US010858403B2

(12) United States Patent
Gil et al.

(10) Patent No.: US 10,858,403 B2
(45) Date of Patent: Dec. 8, 2020

(54) ISOLATED POLYNUCLEOTIDES AND POLYPEPTIDES, AND METHODS OF USING SAME FOR INCREASING PLANT YIELD AND/OR AGRICULTURAL CHARACTERISTICS

(71) Applicant: Evogene Ltd., Rehovot (IL)

(72) Inventors: Lidor Gil, Rehovot (IL); Dror Hilman, Rehovot (IL); Ruth Van-Oss Pinhasi, Kibbutz Shoval (IL); Ronit Rimon Knopf, Modiin (IL); Yaacov Micha Brog, Rehovot (IL); Noa Matarasso, Tel-Aviv (IL); Limor Poraty-Gavra, Rehovot (IL); Yifat Louba Ofir-Birin, Mazkeret Batia (IL); Yael Galon Wolfenson, Rehovot (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 171 days.

(21) Appl. No.: 15/503,411

(22) PCT Filed: Aug. 24, 2015

(86) PCT No.: PCT/IL2015/050849
§ 371 (c)(1),
(2) Date: Feb. 13, 2017

(87) PCT Pub. No.: WO2016/030885
PCT Pub. Date: Mar. 3, 2016

(65) Prior Publication Data
US 2017/0349635 A1    Dec. 7, 2017

Related U.S. Application Data

(60) Provisional application No. 62/114,147, filed on Feb. 10, 2015, provisional application No. 62/042,538, filed on Aug. 27, 2014.

(51) Int. Cl.
*C12N 15/82* (2006.01)
*C07K 14/415* (2006.01)

(52) U.S. Cl.
CPC ........ *C07K 14/415* (2013.01); *C12N 15/8261* (2013.01); *C12N 15/8271* (2013.01)

(58) Field of Classification Search
None
See application file for complete search history.

(56) References Cited

U.S. PATENT DOCUMENTS

| | | | |
|---|---|---|---|
| 6,084,153 A | 7/2000 | Good et al. | |
| 2002/0046419 A1 | 4/2002 | Choo et al. | |
| 2005/0108791 A1 | 5/2005 | Edgerton | |
| 2006/0179511 A1 | 8/2006 | Chomet et al. | |
| 2010/0269213 A2* | 10/2010 | La Rosa | C07K 14/415 800/278 |

FOREIGN PATENT DOCUMENTS

| | | |
|---|---|---|
| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |

(Continued)

OTHER PUBLICATIONS

GenBank Accession BAJ90381, dated May 20, 2011. (Year: 2011).*
UniProt Accession Q0J3D9, integrated on May 1, 2007. (Year: 2007).*
Kaur et al. (Biology direct 10.1 (2015): 70). (Year: 2015).*
Guo et al. (2004, Proc. Natl. Acad. Sci. USA 101: 9205-9210). (Year: 2004).*

(Continued)

*Primary Examiner* — Charles Logsdon

(57) ABSTRACT

Provided are isolated polypeptides which are at least 80% homologous to SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, isolated polynucleotides encoding same, nucleic acid constructs comprising same, transgenic cells expressing same, transgenic plants expressing same and method of using same for increasing yield, abiotic stress tolerance, growth rate, biomass, vigor, oil content, photosynthetic capacity, seed yield, fiber yield, fiber quality, fiber length, and/or nitrogen use efficiency of a plant.

13 Claims, 14 Drawing Sheets

Specification includes a Sequence Listing.

(56) References Cited

FOREIGN PATENT DOCUMENTS

| WO | WO 2012/150598 | 11/2012 |
|---|---|---|
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Wang, et al. (PLoS One 8.7 (2013): e67423). (Year: 2013).*
Haefele et al. (Field Crops Research 107.2 (2008): 137-146). (Year: 2008).*
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Communication Relating to the Results of the Partial International Search dated Nov. 4, 2015 From the International Searching Authority Re. Application No. PCT/IL2015/050849.
International Preliminary Report on Patentability dated Mar. 9, 2017 From the International Bureau of WIPO Re. Application No. PCT/IL2015/050849.
International Search Report and the Written Opinion dated Dec. 7, 2015 From the International Searching Authority Re. Application No. PCT/IL2015/050849.
Karamoko et al. "Lumen Thiol Oxidoreductase1, A Disulfide Bond-Forming Catalyst, Is Required for the Assembly of Photosystem II in *Arabidopsis*", The Plant Cell, 23(12): 4462-4475, Published Online Dec. 30, 2011. Figs.3, 6.
Lu et al. "Thylakoid Membrane Oxidoreductase LTO1/AtVKOR Is Involved in ABA-Mediated Response to Osmotic Stress in *Arabidopsis*", Physiologia Plantarum, 154(1): 28-38, Published Online Oct. 8, 2014. Abstract.
Matsumoto et al. "*Hordeum vulgare* Subsp. *vulgare* mRNA for Predicted Protein, Complete CDS, Clone: NIASHv1091D05", Database NCBI [Online], GeneBank Accession No. AK359170.1, Database Accession No. AK359170, May 20, 2011.

\* cited by examiner pQYN_6669

Normal conditions

Osmotic stress (15 % PEG)

Nitrogen limiting conditions pQNa_RP

ISOLATED POLYNUCLEOTIDES AND POLYPEPTIDES, AND METHODS OF USING SAME FOR INCREASING PLANT YIELD AND/OR AGRICULTURAL CHARACTERISTICS

RELATED APPLICATIONS

This application is a National Phase of PCT Patent Application No. PCT/IL2015/050849 having International filing date of Aug. 24, 2015, which claims the benefit of priority under 35 USC § 119(e) of U.S. Provisional Patent Application Nos. 62/042,538 filed on Aug. 27, 2014 and 62/114,147 filed on Feb. 10, 2015. The contents of the above applications are all incorporated by reference as if fully set forth herein in their entirety.

SEQUENCE LISTING STATEMENT

The ASCII file, entitled 68959SequenceListing.txt, created on Feb. 13, 2017, comprising 17,002,426 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic cells comprising same, transgenic plants exogenously expressing same and more particularly, but not exclusively, to methods of using same for increasing yield (e.g., seed yield, oil yield), biomass, growth rate, vigor, oil content, fiber yield, fiber quality, fiber length, fiber length, photosynthetic capacity, fertilizer use efficiency (e.g., nitrogen use efficiency) and/or abiotic stress tolerance of a plant.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; arabidopsis(dot) org/), TAIR No. AT2G43710)], OleosinA (TAIR No. AT3G01570) or FAD3 (TAIR No. AT2G29980), and various transcription factors and activators such as Lec1 [TAIR No. AT1G21970, Lotan et al. 1998. Cell. 26; 93(7):1195-205], Lec2 [TAIR No. AT1G28300, Santos Mendoza et al. 2005, FEBS Lett. 579 (21):4666-70], Fus3 (TAIR No. AT3G26790), ABI3 [TAIR No. AT3G24650, Lara et al. 2003. J Biol Chem. 278(23): 21003-11] and Wril [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using Arabidopsis FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. Publication No. 20020046419 (U.S. Pat. No. 7,262,055 to Choo, et al.); U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. Nos. 5,981,834, 5,597,718, 5,620,882, 5,521,708 and 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

WO2013/128448 publication discloses isolated polynucleotides and polypeptides and methods of using same for increasing plant yield, biomass, growth rate, vigor, oil content, abiotic stress tolerance of plants and nitrogen use efficiency.

WO 2013/179211 publication discloses isolated polynucleotides and polypeptides, and methods of using same for increasing plant yield and/or agricultural characteristics.

WO2014/033714 publication discloses isolated polynucleotides, polypeptides and methods of using same for increasing abiotic stress tolerance, biomass and yield of plants.

WO2014/102773 publication discloses isolated polynucleotides and polypeptides, and methods of using same for increasing nitrogen use efficiency of plants.

WO2014/102774 publication discloses isolated polynucleotides and polypeptides, construct and plants comprising same and methods of using same for increasing nitrogen use efficiency of plants.

WO2014/188428 publication discloses isolated polynucleotides and polypeptides, and methods of using same for increasing plant yield and/or agricultural characteristics.

WO2015/029031 publication discloses isolated polynucleotides and polypeptides, and methods of using same for increasing plant yield and/or agricultural characteristics.

SUMMARY OF THE INVENTION

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide at least 80% identical to SEQ ID NO: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, 6563-6588 or 6589, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide comprising a nucleic acid sequence encoding a polypeptide at least 80% homologous to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, wherein the crop plant is derived from plants which have been transformed with the exogenous polynucleotide and which have been selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence at least 80% identical to SEQ ID NO: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, 3619-3649 or 3650, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising the nucleic acid sequence selected from the group consisting of SEQ ID NOs: 1-42, 44-57, 59-181, and 298-3650, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650, wherein the crop plant is derived from plants which have been transformed with the exogenous polynucleotide and which have been selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, 6563-6588 or 6589, wherein the amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to an aspect of some embodiments of the present invention there is provided an isolated polynucleotide comprising a nucleic acid sequence at least 80% identical to SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650, wherein the nucleic acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising the nucleic acid sequence selected from the group consisting of SEQ ID NOs: 1-42, 44-57, 59-181, and 298-3650.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 44814813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, 6563-6588 or 6589, wherein the amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polypeptide comprising the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to an aspect of some embodiments of the present invention there is provided a plant cell exogenously expressing the polynucleotide of claim 7, 8, 9 or 10, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence encodes an amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention, the nucleic acid sequence is selected from the group consisting of SEQ ID NOs: 1-42, 44-57, 59-181, and 298-3650.

According to some embodiments of the invention, the polynucleotide consists of the nucleic acid sequence selected from the group consisting of SEQ ID NOs: 1-42, 44-57, 59-181, and 298-3650.

According to some embodiments of the invention, the nucleic acid sequence encodes the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nitrogen deficiency, nutrient excess, atmospheric pollution and UV irradiation.

According to some embodiments of the invention, the yield comprises seed yield or oil yield.

According to an aspect of some embodiments of the present invention there is provided a transgenic plant comprising the nucleic acid construct of any of claims 11 and 16-19 or the plant cell of any of claims 14-20 and 22-23.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to an aspect of some embodiments of the present invention there is provided a method of growing a crop, the method comprising seeding seeds and/or planting plantlets of a plant transformed with the isolated polynucleotide of claim 7, 8, 9, or 10, or with the nucleic acid construct of claim 11, wherein the plant is derived from plants which have been transformed with the exogenous polynucleotide and which have been selected for at least one trait selected from the group consisting of: increased nitrogen use efficiency, increased abiotic stress tolerance, increased biomass, increased growth rate, increased vigor, increased yield, increased fiber yield, increased fiber quality, increased fiber length, increased photosynthetic capacity, and increased oil content as compared to a non-transformed plant, thereby growing the crop.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

According to some embodiments of the invention, the method further comprising selecting a plant having an increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the present invention there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% homologous to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the present invention there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide at least 80% identical to the nucleic acid sequence selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to some embodiments of the invention, selecting is performed under non-stress conditions.

According to some embodiments of the invention, selecting is performed under abiotic stress conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions.

FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
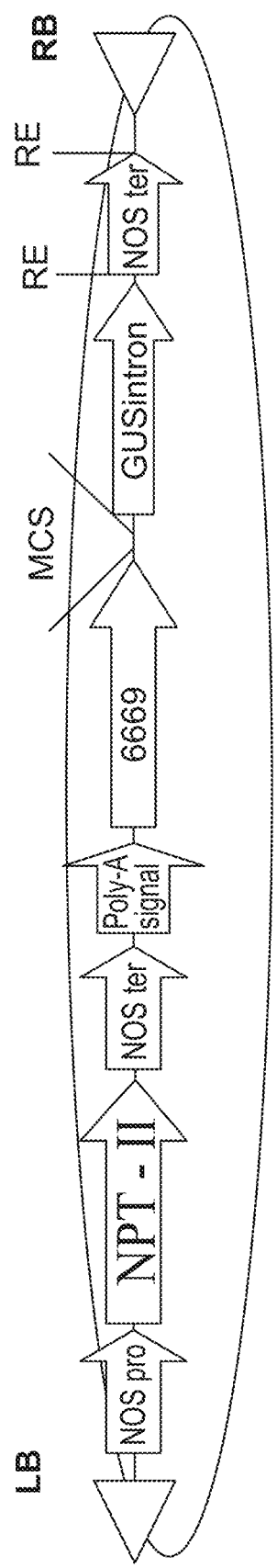
FIG. 1 is a schematic illustration of the modified pGI binary plasmid containing the new At6669 promoter (SEQ ID NO: 6614) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator, Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
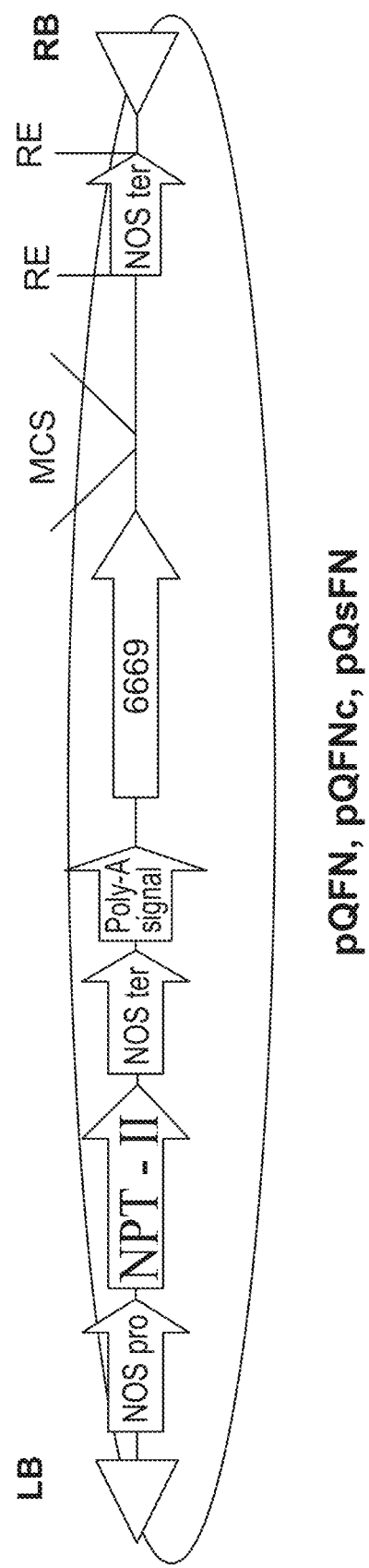
FIG. 2 is a schematic illustration of the modified pGI binary plasmid containing the new At6669 promoter (SEQ ID NO: 6614) (pQFN or pQFNc or pQsFN) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator, Poly-A signal (polyadenylation signal); The isolated polynucleotide sequences of the invention were cloned into the MCS of the vector.
Figure 3A:
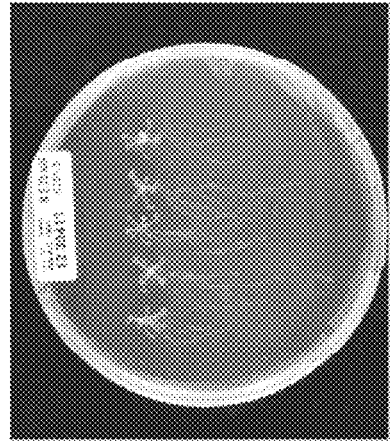
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
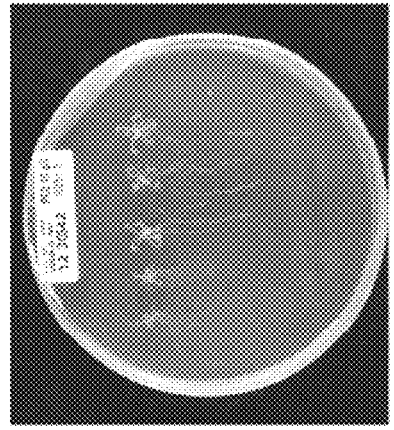
Figure 3E:
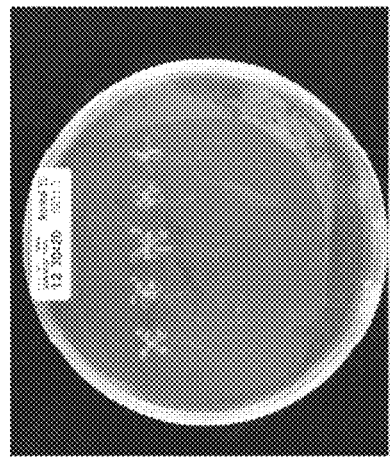
Figure 3B:
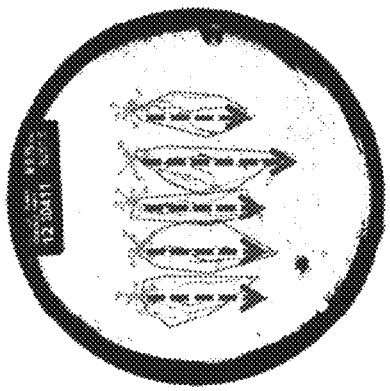
Figure 3D:
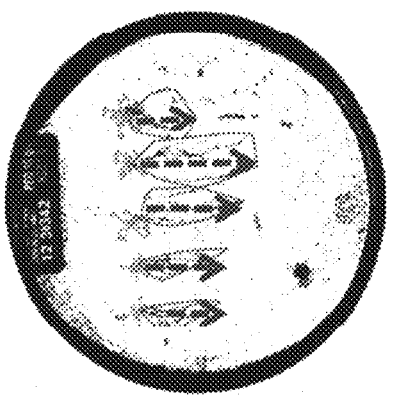
Figure 3F:
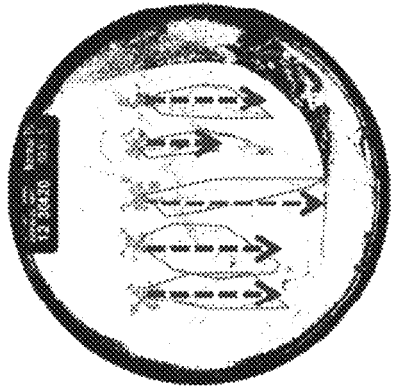
Figure 4:
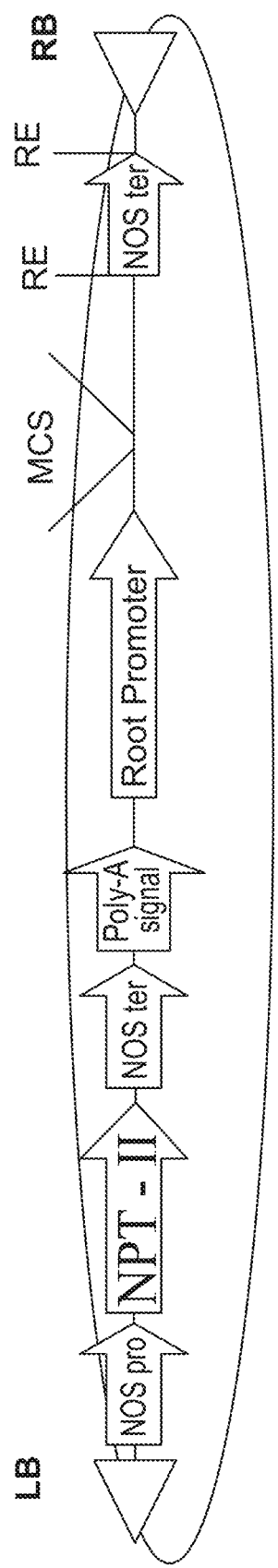
FIG. 4 is a schematic illustration of the modified pGI binary plasmid containing the Root Promoter (pQNa RP) used for expressing the isolated polynucleotide sequences of the invention. RB—T-DNA right border, LB—T-DNA left border; NOS pro=nopaline synthase promoter; NPT-II=neomycin phosphotransferase gene; NOS ter=nopaline synthase terminator, Poly-A signal (polyadenylation signal); The isolated polynucleotide sequences according to some embodiments of the invention were cloned into the MCS (Multiple cloning site) of the vector.
Figure 5:
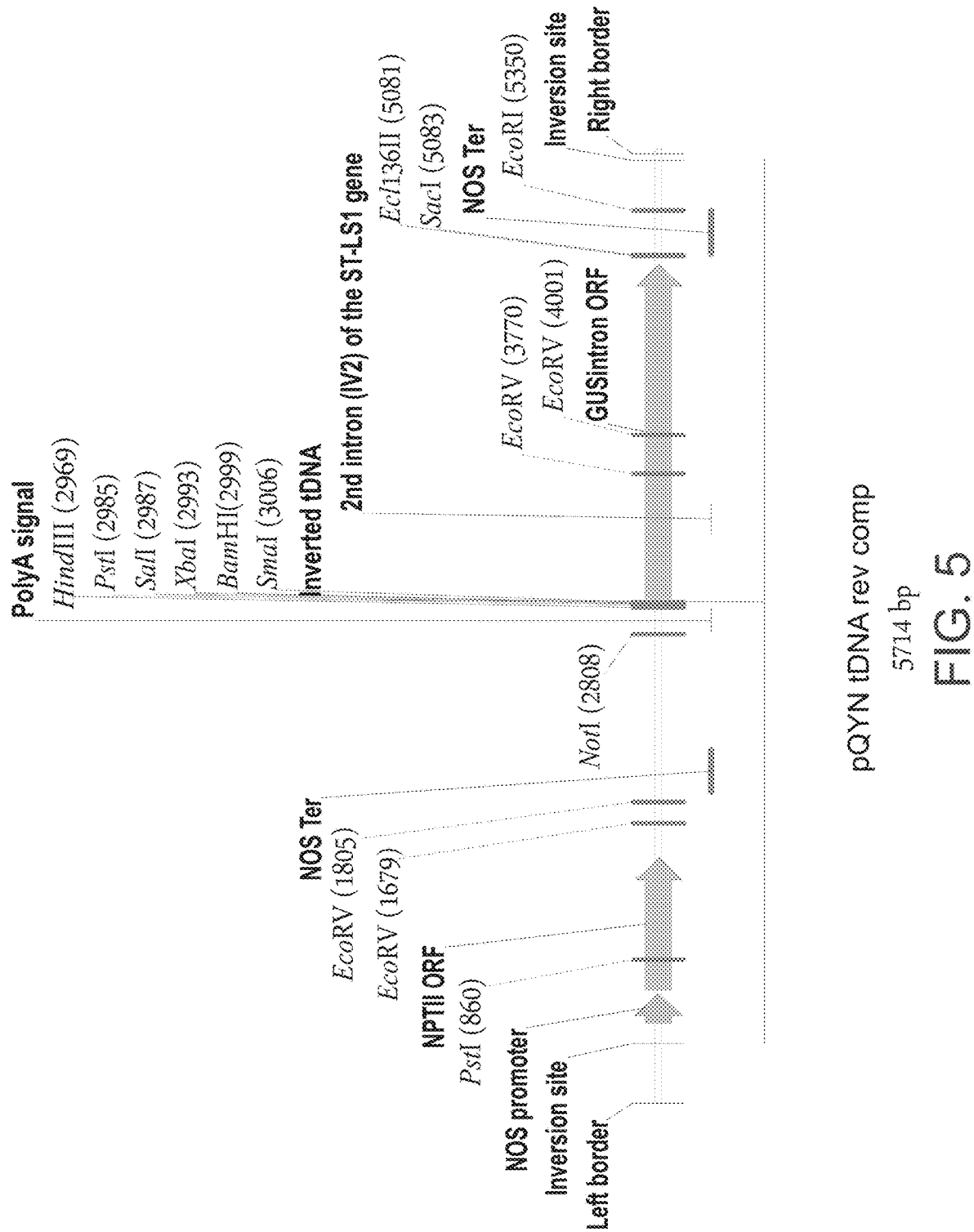
FIG. 5 is a schematic illustration of the pQYN plasmid.
Figure 6:
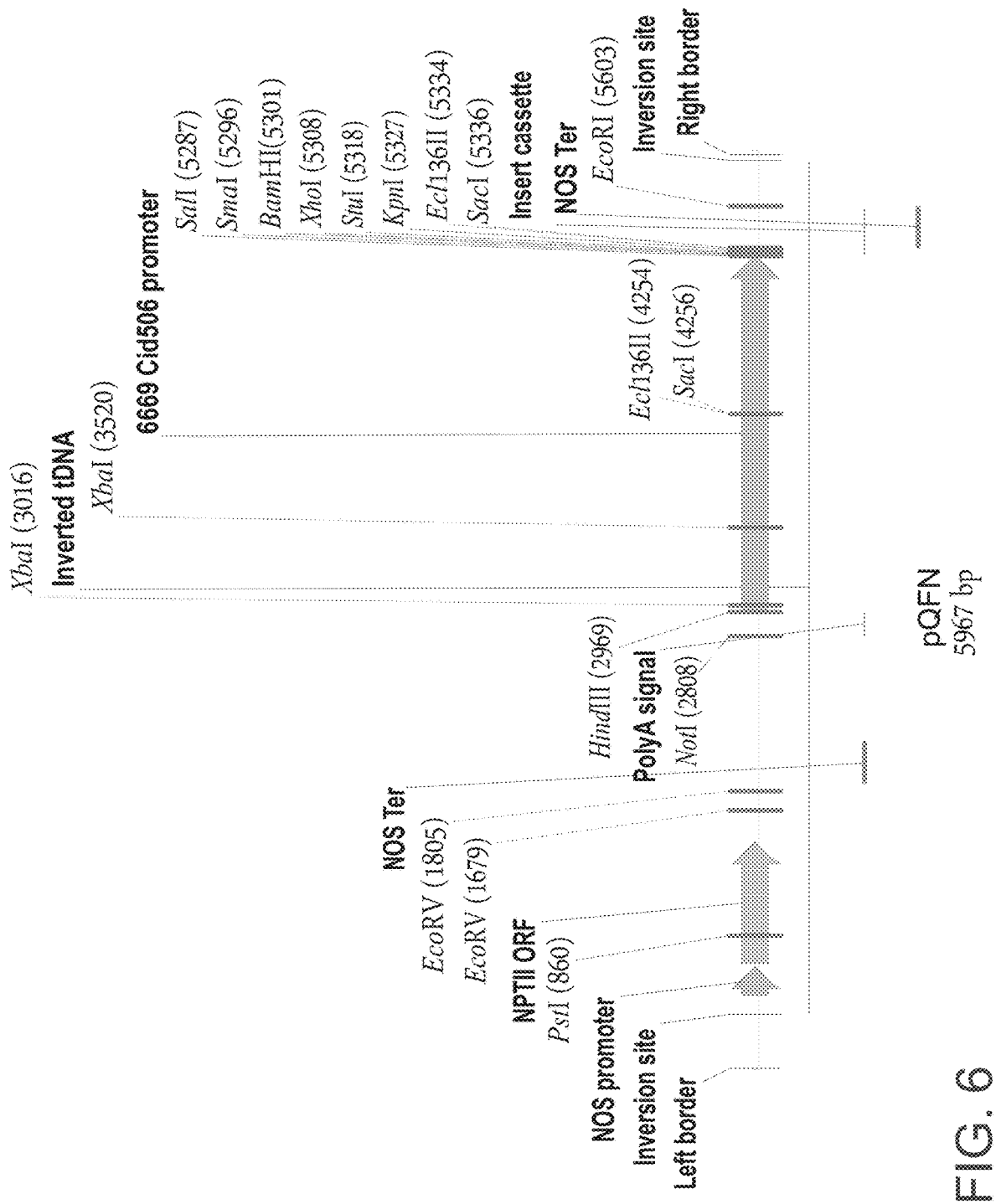
FIG. 6 is a schematic illustration of the pQFN plasmid.
Figure 7:
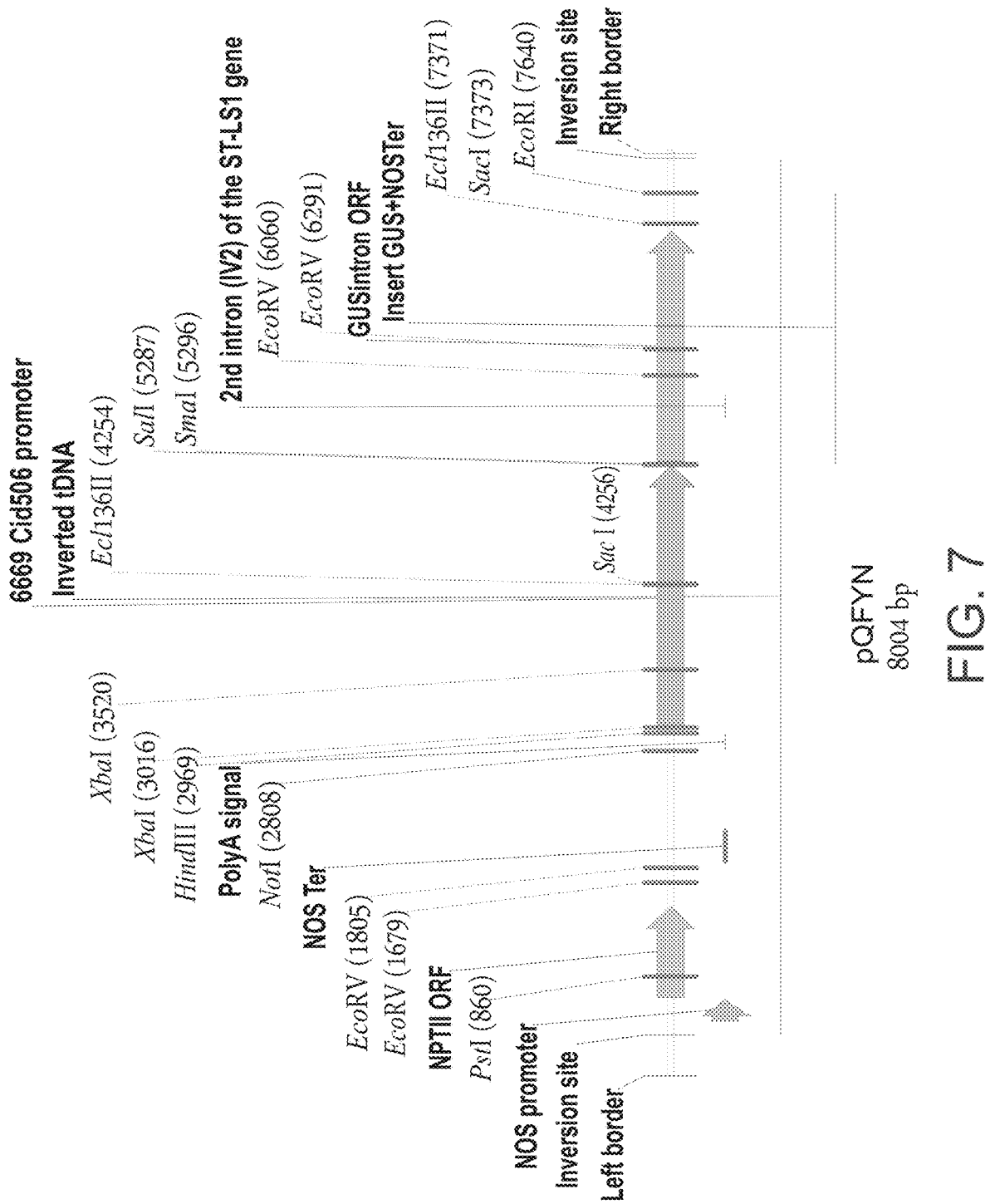
FIG. 7 is a schematic illustration of the pQFYN plasmid.
Figure 8:
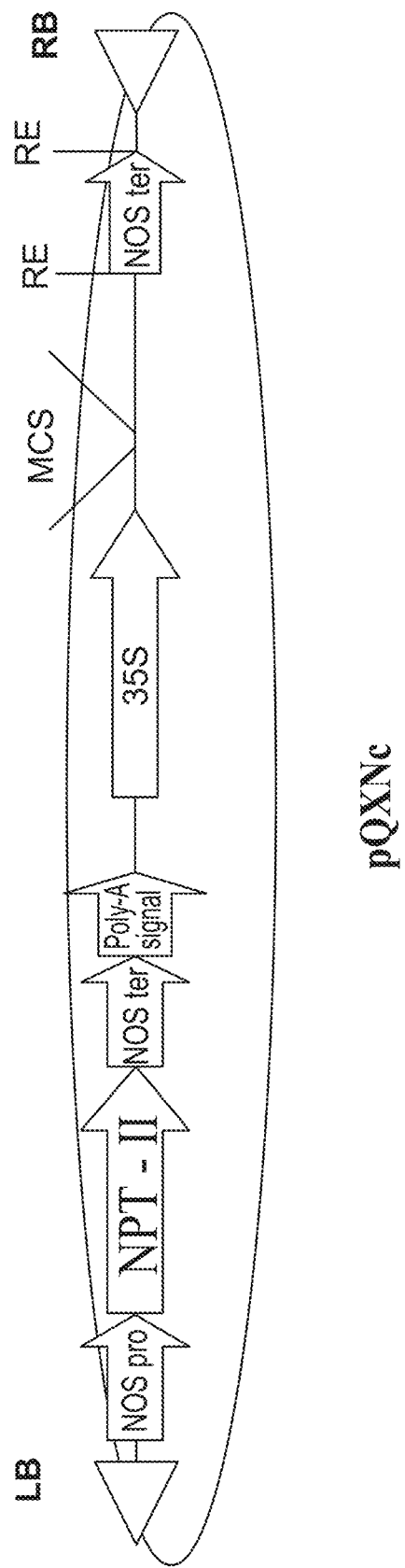
FIG. 8 is a schematic illustration of the modified pGI binary plasmid (pQXNc) used for expressing the isolated polynucleotide sequences of some embodiments of the invention. RB—T-DNA right border, LB—T-DNA left border, NOS pro=nopaline synthase promoter NPT-II=neomycin phosphotransferase gene; NOS ter=nopaline synthase terminator, RE=any restriction enzyme; Poly-A signal (polyadenylation signal); 35S—the 35S promoter (pQXNc); SEQ ID NO: 6610). The isolated polynucleotide sequences of some embodiments of the invention were cloned into the MCS (Multiple cloning site) of the vector.

The present inventors have identified novel polypeptides and polynucleotides which can be used to generate nucleic acid constructs, transgenic plants and to increase nitrogen use efficiency, fertilizer use efficiency, yield, growth rate, vigor, biomass, oil content, fiber yield, fiber quality, fiber length, photosynthetic capacity, abiotic stress tolerance and/or water use efficiency of a plant, such as a wheat plant.

Thus, as shown in the Examples section which follows, the present inventors have utilized bioinformatics tools to identify polynucleotides which enhance/increase fertilizer use efficiency (e.g., nitrogen use efficiency), yield (e.g., seed yield, oil yield, oil content), growth rate, biomass, vigor, fiber yield, fiber quality, fiber length, photosynthetic capacity, and/or abiotic stress tolerance of a plant. Genes which affect the trait-of-interest were identified [SEQ ID NOs: 182-297 for polypeptides; and SEQ ID NOs: 1-181 for polynucleotides] based on expression profiles of genes of several *Sorghum*, Maize, Foxtail millet, Barley, tomato, soybean, *Arabidopsis*, bean, and cotton ecotypes, varieties and/or accessions in various tissues and growth conditions, homology with genes known to affect the trait-of-interest and using digital expression profile in specific tissues and conditions (Tables 1-178, Examples 1-18 of the Examples section which follows). Homologous (e.g., orthologous) polypeptides and polynucleotides having the same function in increasing fertilizer use efficiency (e.g., nitrogen use efficiency), yield (e.g., seed yield, oil yield, oil content), growth rate, biomass, vigor, fiber yield, fiber quality, fiber length, photosynthetic capacity, and/or abiotic stress tolerance of a plant were also identified [SEQ ID NOs: 3651-6589 (for polypeptides), and SEQ ID NOs: 298-3650 (for polynucleotides); Table 179, Example 19 of the Examples section which follows]. The polynucleotides of some embodiments of the invention were cloned into binary vectors (Example 20, Table 180), and were further transformed into *Arabidopsis* plants (Examples 21-22). Transgenic plants over-expressing the identified polynucleotides were found to exhibit increased biomass, growth rate, vigor and yield under normal growth conditions, under drought growth conditions or under nitrogen limiting growth conditions and increased tolerance to abiotic stress conditions (e.g., drought stress, nutrient deficiency) as compared to control plants grown under the same growth conditions (Examples 24-26, Tables 181-203). Altogether, these results suggest the use of the novel polynucleotides and polypeptides of the invention (e.g., SEQ ID NOs: 1-181 and 298-

3650 and SEQ ID NOs: 182-297 and 3651-6589) for increasing nitrogen use efficiency, fertilizer use efficiency, yield (e.g., oil yield, seed yield and oil content), growth rate, biomass, vigor, fiber yield, fiber quality, fiber length, photosynthetic capacity, water use efficiency and/or abiotic stress tolerance of a plant.

Thus, according to an aspect of some embodiments of the invention, there is provided method of increasing oil content, yield, seed yield, growth rate, biomass, vigor, fiber yield, fiber quality, fiber length, photosynthetic capacity, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589, e.g., using an exogenous polynucleotide which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the polynucleotide selected from the group consisting of SEQ ID NOs: 1-42, 44-57, 59-181, and 298-3650, thereby increasing the oil content, yield, seed yield, growth rate, biomass, vigor, fiber yield, fiber quality, fiber length, photosynthetic capacity, fertilizer use efficiency (e.g., nitrogen use efficiency) and/or abiotic stress tolerance of the plant.

According to an aspect of some embodiments of the invention, there is provided method of increasing oil content, yield, growth rate, biomass, vigor, fiber yield, fiber quality, fiber length, photosynthetic capacity, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, thereby increasing the oil content, yield, growth rate, biomass, vigor, fiber yield, fiber quality, fiber length, photosynthetic capacity, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor, growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the term "root biomass" refers to the total weight of the plant's root(s). Root biomass can be determined directly by weighing the total root material (fresh and/or dry weight) of a plant.

Additional or alternatively, the root biomass can be indirectly determined by measuring root coverage, root density and/or root length of a plant.

It should be noted that plants having a larger root coverage exhibit higher fertilizer (e.g., nitrogen) use efficiency and/or higher water use efficiency as compared to plants with a smaller root coverage.

As used herein the phrase "root coverage" refers to the total area or volume of soil or of any plant-growing medium encompassed by the roots of a plant.

According to some embodiments of the invention, the root coverage is the minimal convex volume encompassed by the roots of the plant.

It should be noted that since each plant has a characteristic root system, e.g., some plants exhibit a shallow root system (e.g., only a few centimeters below ground level), while others have a deep in soil root system (e.g., a few tens of centimeters or a few meters deep in soil below ground level), measuring the root coverage of a plant can be performed in any depth of the soil or of the plant-growing medium, and comparison of root coverage between plants of the same species (e.g., a transgenic plant exogenously expressing the polynucleotide of some embodiments of the invention and a control plant) should be performed by measuring the root coverage in the same depth.

According to some embodiments of the invention, the root coverage is the minimal convex area encompassed by the roots of a plant in a specific depth.

Figure 10:
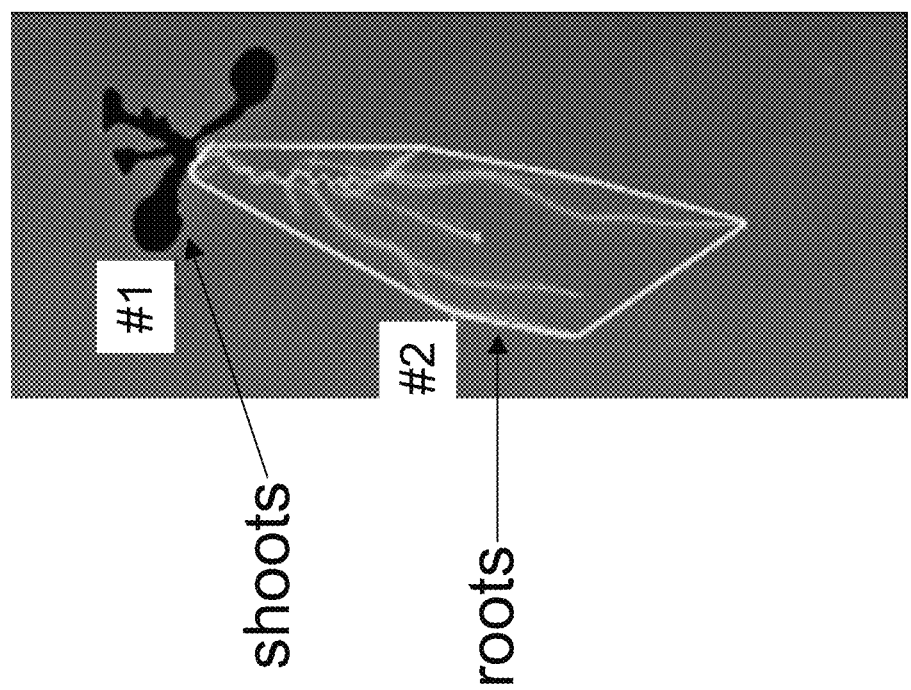
FIG. 10 depicts seedling analysis of an *Arabidopsis* plant having shoots (upper part, marked "#1") and roots (lower part, marked "#2"). Using an image analysis system the minimal convex area encompassed by the roots is determined. Such area corresponds to the root coverage of the plant.

A non-limiting example of measuring root coverage is shown in FIG. 10.

As used herein the term "root density" refers to the density of roots in a given area (e.g., area of soil or any plant growing medium). The root density can be determined by counting the root number per a predetermined area at a predetermined depth (in units of root number per area, e.g., $mm^2$, $cm^2$ or $m^2$).

As used herein the phrase "root length" refers to the total length of the longest root of a single plant.

As used herein the phrase "root length growth rate" refers to the change in total root length per plant per time unit (e.g., per day).

As used herein the phrase "growth rate" refers to the increase in plant organ/tissue size per time (can be measured in $cm^2$ per day or cm/day).

As used herein the phrase "photosynthetic capacity" (also known as "$A_{max}$") is a measure of the maximum rate at which leaves are able to fix carbon during photosynthesis. It is typically measured as the amount of carbon dioxide that is fixed per square meter per second, for example as $\mu mol\ m^{-2}\ sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modem rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant trait such as yield, growth rate, biomass, vigor, oil content, fiber yield, fiber quality, fiber length, photosynthetic capacity, fertilizer use efficiency (e.g., nitrogen use efficiency) can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

Following is a non-limiting description of non-stress (normal) growth conditions which can be used for growing the transgenic plants expressing the polynucleotides or polypeptides of some embodiments of the invention.

For example, normal conditions for growing *sorghum* include irrigation with about 452,000 liter water per dunam (1000 square meters) and fertilization with about 14 units nitrogen per dunam per growing season.

Normal conditions for growing cotton include irrigation with about 580,000 liter water per dunam (1000 square meters) and fertilization with about 24 units nitrogen per dunam per growing season.

Normal conditions for growing bean include irrigation with about 524,000 liter water per dunam (1000 square meters) and fertilization with about 16 units nitrogen per dunam per growing season.

Normal conditions for growing *B. Juncea* include irrigation with about 861,000 liter water per dunam (1000 square meters) and fertilization with about 12 units nitrogen per dunam per growing season.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield. It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and Agave spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As mentioned hereinabove, transgenic plants of the present invention can be used for improving myriad of commercially desired traits which are all interrelated as is discussed hereinbelow.

As used herein the term "trait" refers to a characteristic or quality of a plant which may overall (either directly or indirectly) improve the commercial value of the plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in the trait [e.g., yield, seed yield, biomass, growth rate, vigor, oil content, fiber yield, fiber quality, fiber length, photosynthetic capacity, abiotic stress tolerance, and/or nitrogen use efficiency] of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y (Sequence-Evolution-Function: Computational Approaches in Comparative Genomics. Boston: Kluwer Academic; 2003. Chapter 2, Evolutionary Concept in Genetics and Genomics. Available from: ncbi(dot)nlm(dot)nih (dot)gov/books/NBK20255) and therefore have great likelihood of having the same function.

A non-limiting example of a reduction to practice with respect to homologues (e.g., orthologues) is described hereinbelow. As shown in Tables 192-194 below, LGB5 (the polypeptides set forth by SEQ ID NO:191) and an orthologue thereof (e.g., MGP22, the polypeptide set forth by SEQ ID NO:251), which exhibits 83.23% sequence identity to LGB5 have the same beneficial effect in a plant (e.g., capable of increasing the same plant trait(s)) such as increasing biomass (e.g., dry weight and fresh weight), nitrogen use efficiency (e.g., as is shown by the increase in root area and root coverage), growth rate (e.g., as is demonstrated by the increase in the relative growth rate of root coverage, leaf area and root length) of a plant as compared to control plant(s) grown under the same growth conditions.

One option to identify orthologues in monocot plant species is by performing a reciprocal blast search. This may be done by a first blast involving blasting the sequence-of-interest against any sequence database, such as the publicly available NCBI database which may be found at: ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [ebi (dot) ac (dot) uk/Tools/clustalw2/index (dot) html], followed by a neighbor-joining tree (wikipedia(dot)org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9]. Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration (dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cutoff—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter):

EMBOSS-6.0.1 Needleman-Wunsch algorithm with the following modified parameters: gapopen=8 gapextend=2. The rest of the parameters are unchanged from the default options listed here:

Standard (Mandatory) Qualifiers:

[-asequence]    sequence    Sequence filename and optional format, or reference (input USA)
[-bsequence]    seqall    Sequence(s) filename and optional format, or reference (input USA)
-gapopen    float    [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)
-gapextend    float    [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)
[-outfile]    align    [*.needle] Output alignment file name Additional (Optional) Qualifiers:

-datafile    matrixf    [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.

Advanced (Unprompted) Qualifiers:

-[no]brief    boolean    [Y] Brief identity and similarity

Associated Qualifiers:

"-asequence" associated qualifiers
-sbegin1    integer    Start of the sequence to be used
-send1    integer    End of the sequence to be used
-sreverse1    boolean    Reverse (if DNA)
-sask1    boolean    Ask for begin/end/reverse
-snucleotide1    boolean    Sequence is nucleotide
-sprotein1    boolean    Sequence is protein
-slower1    boolean    Make lower case
-supper1    boolean    Make upper case
-sformat1    string    Input sequence format
-sdbname1    string    Database name
-sid1    string    Entryname
-ufo1    string    UFO features
-fformat1    string    Features format
-fopenfile1    string    Features file name
"-bsequence" associated qualifiers
-sbegin2    integer    Start of each sequence to be used -continued -send2    integer    End of each sequence to be used
-sreverse2    boolean    Reverse (if DNA)
-sask2    boolean    Ask for begin/end/reverse
-snucleotide2    boolean    Sequence is nucleotide
-sprotein2    boolean    Sequence is protein
-slower2    boolean    Make lower case
-supper2    boolean    Make upper case
-sformat2    string    Input sequence format
-sdbname2    string    Database name
-sid2    string    Entryname
-ufo2    string    UFO features
-fformat2    string    Features format
-fopenfile2    string    Features file name
"-outfile" associated qualifiers
-aformat3    string    Alignment format
-aextension3    string    File name extension
-adirectory3    string    Output directory -continued -aname3    string    Base file name
-awidth3    integer    Alignment width
-aaccshow3    boolean    Show accession number in the header
-adesshow3    boolean    Show description in the header
-ausashow3    boolean    Show the full USA in the alignment
-aglobal3    boolean    Show the full sequence in alignment General Qualifiers:

-auto    boolean    Turn off prompts
-stdout    boolean    Write first file to standard output
-filter    boolean    Read first file from standard input, write first file to standard output
-options    boolean    Prompt for standard and additional values
-debug    boolean    Write debug output to program.dbg
-verbose    boolean    Report some/full command line options
-help    boolean    Report command line options. More information on associated and general qualifiers can be found with -help -verbose
-warning    boolean    Report warnings
-error    boolean    Report errors
-fatal    boolean    Report fatal errors
-die    boolean    Report dying program messages 2. Between a Protein Sequence and a Nucleotide Sequence (Following the tblastn Filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:

Usage:
om -model=<model_fname> [-q=]query [-db=]database [options]
-model=<model_fname> Specifies the model that you want to run. All models supplied by Compugen are located in the directory $CGNROOT/models/.
Valid Command Line Parameters:
-dev=<dev_name> Selects the device to be used by the application.
   Valid Devices are:
   bic-Bioccelerator (valid for SW, XSW, FRAME_N2P, and FRAME_P2N models).
   xlg-BioXL/G (valid for all models except XSW).
   xlp-BioXL/P (valid for SW, FRAME+_N2P, and FRAME_P2N models).
   xlh-BioXL/H (valid for SW, FRAME+_N2P, and FRAME_P2N models).
   soft-Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name> Chooses the database set. The database set can be a sequence file or a database reference. The database format is detected automatically. However, you may specify a format using -dfmt parameter.
-qacc Add this parameter to the command line if you specify query using accession numbers.
-dacc Add this parameter to the command line if you specify a database using accession numbers.
-dfmt/-qfmt=<format_type> Chooses the database/query format type. Possible formats are:
   fasta-fasta with seq type auto-detected.
   fastap-fasta protein seq.
   fastan-fasta nucleic seq.
   gcg-gcg format, type is auto-detected.
   gcg9seq-gcg9 format, type is auto-detected.
   gcg9seqp-gcg9 format protein seq.
   gcg9seqn-gcg9 format nucleic seq.
   nbrf-nbrf seq, type is auto-detected.
   nbrfp-nbrf protein seq.
   nbrfn-nbrf nucleic seq.
   embl-embl and swissprot format.
   genbank-genbank format (nucleic).
   blast-blast format.
   nbrf_gcg-nbrf-gcg seq, type is auto-detected.
   nbrf_gcgp-nbrf-gcg protein seq.
   nbrf_gcgn-nbrf-gcg nucleic seq.
   raw-raw ascii sequence, type is auto-detected.
   rawp-raw ascii protein sequence.
   rawn-raw ascii nucleic sequence.
   pir-pir codata format, type is auto-detected.
   profile-gcg profile (valid only for -qfmt
   in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
   Valid for SW and XSW.
-dtrans Performs a translated search, relevant for a protein query against a DNA database. Each database entry is translated to six reading frames and a result is given for each frame.
   Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
   zscore.
   escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS.
Possible values are:
   PFS-PFS text format
   FASTA-FASTA text format
   BLAST-BLAST text format
-nonorm Do not perform score normalization.
-norm=<norm_name> Specifies the normalization method.
Valid options are:
   log-logarithm normalization.
   std-standard normalization.
   stat-Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.

-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note:"-batch" and "-wait" parameters are mutually exclusive.
-version Prints the software version number.
-help Displays this help message. To get more specific help type:
  "om -model=<model_fname>-help".
According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589.

According to some embodiments of the invention, the exogenous polynucleotide of the invention encodes a polypeptide having the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention, the method of increasing yield, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, thereby increasing the yield, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO:

182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 49604963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, 6503-6588 or 6589.

According to an aspect of some embodiments of the invention, the method of increasing yield, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589, thereby increasing the yield, biomass, growth rate, vigor, oil content, fiber yield, fiber quality, fiber length, photosynthetic capacity, abiotic stress tolerance, and/or nitrogen use efficiency of the plant.

According to an aspect of some embodiments of the invention, there is provided a method of increasing yield, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589, thereby increasing the yield, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650.

According to an aspect of some embodiments of the invention, there is provided a method of increasing yield, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650, thereby increasing the yield, biomass, growth rate, vigor, oil content, fiber yield, fiber quality, fiber length, photosynthetic capacity, abiotic stress tolerance, and/or nitrogen use efficiency of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650.

According to some embodiments of the invention the exogenous polynucleotide is set forth by SEQ ID NO: 1-42, 44-57, 59-181, and 298-3650.

According to some embodiments of the invention the method of increasing yield, growth rate, biomass, vigor, oil content, seed yield, fiber yield, fiber quality, fiber length, photosynthetic capacity, nitrogen use efficiency, and/or abiotic stress tolerance of a plant further comprising selecting a plant having an increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

It should be noted that selecting a transformed plant having an increased trait as compared to a native (or non-transformed) plant grown under the same growth conditions can be performed by selecting for the trait, e.g., validating the ability of the transformed plant to exhibit the increased trait using well known assays (e.g., seedling analyses, greenhouse assays, field experiments) as is further described herein below.

According to some embodiments of the invention selecting is performed under non-stress conditions.

According to some embodiments of the invention selecting is performed under abiotic stress conditions.

According to some embodiments of the invention selecting is performed under nitrogen limiting (e.g., nitrogen deficient) conditions.

According to an aspect of some embodiments of the invention, there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (e.g., having sequence similarity or sequence identity) to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance (e.g., by selecting the plants for the increased trait), thereby selecting the plant having increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the invention, there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance, thereby selecting the plant having increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase "non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs:377, 397, 1007, 1526, 1555, 1556, 1557, 1561, 1573, 1650, 2120, 2445, 2538, 3233, 3527, and 3588.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the exogenous polynucleotide encodes a polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention, the polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 182-216, 219-223, 225-233, 235-238, 240-260, 262-297, 3651-3675, 36774327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650.

According to some embodiments of the invention the nucleic acid sequence is capable of increasing nitrogen use efficiency, fertilizer use efficiency, yield (e.g., seed yield, oil yield), growth rate, vigor, biomass, oil content, fiber yield, fiber quality, fiber length, photosynthetic capacity, abiotic stress tolerance and/or water use efficiency of a plant.

According to some embodiments of the invention the isolated polynucleotide comprising the nucleic acid sequence selected from the group consisting of SEQ ID NOs: 1-42, 44-57, 59-181, and 298-3650.

According to some embodiments of the invention the isolated polynucleotide is set forth by SEQ ID NO: 1-42, 44-57, 59-181, and 298-3650.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589.

According to some embodiments of the invention the amino acid sequence is capable of increasing nitrogen use efficiency, fertilizer use efficiency, yield, seed yield, growth rate, vigor, biomass, oil content, fiber yield, fiber quality, fiber length, photosynthetic capacity, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to an amino acid sequence selected from the group consisting of SEQ ID NO: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589.

In an exemplary embodiment the polypeptide is not the polypeptide set forth by SEQ ID NO: 217-218, 224, 234, 239, 261, 3676, 4328, 4816-4817, 4819-4820, 4828-4829, 4831-4832, 4834, 4841-4842, 4845, 4849, 4856-4857, 4859-4860, 4863-4864, 4871-4872, 4883, 4885-4887, 4894, 4897-4898, 4903, 4905, 4907-4911, 4914-4917, 4920-4921, 4923, 4925-4928, 4942-4943, 4949, 4953-4954, 4958-4959, 4964-4965, 4967, 4972, 4998, 5051-5052, 5308, 5327, 5341, 5348-5349, 5359-5360, 5398-5400, 5403-5406, 5409, 5430-5432, 5440-5441, 5457, 5462, 5464, 5787, 5789, 5794, 5797, 5801, 5805, 5807-5808, 5819, 5824, 5827-5828, 5833-5834, 5854, 5871, 5874, 5877-5878, 5880, 5891, 5897, 5899, 5908, 5911, 5926-5927, 5931, 5934, 5942, 5944-5945, 5948, 5958, 5965, 5971, 5973, 5992-5993, 5996-5997, 6002, 6006, 6102, 6120, 6155, 6162, 6199, 6244, 6272, or 6502.

According to some embodiments of the invention, the polypeptide comprising an amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention, the polypeptide is set forth by SEQ ID NO: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, 6503-6588 or 6589.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising Acacia spp., Acer spp., Actinidia spp., Aesculus spp., Agathis australis, Albizia amara, Alsophila tricolor, Andropogon spp., Arachis spp, Areca catechu, Astelia fragrans, Astragalus cicer, Baikiaea plurijuga, Betula spp., Brassica spp., Bruguiera gymnorrhiza, Burkea africana, Butea frondosa, Cadaba farinosa, Calliandra spp, Camellia sinensis, Canna indica, Capsicum spp., Cassia spp., Centroema pubescens, Chacoomeles spp., Cinnamomum cassia, Coffea arabica, Colophospermum mopane, Coronillia varia,

*Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, *lupinus*, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 6590; Albanietal, Plant Cell, 9: 171-184, 1997, which is fully incorporated herein by reference), wheat LMW (SEQ ID NO: 6591 (longer LMW promoter), and SEQ ID NO: 6592 (LMW promoter) and HMW glutenin-1 (SEQ ID NO: 6593 (Wheat HMW glutenin-1 longer promoter); and SEQ ID NO: 6594 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 6595 (wheat alpha gliadin, B genome, promoter); SEQ ID NO: 6596 (wheat gamma gliadin promoter); EMBO 3:1409-15, 1984, which is fully incorporated herein by reference], wheat TdPR60 [SEQ ID NO: 6597 (wheat TdPR60 longer promoter) or SEQ ID NO: 6598 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO: 6599); GenBank: DQ141598.1; Taylor et al., Plant Cell Rep 1993 12: 491-495, which is fully incorporated herein by reference; and cultivar B73 (SEQ ID NO: 6600); Christensen, A H, et al. Plant Mol. Biol. 18 (4), 675-689 (1992), which is fully incorporated herein by reference]; rice actin 1 (SEQ ID NO: 6601; Mc Elroy et al. 1990, The Plant Cell, Vol. 2, 163-171, which is fully incorporated herein by reference), rice GOS2 [SEQ ID NO: 6602 (rice GOS2 longer promoter) and SEQ ID NO: 6603 (rice GOS2 Promoter); De Pater et al. Plant J. 1992; 2: 837-44, which is fully incorporated herein by reference], *arabidopsis* Pho1 [SEQ ID NO: 6604 (*arabidopsis* Pho1 Promoter); Hamburger et al., Plant Cell. 2002; 14: 889-902, which is fully incorporated herein by reference], ExpansinB promoters, e.g., rice ExpB5 [SEQ ID NO: 6605 (rice ExpB5 longer promoter) and SEQ ID NO: 6606 (rice ExpB5 promoter)] and Barley ExpB1 [SEQ ID NO: 6607 (barley ExpB1 Promoter), Won et al. Mol Cells. 2010; 30:369-76, which is fully incorporated herein by reference], barley SS2 (sucrose synthase 2) [(SEQ ID NO: 6608), Guerin and Carbonero, *Plant Physiology May* 1997 vol. 114 no. 1 55-62, which is fully incorporated herein by reference], and rice PG5a [SEQ ID NO: 6609, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 6610 (CaMV 35S (pQXNc) Promoter); SEQ ID NO: 6611 (PJJ 35S from Brachypodium); SEQ ID NO: 6612 (CaMV 35S (OLD) Promoter) (Odell et al., Nature 313:810-812, 1985)], *Arabidopsis* At6669 promoter (SEQ ID NO: 6613 (*Arabidopsis* At6669 (OLD) Promoter); see PCT Publication No. WO04081173A2 or the new At6669 promoter (SEQ ID NO: 6614 (*Arabidopsis* At6669 (NEW) Promoter)); maize Ub1 Promoter [cultivar Nongda 105 (SEQ ID NO: 6599); GenBank: DQ141598.1; Taylor et al., Plant Cell Rep 1993 12: 491-495, which is fully incorporated herein by reference; and cultivar B73 (SEQ ID NO: 6600); Christensen, A H, et al. Plant Mol. Biol. 18 (4), 675-689 (1992), which is fully incorporated herein by reference]; rice actin 1 (SEQ ID NO: 6601, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 6602 (rice GOS2 longer Promoter) and SEQ ID NO: 6603 (rice GOS2 Promoter), de Pater et al, Plant J November; 2(6):837-44, 1992]; RBCS promoter (SEQ ID NO: 6615); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 6616), AT5G61520 (AtSTP3) (low expression, SEQ ID NO: 6617) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 6618 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 6609; U.S. Pat. No. 7,700, 835), early seed development *Arabidopsis* BAN (AT1G61720) (SEQ ID NO: 6619, US 2009/0031450 A1), late seed development *Arabidopsis* ABI3 (AT3G24650) (SEQ ID NO: 6620 (*Arabidopsis* ABI3 (AT3G24650) longer Promoter) or 6621 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (SEQ ID NO: 6590; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 6591 (Wheat LMW Longer Promoter), and SEQ ID NO: 6592 (Wheat LMW Promoter) and HMW glutenin-1 [(SEQ ID NO: 6593 (Wheat HMW glutenin-1 longer Promoter)); and SEQ ID NO: 6594 (Wheat HMW glutenin-1 Promoter), Thomas and Flavell, The Plant Cell 2:1171-1180, 1990; Mol Gen Genet 216:81-90, 1989; NAR17:461-2), wheat alpha, beta and gamma gliadins (SEQ ID NO: 6595 (wheat alpha gliadin (B genome) promoter); SEQ ID NO: 6596 (wheat gamma gliadin promoter); EMBO 3:1409-15, 1984), Barley ltr1 promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 6608 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis apetala*—3 (Tilly et al., Development. 125:1647-57, 1998), *Arabidopsis* APETALA 1 (AT1G69120, API) (SEQ ID NO: 6622 (*Arabidopsis* (AT1G69120) *APETALA* 1)) (Hempel et al., Development 124:3845-3853, 1997)], and root promoters [e.g., the ROOTP promoter [SEQ ID NO: 6623]; rice ExpB5 (SEQ ID NO: 6606 (rice ExpB5 Promoter); or SEQ ID NO: 6605 (rice ExpB5 longer Promoter)) and barley ExpB1 promoters (SEQ ID NO: 6607) (Won et al. Mol. Cells 30: 369-376, 2010); *arabidopsis* ATTPS-CIN (AT3G25820) promoter (SEQ ID NO: 6624; Chen et al., Plant Phys 135:1956-66, 2004); *arabidopsis* Pho1 promoter (SEQ ID NO: 6604, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome on.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual AS, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments, there is provided a method of improving nitrogen use efficiency, yield, growth rate, biomass, vigor, oil content, oil yield, seed yield, fiber yield, fiber quality, fiber length, photosynthetic capacity, and/or abiotic stress tolerance (XX to update trait) of a grafted plant, the method comprising providing a scion that does not transgenically express a polynucleotide encoding a polypeptide at least 80% homologous to the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589 (e.g., in a constitutive, tissue specific or inducible, e.g., in an abiotic stress responsive manner), thereby improving the nitrogen use efficiency, yield, growth rate, biomass, vigor, oil content, seed yield, fiber yield, fiber quality, fiber length, photosynthetic capacity, and/or abiotic stress tolerance of the grafted plant.

In some embodiments, the plant scion is non-transgenic.

Several embodiments relate to a grafted plant exhibiting improved nitrogen use efficiency, yield, growth rate, biomass, vigor, oil content, seed yield, fiber yield, fiber quality, fiber length, photosynthetic capacity, and/or abiotic stress tolerance, comprising a scion that does not transgenically express a polynucleotide encoding a polypeptide at least 80% homologous to the amino acid sequence selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589, and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589.

In some embodiments, the plant root stock transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589 in a stress responsive manner.

According to some embodiments of the invention, the plant root stock transgenically expresses a polynucleotide encoding a polypeptide selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention, the plant root stock transgenically expresses a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650.

According to some embodiments of the invention, the plant root stock transgenically expresses a polynucleotide selected from the group consisting of SEQ ID NOs: 1-42, 44-57, 59-181, and 298-3650.

Since processes which increase nitrogen use efficiency, fertilizer use efficiency, oil content, yield, seed yield, fiber yield, fiber quality, fiber length, photosynthetic capacity, growth rate, biomass, vigor and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, fertilizer use efficiency, oil content, yield, seed yield, fiber yield, fiber quality, fiber length, photosynthetic capacity, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions), wherein the normal or optimal conditions include about 6-15 mM Nitrogen, e.g., 6-10 mM Nitrogen).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immunoassays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, wherein the plant is derived from a plant (parent plant) that has been transformed to express the exogenous polynucleotide and that has been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the polypeptide is selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650, wherein the plant is derived from a plant selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, and 3619-3650, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the exogenous polynucleotide is selected from the group consisting of SEQ ID NOs: 1-42, 44-57, 59-181, and 298-3650.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the polypeptide is selected from the group consisting of SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-3, 5-21, 23-35, 38-42, 44, 46-51, 54-55, 57, 59-79, 81-87, 89-103, 105-119, 121-133, 136-139, 141, 143-148, 151-152, 155-173, 175-180, 298-322, 342, 377, 380-381, 384, 387, 396-397, 419, 440, 461-1016, 1028, 1088, 1143, 1187, 1204-1549, 1555-1557, 1561, 1572-1573, 1586, 1598-1599, 1648-1651, 1674, 1676-1677, 1816-1864, 1867-1886, 1918, 2075, 2090, 2092-2093, 2099-2100, 2107, 2116, 2118-2166, 2292, 2295-2312, 2334-2344, 2354-2602, 2604-2615, 2617-2624, 2626-2627, 2629, 2631-2636, 2638-2644, 2646-2725, 2786, 2827, 2948, 2978-3018, 3020-3030, 3032-3085, 3135, 3233, 3416, 3439, 3527, 3538, 3572, 3582-3588, 3619-3649 or 3650, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the exogenous polynucleotide is selected from the group consisting of SEQ ID NOs: 1-42, 44-57, 59-181, and 298-3650.

According to an aspect of some embodiments of the present invention there is provided a method of growing a crop comprising:

(a) selecting a parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of set forth in SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress tolerance as compared to a non-transformed plant of the same species which is grown under the same growth conditions, and (b) growing a progeny crop plant of the parent plant, wherein the progeny crop plant which comprises the exogenous polynucleotide has the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress, thereby growing the crop.

According to an aspect of some embodiments of the present invention there is provided a method of producing seeds of a crop comprising:

(a) selecting parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of set forth in SEQ ID NOs: 182-184, 186-202, 204-216, 219-223, 225, 227-232, 235-236, 238, 240-260, 262-268, 270-275, 277-287, 289-297, 3651-3671, 3686, 3720-3721, 3724, 3727, 3735, 3754, 3774, 3795-4304, 4316, 4374, 4425, 4464, 4481-4813, 4824, 4833, 4843-4844, 4867-4869, 4888, 4890-4891, 5005-5050, 5053-5070, 5093, 5217, 5231, 5233, 5239, 5246, 5255, 5257-5296, 5412, 5415-5429, 5447-5456, 5465-5673, 5675-5686, 5688-5695, 5697-5698, 5700, 5702-5707, 5709-5715, 5717-5785, 5831, 5869, 5980, 6010-6043, 6045-6053, 6055-6093, 6132, 6383, 6405, 6493, 6523, 6533-6537, and 6563-6589 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress as compared to a non-transformed plant of the same species which is grown under the same growth conditions, (b) growing a seed producing plant from the parent plant resultant of step (a), wherein the seed producing plant which comprises the exogenous polynucleotide having the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress, and (c) producing seeds from the seed producing plant resultant of step (b), thereby producing seeds of the crop.

According to some embodiments of the invention, the seeds produced from the seed producing plant comprise the exogenous polynucleotide.

According to an aspect of some embodiments of the present invention there is provided a method of growing a crop comprising:

(a) selecting a parent plant transformed with an exogenous polynucleotide comprising a nucleic acid sequence encoding the polypeptide selected from the group consisting of set forth in SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589, for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress tolerance as compared to a non-transformed plant of the same species which is grown under the same growth conditions, and (b) growing progeny crop plant of the parent plant, wherein the progeny crop plant which comprises the exogenous polynucleotide has the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress, thereby growing the crop.

According to an aspect of some embodiments of the present invention there is provided a method of producing seeds of a crop comprising:

(a) selecting parent plant transformed with an exogenous polynucleotide comprising a nucleic acid sequence encoding the polypeptide selected from the group consisting of set forth in SEQ ID NOs: 182-216, 219-223, 225-233, 235-238, 240-260, 262-297, 3651-3675, 3677-4327, 4329-4815, 4818, 4821-4827, 4830, 4833, 4835-4840, 4843-4844, 4846-4848, 4850-4855, 4858, 4861-4862, 4865-4870, 4873-4882, 4884, 4888-4893, 4895-4896, 4899-4902, 4904, 4906, 4912-4913, 4918-4919, 4922, 4924, 4929-4941, 4944-4948, 4950-4952, 4955-4957, 4960-4963, 4966, 4968-4971, 4973-4997, 4999-5050, 5053-5307, 5309-5326, 5328-5340, 5342-5347, 5350-5358, 5361-5397, 5401-5402, 5407-5408, 5410-5429, 5433-5439, 5442-5456, 5458-5461, 5463, 5465-5786, 5788, 5790-5793, 5795-5796, 5798-5800, 5802-5804, 5806, 5809-5818, 5820-5823, 5825-5826, 5829-5832, 5835-5853, 5855-5870, 5872-5873, 5875-5876, 5879, 5881-5890, 5892-5896, 5898, 5900-5907, 5909-5910, 5912-5925, 5928-5930, 5932-5933, 5935-5941, 5943, 5946-5947, 5949-5957, 5959-5964, 5966-5970, 5972, 5974-5991, 5994-5995, 5998-6001, 6003-6005, 6007-6101, 6103-6119, 6121-6154, 6156-6161, 6163-6198, 6200-6243, 6245-6271, 6273-6501, and 6503-6589 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress as compared to a non-transformed plant of the same species which is grown under the same growth conditions, (b) growing a seed producing plant from the parent plant resultant of step (a), wherein the seed producing plant which comprises the exogenous polynucleotide having the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress, and (c) producing seeds from the seed producing plant resultant of step (b), thereby producing seeds of the crop.

According to some embodiments of the invention the exogenous polynucleotide is selected from the group consisting of SEQ ID NOs: 1-42, 44-57, 59-181, and 298-3650.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)/]\times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Examples 24-26, hereinbelow and in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

It should be noted that an increase in rosette parameters such as rosette area, rosette diameter and/or rosette growth rate in a plant model such as *Arabidopsis* predicts an increase in canopy coverage and/or plot coverage in a target plant such as *Brassica* sp., soy, corn, wheat, Barley, oat, cotton, rice, tomato, sugar beet, and vegetables such as lettuce.

Evaluation of growth rate can be done by measuring plant biomass produced, rosette area, leaf size or root length per time (can be measured in $cm^2$ per day of leaf area).

Relative growth area can be calculated using Formula II.

Formula II:

Relative growth rate area=Regression coefficient of area along time course

Thus, the relative growth area rate is in units of area units (e.g., $mm^2$/day or $cm^2$/day) and the relative length growth rate is in units of length units (e.g., cm/day or mm/day).

For example, RGR can be determined for plant height (Formula III), SPAD (Formula IV), Number of tillers (Formula V), root length (Formula VI), vegetative growth (Formula VII), leaf number (Formula VIII), rosette area (Formula IX), rosette diameter (Formula X), plot coverage (Formula XI), leaf blade area (Formula XII), and leaf area (Formula XIII).

Formula III: Relative growth rate of Plant height=Regression coefficient of Plant height along time course (measured in cm/day).

Formula IV: Relative growth rate of SPAD=Regression coefficient of SPAD measurements along time course.

Formula V: Relative growth rate of Number of tillers=Regression coefficient of Number of tillers along time course (measured in units of "number of tillers/day").

Formula VI: Relative growth rate of root length=Regression coefficient of root length along time course (measured in cm per day).

Vegetative growth rate analysis—was calculated according to Formula VII below.

Formula VII: Relative growth rate of vegetative growth=Regression coefficient of vegetative dry weight along time course (measured in grams per day).

Formula VIII: Relative growth rate of leaf number=Regression coefficient of leaf number along time course (measured in number per day).

Formula IX: Relative growth rate of rosette area=Regression coefficient of rosette area along time course (measured in $cm^2$ per day).

Formula X: Relative growth rate of rosette diameter=Regression coefficient of rosette diameter along time course (measured in cm per day).

Formula XI: Relative growth rate of plot coverage=Regression coefficient of plot (measured in $cm^2$ per day).

Formula XII: Relative growth rate of leaf blade area=Regression coefficient of leaf area along time course (measured in $cm^2$ per day).

Formula XIII: Relative growth rate of leaf area=Regression coefficient of leaf area along time course (measured in $cm^2$ per day).

Formula XIV: 1000 Seed Weight=number of seed in sample/sample weight×1000

The Harvest Index can be calculated using Formulas XV, XVI, XVII, XVIII and LXV below.

Formula XV: Harvest Index (seed)=Average seed yield per plant/Average dry weight.

Formula XVI: Harvest Index (*Sorghum*)=Average grain dry weight per Head/(Average vegetative dry weight per Head+Average Head dry weight)

Formula XVII: Harvest Index (Maize)=Average grain weight per plant/(Average vegetative dry weight per plant plus Average grain weight per plant)

Harvest Index (for barley)—The harvest index is calculated using Formula XVIII.

Formula XVIII: Harvest Index (for barley and wheat)=Average spike dry weight per plant/(Average vegetative dry weight per plant+Average spike dry weight per plant)

Following is a non-limited list of additional parameters which can be detected in order to show the effect of the transgene on the desired plant's traits:

Formula XIX: Grain circularity=4×3.14 (grain area/perimeter$^2$)

Formula XX: Internode volume=$3.14 \times (d/2)^2 \times 1$

Formula XXI: Total dry matter (kg)=Normalized head weight per plant+vegetative dry weight.

Formula XXII: Root/Shoot Ratio=total weight of the root at harvest/total weight of the vegetative portion above ground at harvest. (=RBiH/BiH)

Formula XXIII: Ratio of the number of pods per node on main stem at pod set=Total number of pods on main stem/Total number of nodes on main stem.

Formula XXIV: Ratio of total number of seeds in main stem to number of seeds on lateral branches=Total number of seeds on main stem at pod set/Total number of seeds on lateral branches at pod set.

Formula XXV: Petiole Relative Area=(Petiole area)/Rosette area (measured in %).

Formula XXVI: percentage of reproductive tiller=Number of Reproductive tillers/number of tillers)×100.

Formula XXVII: Spikes Index=Average Spikes weight per plant/(Average vegetative dry weight per plant plus Average Spikes weight per plant).

Formula XXVIII:

Relative growth rate of root coverage=Regression coefficient of root coverage along time course.

Formula XXIX:

Seed Oil yield=Seed yield per plant (gr.) *Oil % in seed.

Formula XXX: shoot/root Ratio=total weight of the vegetative portion above ground at harvest/total weight of the root at harvest.

Formula XXXI: Spikelets Index=Average Spikelets weight per plant/(Average vegetative dry weight per plant plus Average Spikelets weight per plant).

Formula XXXII: % Canopy coverage=(1−(PAR_DOWN/PAR_UP))×100 measured using AccuPAR Ceptometer Model LP-80.

Formula XXXIII: leaf mass fraction=Leaf area/shoot FW.

Formula XXXIV: Relative growth rate based on dry weight=Regression coefficient of dry weight along time course.

Formula XXXV: Dry matter partitioning (ratio)—At the end of the growing period 6 plants heads as well as the rest of the plot heads were collected, threshed and grains were weighted to obtain grains yield per plot. Dry matter partitioning was calculated by dividing grains yield per plot to vegetative dry weight per plot.

Formula XXXVI: 1000 grain weight filling rate (gr/day)—The rate of grain filling was calculated by dividing 1000 grain weight by grain fill duration.

Formula XXXVII: Specific leaf area ($cm^2/gr$)—Leaves were scanned to obtain leaf area per plant, and then were dried in an oven to obtain the leaves dry weight. Specific leaf area was calculated by dividing the leaf area by leaf dry weight.

Formula XXVIII: Vegetative dry weight per plant at flowering/water until flowering (gr/lit)—Calculated by dividing vegetative dry weight (excluding roots and reproductive organs) per plant at flowering by the water used for irrigation up to flowering Formula XXXIX: Yield filling rate (gr/day)—The rate of grain filling was calculated by dividing grains Yield by grain fill duration.

Formula XXXX: Yield per dunam/water until tan (kg/lit)—Calculated by dividing Grains yield per dunam by water used for irrigation until tan.

Formula XXXXI: Yield per plant/water until tan (gr/It)—Calculated by dividing Grains yield per plant by water used for irrigation until tan Formula XXXXII: Yield per dunam/water until maturity (gr/lit)—Calculated by dividing grains yield per dunam by the water used for irrigation up to maturity. "Lit"=Liter.

Formula XXXXIII: Vegetative dry weight per plant/water until maturity (gr/lit): Calculated by dividing vegetative dry weight per plant (excluding roots and reproductive organs) at harvest by the water used for irrigation up to maturity.

Formula XXXXIV: Total dry matter per plant/water until maturity (gr/lit): Calculated by dividing total dry matter at harvest (vegetative and reproductive, excluding roots) per plant by the water used for irrigation up to maturity.

Formula XXXXV: Total dry matter per plant/water until flowering (gr/lit): Calculated by dividing total dry matter at flowering (vegetative and reproductive, excluding roots) per plant by the water used for irrigation up to flowering.

Formula XXXXVI: Heads index (ratio): Average heads weight/(Average vegetative dry weight per plant plus Average heads weight per plant).

Formula XXXXVII: Yield/SPAD (kg/SPAD units)—Calculated by dividing grains yield by average SPAD measurements per plot.

Formula XXXXVIII: Stem water content (percentage)—stems were collected and fresh weight (FW) was weighted. Then the stems were oven dry and dry weight (DW) was recorded. Stems dry weight was divided by stems fresh weight, subtracted from 1 and multiplied by 100.

Formula XXXXIX: Leaf water content (percentage)—Leaves were collected and fresh weight (FW) was weighted. Then the leaves were oven dry and dry weight (DW) was recorded. Leaves dry weight was divided by leaves fresh weight, subtracted from 1 and multiplied by 100.

Formula L: stem volume ($cm^3$)—The average stem volume was calculated by multiplying the average stem length by $(3.14*((\text{mean lower and upper stem width})/2)^2)$.

Formula LI: NUE—is the ratio between total grain yield per total nitrogen (applied+content) in soil.

Formula LII: NUpE—Is the ratio between total plant N content per total N (applied+content) in soil.

Formula LIII: Total NUtE—Is the ratio between total dry matter per N content of total dry matter.

Formula LIV: Stem density—is the ratio between internode dry weight and internode volume.

Formula LV: Grain NUtE—Is the ratio between grain yield per N content of total dry matter Formula LVI: N harvest index (Ratio)—Is the ratio between nitrogen content in grain per plant and the nitrogen of whole plant at harvest.

Formula LVII: Biomass production efficiency—is the ratio between plant biomass and total shoot N.

Formula LVIII: Harvest index (plot) (ratio)—Average seed yield per plot/Average dry weight per plot.

Formula LIX. Relative growth rate of petiole relative area—Regression coefficient of petiole relative area along time course (measured in cm2 per day).

Formula LX: Yield per spike filling rate (gr/day)—spike filling rate was calculated by dividing grains yield per spike to grain fill duration.

Formula LXI: Yield per micro plots filling rate (gr/day)—micro plots filling rate was calculated by dividing grains yield per micro plots to grain fill duration.

Formula LXII: Grains yield per hectare [ton/ha]—all spikes per plot were harvested threshed and grains were weighted after sun dry. The resulting value was divided by the number of square meters and multiplied by 10,000 (10,000 square meters=1 hectare).

$$\text{Total dry matter (for Maize)} = \text{Normalized ear weight per plant} + \text{vegetative dry weight} \quad \text{Formula LXIII}$$

$$\text{Agronomical } NUE = \frac{\text{Yield per plant (Kg.)}^{X\ Nitrogen\ Fertilization} - \text{Yield per plant (Kg.)}^{0\%\ Nitrogen\ Fertilization}}{Fertilizer^X} \quad \text{Formula LXIV}$$

$$\text{Harvest Index (brachypodium)} = \text{Average grain weight/average dry (vegatative+spikelet) weight per plant} \quad \text{Formula LXV}$$

$$\text{Harvest Index for Sorghum}^*(*\text{when the plants were not dried}) = FW(\text{fresh weight})\text{Heads}/(FW\ \text{Heads}+FW\ \text{Plants}) \quad \text{Formula LXVI}$$

Grain protein concentration—Grain protein content (g grain protein m$^{-2}$) is estimated as the product of the mass of grain N (g grain N m$^{-2}$) multiplied by the N/protein conversion ratio of k-5.13 (Mosse 1990, supra). The grain protein concentration is estimated as the ratio of grain protein content per unit mass of the grain (g grain protein kg$^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W.H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [invitrogen (dot)com/content(dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each micro-array expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptome which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved nitrogen use efficiency, abiotic stress tolerance, yield, growth rate and the like).

Example 1

Bioinformatics Tools for Identification of Genes which Increase Abiotic Stress Tolerance, Yield and Agronomical Important Traits in Plants The present inventors have identified polynucleotides which upregulation of expression thereof can increase abiotic stress tolerance (ABST), water use efficiency (WUE), yield, oil content, growth rate, vigor, biomass, fiber yield and quality, nitrogen use efficiency (NUE), and/or fertilizer use efficiency (FUE) of a plant.

All nucleotide sequence datasets used here were originated from publicly available databases or from performing nucleotide sequencing using the Solexa technology (e.g. Barley and *Sorghum*). Sequence data from 100 different plant species was introduced into a single, comprehensive database. Other information on gene expression, protein annotation, enzymes and pathways were also incorporated. Major databases used include:

Genomes

*Arabidopsis* genome [TAIR genome version 6 (*arabidopsis* (dot) org/)];

Rice genome [IRGSP build 4.0 (rgp (dot) dna (dot) affrc (dot) go (dot) jp/IRGSP/)];

Poplar [*Populus trichocarpa* release 1.1 from JGI (assembly release v1.0) (genome (dot) jgi-psf (dot) org/)];

Brachypodium [JGI 4× assembly, brachpodium (dot) org)];

Soybean [DOE-JGI SCP, version Glyma0 (phytozome (dot) net/)];

Grape [French-Italian Public Consortium for Grapevine Genome Characterization grapevine genome (genoscope (dot) cns (dot) fr/)];

Castobean [TIGR/J Craig Venter Institute 4× assembly [msc (dot) jcvi (dot) org/r_communis];

*Sorghum* [DOE-JGI SCP, version Sbi1 [phytozome (dot) net/)];

Partially assembled genome of Maize [maizesequence (dot) org/];

Expressed EST and mRNA Sequences were Extracted from the Following Databases:

GenBank versions 154, 157, 160, 161, 164, 165, 166 and 168 (ncbi (dot) nlm (dot) nih (dot) gov/dbEST/);

RefSeq (ncbi (dot) nlm (dot) nih (dot) gov/RefSeq/);

TAIR (*arabidopsis* (dot) org/);

Protein and Pathway Databases

Uniprot [uniprot (dot) org/];

AraCyc [*arabidopsis* (dot) org/biocyc/index (dot) jsp];

ENZYME [expasy (dot) org/enzyme/];

Microarray Datasets were Downloaded from:

GEO (ncbi (dot) nlm (dot) nih (dot) gov/geo/);

TAIR (*arabidopsis* (dot) org/);

Proprietary microarray data (WO2008/122980 and Examples 2-17 below).

QTL and SNPs Information

Gramene [gramene (dot) org/qtl/];

Panzea [panzea (dot) org/index (dot) html];

Database assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300

(5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*arabidopsis*, rice, castorbean, grape, brachypodium, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Basic Local Alignment Search Tool (BLAST™ National Library of Medicine) search [blast (dot) ncbi (dot) nlm (dot) nih (dot) gov/Blast (dot) cgi] against all plant UniProt [uniprot (dot) org/] sequences was performed. Open reading frames (ORFs) of each putative transcript were analyzed and longest open reading frame (ORF) with higher number of homologues was selected as predicted protein of the transcript. The predicted proteins were analyzed by InterPro [ebi (dot) ac (dot) uk/interpro/].

Blast against proteins from AraCyc and ENZYME databases was used to map the predicted transcripts to AraCyc pathways.

Predicted proteins from different species were compared using the Basic Local Alignment Search Tool (BLAST™) (National Library of Medicine) algorithm [ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for ABST, increased yield, growth rate, vigor, biomass, oil content, WUE, NUE and FUE of a plant.

A digital expression profile summary was compiled for each cluster according to all keywords included in the sequence records comprising the cluster. Digital expression, also known as electronic Northern Blot, is a tool that displays virtual expression profile based on the expressed sequence tag (EST) sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

The accuracy of this system was demonstrated by Portnoy et al., 2009, "Analysis Of The Melon Fruit Transcriptome Based On 454 Pyrosequencing" in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [icugi (dot) org/] confirmed the accuracy of the sequencing and assembly. Expression patterns of selected genes fitted well their qRT-PCR (quantitative reverse transcriptase polymerase chain reaction) data.

Example 2

Production of *Sorghum* Transcriptome and High Throughput Correlation Analysis with Yield, Nue, and Abst Related Parameters Measured in Fields Using 44K *Sorghum* Oligonucleotide Micro-Arrays In order to produce a high throughput correlation analysis between plant phenotype and gene expression level, the present inventors utilized a sorghum oligonucleotide microarray, produced by Agilent Technologies [chem(dot)agilent (dot)com/Scripts/PDS(dot)asp?1Page=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [davidmlane (dot)com/hyperstat/A34739(dot)html].

Correlation of *Sorghum* Varieties Across Ecotypes Grown Under Regular Growth Conditions, Severe Drought Conditions and Low Nitrogen Conditions Experimental Procedures 17 *Sorghum* varieties were grown in 3 repetitive plots, in field. Briefly, the growing protocol was as follows:

1. Regular growth conditions: *Sorghum* plants were grown in the field using commercial fertilization and irrigation protocols (normal growth conditions), which include 370 $m^3$ water per dunam (1000 $m^2$) per entire growth period and fertilization of 14 units of URAN® 21% (Nitrogen Fertilizer Solution; PCS Sales, Northbrook, Ill., USA).

2. Drought conditions: *Sorghum* seeds were sown in soil and grown under normal growth conditions until about 35 days from sowing, at about stage V8 (eight green leaves are fully expanded, booting not started yet). At this point, irrigation was stopped, and severe drought stress was developed.

3. Low Nitrogen fertilization conditions: *Sorghum* plants were fertilized with 50% less amount of nitrogen in the field than the amount of nitrogen applied in the regular (normal) growth treatment. All the fertilizer was applied before flowering.

Analyzed *Sorghum* tissues—All 10 selected *Sorghum* hybrids were sampled per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 1 below.

TABLE 1

*Sorghum* transcriptome expression sets in field experiments

| Expression Set | Set ID |
| --- | --- |
| Flag leaf at flowering stage under drought growth conditions | 1 |
| Flag leaf at flowering stage under low nitrogen growth conditions | 2 |
| Flag leaf at flowering stage under normal growth conditions | 3 |
| Flower meristem at flowering stage under drought growth conditions | 4 |
| Flower meristem at flowering stage under low nitrogen growth conditions | 5 |
| Flower meristem at flowering stage under normal growth conditions | 6 |
| Flower at flowering stage under drought growth conditions | 7 |
| Flower at flowering stage under low nitrogen growth conditions | 8 |
| Flower at flowering stage under normal growth conditions | 9 |

Table 1: Provided are the *sorghum* transcriptom expression sets. Flag leaf = the leaf below the flower; Flower meristem = Apical meristem following panicle initiation; Flower = the flower at the anthesis day.

The following parameters were collected using digital imaging system:

Average grain area ($cm^2$)—At the end of the growing period the grains were separated from the Plant 'Head'. A sample of ~200 grains were weighted, photographed and images were processed using the below described image processing system. The grain area was measured from those images and was divided by the number of grains.

Upper and lower ratio average of grain area, width, length, diameter and perimeter—Grain projection of area, width, length, diameter and perimeter were extracted from the digital images using open source package imagej (nih). Seed data was analyzed in plot average levels as follows:
Average of all seeds;
Average of upper 20% fraction=contained upper 20% fraction of seeds;
Average of lower 20% fraction=contained lower 20% fraction of seeds;

Further on, ratio between each fraction and the plot average was calculated for each of the data parameters.

At the end of the growing period 5 'Heads' were, photographed and images were processed using the below described image processing system.

Average grain length (cm)—At the end of the growing period the grains were separated from the Plant 'Head'. A sample of ~200 grains were weighted, photographed and images were processed using the below described image processing system. The sum of grain lengths (longest axis) was measured from those images and was divided by the number of grains.

Head average area ($cm^2$)—At the end of the growing period 5 'Heads' were photographed and images were processed using the below described image processing system. The 'Head' area was measured from those images and was divided by the number of 'Heads'.

Head average length (cm)—At the end of the growing period 5 'Heads' were photographed and images were processed using the below described image processing system. The 'Head' length (longest axis) was measured from those images and was divided by the number of 'Heads'.

Head average width (cm)—At the end of the growing period 5 'Heads' were photographed and images were processed using the below described image processing system. The 'Head' width was measured from those images and was divided by the number of 'Heads'.

Head average perimeter (cm)—At the end of the growing period 5 'Heads' were photographed and images were processed using the below described image processing system. The 'Head' perimeter was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total seed weight per head (Grain yield) (gr.)—At the end of the experiment (plant 'Heads') heads from plots within blocks A-C were collected. Five heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW (fresh weight) head per plant (gr.)—At the end of the experiment (when heads were harvested) total heads and 5 selected heads per plots within blocks A-C were collected separately. The heads (total and 5) were weighted (gr.) separately, and the average fresh weight per plant was calculated for total (FW Head/Plant gr. based on plot) and for 5 heads (FW Head/Plant gr. based on 5 plants).

Plant height—Plants were characterized for height during growing period at 5 time points. In each measure, plants were measured for their height using a measuring tape. Height was measured from ground level to top of the longest leaf.

Plant leaf number—Plants were characterized for leaf number during a growing period at 5 time points. In each measure, plants were measured for their leaf number by counting all the leaves of 3 selected plants per plot.

SPAD [SPAD unit]—Chlorophyll content was determined using a Minolta SPAD 502 chlorophyll meter and measurement was performed 64 days post sowing. SPAD meter readings were done on young fully developed leaves. Three measurements per leaf were taken per plot.

Vegetative fresh weight and Heads—At the end of the experiment (when inflorescence were dry) all inflorescence and vegetative material from plots within blocks A-C were collected. The biomass and heads weight of each plot was separated, measured and divided by the number of heads.

Plant biomass (Fresh weight)—At the end of the experiment (when inflorescence were dry) the vegetative material from plots within blocks A-C were collected. The plants biomass without the inflorescence were measured and divided by the number of plants.

FW (fresh weight) heads/(FW Heads+FW Plants)—The total fresh weight of heads and their respective plant biomass were measured at the harvest day. The heads weight was divided by the sum of weights of heads and plants.

Dry weight=total weight of the vegetative portion above ground (excluding roots) after drying at 70° C. in oven for 48 hours;

Harvest Index (HI) (*Sorghum*)—The harvest index was calculated using Formula XVI above.

Data parameters collected are summarized in Table 2, herein below

TABLE 2

*Sorghum* correlated parameters (vectors)

| Correlated parameter with | Correlation ID |
|---|---|
| Average grain area [cm$^2$] at Drought growth conditions | 1 |
| Average grain area [cm$^2$] at Normal growth conditions | 2 |
| Average grain area [cm$^2$] at low nitrogen growth conditions | 3 |
| FW head per plant [gr.] at Drought growth conditions | 4 |
| FW head per plant [gr.] at Normal growth conditions | 5 |
| FW head per plant [gr.] at low nitrogen growth conditions | 6 |
| FW heads/(FW Heads + FW Plants) [gr.] at Drought growth conditions | 7 |
| FW heads/(FW Heads + FW Plants) [gr.] at Normal growth conditions | 8 |
| FW heads/(FW Heads + FW Plants) [gr.] at low nitrogen growth conditions | 9 |
| Head average area [cm$^2$] at Drought growth conditions | 10 |
| Head average area [cm$^2$] at Normal growth conditions | 11 |
| Head average area [cm$^2$] at low nitrogen growth conditions | 12 |
| Head average length [cm] at Drought growth conditions | 13 |
| Head average length [cm] at Normal growth conditions | 14 |
| Head average length [cm] at low nitrogen growth conditions | 15 |
| Head average perimeter [cm] at Drought growth conditions | 16 |
| Head average perimeter [cm] at Normal growth conditions | 17 |
| Head average perimeter [cm] at low nitrogen growth conditions | 18 |
| Head average width [cm] at Drought growth conditions | 19 |
| Head average width [cm] at Normal growth conditions | 20 |
| Head average width [cm] at low nitrogen growth conditions | 21 |
| Lower Ratio Average Grain Area, at Low Nitrogen growth conditions | 22 |

TABLE 2-continued

*Sorghum* correlated parameters (vectors)

| Correlated parameter with | Correlation ID |
|---|---|
| Lower Ratio Average Grain Area at Normal growth conditions | 23 |
| Lower Ratio Average Grain Length at Low Nitrogen growth conditions | 24 |
| Lower Ratio Average Grain Length at Normal growth conditions | 25 |
| Lower Ratio Average Grain Perimeter at Low Nitrogen growth conditions | 26 |
| Lower Ratio Average Grain Perimeter at Normal growth conditions | 27 |
| Lower Ratio Average Grain Width at Low N growth conditions | 28 |
| Lower Ratio Average Grain Width at Normal growth conditions | 29 |
| Plant height [cm] at Drought growth conditions | 30 |
| Plant height [cm] at Normal growth conditions | 31 |
| Plant height [cm] at low nitrogen growth conditions | 32 |
| SPAD [SPAD unit] at Drought growth conditions | 33 |
| SPAD [SPAD unit] at Normal growth conditions | 34 |
| SPAD [SPAD unit] at low nitrogen growth conditions | 35 |
| Total seed weight per head (Grain yield) [gr.] at Drought growth conditions | 36 |
| Total seed weight per head (Grain yield) [gr.] at Normal growth conditions | 37 |
| Total seed weight per head (Grain yield) [gr.] at low nitrogen growth conditions | 38 |
| Upper Ratio Average Grain Area at Drought growth conditions | 39 |
| Upper Ratio Average Grain Area at Low Nitrogen growth conditions | 40 |
| Upper Ratio Average Grain Area at Normal growth conditions | 41 |

Table 2. Provided are the *Sorghum* correlated parameters (vectors). "gr." = grams; "SPAD" = chlorophyll levels; "FW Plants" = Plant Fresh weight; "normal" = standard growth conditions; "Low N" = Low Nitrogen conditions; "FW Heads" = fresh weight of the harvested heads was divided by the number of heads that were phenotyped; "Lower Ratio Average Grain Area" = grain area of the lower fraction of grains.

Experimental Results 17 different *sorghum* hybrids were grown and characterized for different parameters (Table 2). The average for each of the measured parameters was calculated using the JMP software (Tables 3-8) and a subsequent correlation analysis was performed (Table 9). Results were then integrated to the database.

TABLE 3

Measured parameters in *Sorghum* accessions under normal conditions

| Corr. ID | Line-1 | Line-2 | Line-3 | Line-4 | Line-5 | Line-6 | Line-7 | Line-8 | Line-9 |
|---|---|---|---|---|---|---|---|---|---|
| 2 | 0.105 | 0.112 | 0.131 | 0.129 | 0.139 | 0.141 | 0.11 | 0.113 | 0.102 |
| 5 | 406.5 | 518 | 148 | 423 | 92 | 101.3 | 423.5 | 386.5 | 409.5 |
| 8 | 0.51 | 0.51 | 0.115 | 0.263 | 0.12 | 0.177 | 0.459 | 0.432 | 0.425 |
| 11 | 120.1 | 167.6 | 85.1 | 157.3 | 104 | 102.5 | 168.5 | 109.3 | 135.1 |
| 14 | 25.6 | 26.8 | 21 | 26.8 | 23.1 | 21.8 | 31.3 | 23.2 | 25.7 |
| 17 | 61.2 | 67.9 | 56.3 | 65.4 | 67.5 | 67.5 | 74.4 | 56.2 | 61.6 |
| 20 | 5.97 | 7.92 | 4.87 | 7.43 | 5.58 | 5.88 | 6.78 | 5.99 | 6.62 |
| 23 | 0.825 | 0.74 | 0.778 | 0.802 | 0.697 | 0.699 | 0.827 | 0.805 | 0.841 |
| 25 | 0.914 | 0.884 | 0.921 | 0.908 | 0.89 | 0.877 | 0.913 | 0.903 | 0.92 |
| 27 | 0.914 | 0.869 | 0.913 | 0.948 | 0.902 | 0.915 | 0.913 | 0.91 | 0.918 |
| 29 | 0.908 | 0.833 | 0.85 | 0.874 | 0.788 | 0.799 | 0.904 | 0.893 | 0.915 |
| 31 | 95.2 | 79.2 | 197.8 | 234.2 | 189.4 | 194.7 | 117.2 | 92.8 | 112.7 |
| 34 | 43 | 0 | 43.3 | 44.7 | 45.8 | 41.6 | 45.2 | 45.1 | 43 |
| 37 | 47.4 | 46.3 | 28.4 | 70.4 | 32.1 | 49.2 | 63.5 | 44.5 | 56.6 |
| 41 | 1.22 | 1.3 | 1.13 | 1.14 | 1.16 | 1.15 | 1.19 | 1.23 | 1.25 |

Table 3: Provided are the values of each of the parameters (as described above) measured in *Sorghum* accessions (Line) under normal conditions. Growth conditions are specified in the experimental procedure section.

TABLE 4

Additional measured parameters in *Sorghum* accessions under normal growth conditions

| | Line | | | | | | | |
|---|---|---|---|---|---|---|---|---|
| Corr. ID | Line-10 | Line-11 | Line-12 | Line-13 | Line-14 | Line-15 | Line-16 | Line-17 |
| 2 | 0.118 | 0.121 | 0.111 | 0.117 | 0.108 | 0.105 | 0.11 | 0.105 |
| 5 | 328.9 | 391 | 435.8 | 429.5 | 441 | 415.8 | 429.5 | 428.5 |
| 8 | 0.442 | 0.458 | 0.447 | 0.447 | 0.513 | 0.46 | 0.442 | 0.386 |
| 11 | 169 | 156.1 | 112.1 | 154.7 | 171.7 | 168.5 | 162.5 | 170.5 |
| 14 | 28.8 | 28.1 | 23 | 28.1 | 30 | 30.5 | 27.2 | 29.3 |
| 17 | 71.4 | 68.6 | 56.4 | 67.8 | 71.5 | 78.9 | 67 | 74.1 |
| 20 | 7.42 | 6.98 | 6.19 | 7.02 | 7.18 | 7 | 7.39 | 7.35 |
| 23 | 0.788 | 0.765 | 0.803 | 0.806 | 0.821 | 0.814 | 0.818 | 0.817 |
| 25 | 0.923 | 0.893 | 0.913 | 0.907 | 0.911 | 0.904 | 0.903 | 0.913 |
| 27 | 0.93 | 0.911 | 0.916 | 0.904 | 0.912 | 0.905 | 0.909 | 0.905 |
| 29 | 0.854 | 0.863 | 0.885 | 0.898 | 0.905 | 0.91 | 0.902 | 0.899 |
| 31 | 97.5 | 98 | 100 | 105.6 | 151.2 | 117.1 | 124.5 | 126.5 |
| 34 | 45.6 | 44.8 | 45.3 | 46.5 | 44 | 45.1 | 45.1 | 43.1 |
| 37 | 60 | 45.5 | 58.2 | 70.6 | 70.1 | 54 | 59.9 | 52.6 |
| 41 | 1.24 | 1.32 | 1.22 | 1.18 | 1.18 | 1.22 | 1.25 | 1.22 |

Table 4:
Provided are the values of each of the parameters (as described above) measured in *Sorghum* accessions (Line) under normal conditions.
Growth conditions are specified in the experimental procedure section.
"Corr." = correlation.

TABLE 5

Measured parameters in *Sorghum* accessions under low nitrogen conditions

| Corr. ID | Line | | | | | | | | |
|---|---|---|---|---|---|---|---|---|---|
| | Line-1 | Line-2 | Line-3 | Line-4 | Line-5 | Line-6 | Line-7 | Line-8 | Line-9 |
| 3 | 0.105 | 0.111 | 0.136 | 0.121 | 0.141 | 0.134 | 0.119 | 0.117 | 0.116 |
| 6 | 388 | 428.7 | 297.7 | 280 | 208.3 | 303.7 | 436 | 376.3 | 474.7 |
| 9 | 0.505 | 0.506 | 0.166 | 0.391 | 0.21 | 0.192 | 0.476 | 0.375 | 0.42 |
| 12 | 96.2 | 214.7 | 98.6 | 182.8 | 119.6 | 110.2 | 172.4 | 84.8 | 156.3 |
| 15 | 23.2 | 25.6 | 20.9 | 28.4 | 24.3 | 22.6 | 32.1 | 20.4 | 26.7 |
| 18 | 56.3 | 79.2 | 53.2 | 76.2 | 67.3 | 59.5 | 79.3 | 51.5 | 69.9 |
| 21 | 5.26 | 10.41 | 5.93 | 8.25 | 6.19 | 6.12 | 6.8 | 5.25 | 7.52 |
| 22 | 0.815 | 0.77 | 0.81 | 0.793 | 0.78 | 0.799 | 0.834 | 0.788 | 0.806 |
| 24 | 0.91 | 0.9 | 0.921 | 0.898 | 0.908 | 0.926 | 0.918 | 0.89 | 0.901 |
| 26 | 0.901 | 0.884 | 0.915 | 0.897 | 0.919 | 0.918 | 0.916 | 0.891 | 0.898 |
| 28 | 0.901 | 0.852 | 0.893 | 0.88 | 0.863 | 0.871 | 0.91 | 0.888 | 0.899 |
| 32 | 104 | 80.9 | 204.7 | 125.4 | 225.4 | 208.1 | 121.4 | 100.3 | 121.1 |
| 35 | 38.3 | 39 | 42.3 | 40.9 | 43.1 | 39.9 | 42.7 | 43.3 | 39 |
| 38 | 50.3 | 50.9 | 36.1 | 73.1 | 37.9 | 36.4 | 71.7 | 35 | 76.7 |
| 40 | 1.18 | 1.31 | 1.11 | 1.21 | 1.19 | 1.18 | 1.16 | 1.23 | 1.17 |

Table 5:
Provided are the values of each of the parameters (as described above) measured in *Sorghum* accessions (Line) under low nitrogen conditions.
Growth conditions are specified in the experimental procedure section.
"Corr." = correlation.

TABLE 6

Additional measured parameters in *Sorghum* accessions under low nitrogen growth conditions

| | Line | | | | | | | |
|---|---|---|---|---|---|---|---|---|
| Corr. ID | Line-10 | Line-11 | Line-12 | Line-13 | Line-14 | Line-15 | Line-16 | Line-17 |
| 3 | 0.129 | 0.131 | 0.12 | 0.116 | 0.115 | 0.107 | 0.121 | 0.109 |
| 6 | 437.7 | 383 | 375 | 425 | 434 | 408.7 | 378.5 | 432 |
| 9 | 0.441 | 0.429 | 0.387 | 0.438 | 0.439 | 0.442 | 0.43 | 0.417 |
| 12 | 136.7 | 137.7 | 96.5 | 158.2 | 163.9 | 138.4 | 135.5 | 165.6 |

TABLE 6-continued

Additional measured parameters in *Sorghum* accessions under low nitrogen growth conditions

| | Line | | | | | | | |
|---|---|---|---|---|---|---|---|---|
| Corr. ID | Line-10 | Line-11 | Line-12 | Line-13 | Line-14 | Line-15 | Line-16 | Line-17 |
| 15 | 26.3 | 25.4 | 23.1 | 27.9 | 28.9 | 27.6 | 25.5 | 30.3 |
| 18 | 66.2 | 67.4 | 57.9 | 70.6 | 73.8 | 66.9 | 65.4 | 76 |
| 21 | 6.59 | 6.85 | 5.32 | 7.25 | 7.19 | 6.27 | 6.57 | 6.82 |
| 22 | 0.772 | 0.741 | 0.804 | 0.788 | 0.823 | 0.801 | 0.809 | 0.807 |
| 24 | 0.909 | 0.886 | 0.897 | 0.894 | 0.911 | 0.888 | 0.892 | 0.901 |
| 26 | 0.907 | 0.895 | 0.903 | 0.896 | 0.914 | 0.894 | 0.896 | 0.897 |
| 28 | 0.857 | 0.842 | 0.897 | 0.887 | 0.908 | 0.899 | 0.902 | 0.897 |
| 32 | 94.5 | 110 | 115.1 | 104.7 | 173.7 | 115.6 | 138.8 | 144.4 |
| 35 | 42.7 | 40.1 | 44 | 45.4 | 44.8 | 42.6 | 43.8 | 46.7 |
| 38 | 57.6 | 42.9 | 36.5 | 68.6 | 71.8 | 49.3 | 43.9 | 52.1 |
| 40 | 1.22 | 1.24 | 1.19 | 1.23 | 1.16 | 1.34 | 1.21 | 1.21 |

Table 6:
Provided are the values of each of the parameters (as described above) measured in *Sorghum* accessions (Line) under low nitrogen conditions.
Growth conditions are specified in the experimental procedure section.
"Corr." = correlation.

TABLE 7

Measured parameters in *Sorghum* accessions under drought conditions

| | Line | | | | | | | | |
|---|---|---|---|---|---|---|---|---|---|
| Corr. ID | Line-1 | Line-2 | Line-3 | Line-4 | Line-5 | Line-6 | Line-7 | Line-8 | Line-9 |
| 1 | 0.099 | 0.115 | 0.106 | 0.094 | 0.09 | 0.114 | | | |
| 4 | 154.9 | 122 | 130.5 | 241.1 | 69 | 186.4 | 62.1 | 39 | 58.9 |
| 7 | 0.419 | 0.472 | 0.419 | 0.374 | 0.228 | 0.314 | 0.41 | 0.437 | 0.404 |
| 10 | 83.1 | 107.8 | 88.7 | 135.9 | 90.8 | 124 | 86.1 | 85.2 | 113.1 |
| 13 | 21.6 | 21.9 | 21.6 | 22 | 21 | 28.6 | 21.3 | 20.8 | 24.7 |
| 16 | 52.8 | 64.5 | 56.6 | 64.4 | 53.2 | 71.7 | 55.6 | 53 | 69.8 |
| 19 | 4.83 | 6.31 | 5.16 | 7.78 | 5.28 | 5.49 | 5.04 | 5.07 | 5.77 |
| 30 | 89.4 | 75.7 | 92.1 | 94.3 | 150.8 | 110.7 | 99.2 | 84 | 99 |
| 33 | 40.6 | 40.9 | 45 | 42.3 | 45.2 | 40.6 | 44.8 | 45.1 | 40.6 |
| 36 | 22.1 | 16.8 | 9.2 | 104.4 | 3.2 | 22 | 10 | 18.6 | 29.3 |
| 39 | 1.31 | 1.19 | 1.29 | 1.46 | 1.21 | 1.21 | | | |

Table 7:
Provided are the values of each of the parameters (as described above) measured in *Sorghum* accessions (Line) under drought conditions.
Growth conditions are specified in the experimental procedure section.
"Corr." = correlation.

TABLE 8

Additional measured parameters in *Sorghum* accessions under drought growth conditions

| | Line | | | | | | | |
|---|---|---|---|---|---|---|---|---|
| Corr. ID | Line-10 | Line-11 | Line-12 | Line-13 | Line-14 | Line-15 | Line-16 | Line-17 |
| 1 | | | | | | | | |
| 4 | 76.4 | 33.5 | 42.2 | 41.5 | 131.7 | 60.8 | 44.3 | 185.4 |
| 7 | 0.443 | 0.472 | 0.468 | 0.484 | 0.354 | 0.349 | 0.231 | 0.327 |
| 10 | 100.8 | 80.4 | 126.9 | 86.4 | 92.3 | 77.9 | 76.9 | |
| 13 | 24.3 | 21.9 | 25 | 19.5 | 20.4 | 16.8 | 18.9 | |
| 16 | 65.1 | 55.3 | 69.1 | 53.3 | 56.3 | 49.1 | 51.9 | |
| 19 | 5.37 | 4.66 | 6.35 | 5.58 | 5.76 | 5.86 | 5.1 | |

TABLE 8-continued

Additional measured parameters in Sorghum accessions under drought growth conditions

| Corr. ID | Line | | | | | | | |
|---|---|---|---|---|---|---|---|---|
| | Line-10 | Line-11 | Line-12 | Line-13 | Line-14 | Line-15 | Line-16 | Line-17 |
| 30 | 92.2 | 81.9 | 98.8 | 86.5 | 99.6 | 83 | 83.5 | 92.3 |
| 33 | 45.4 | 42.6 | 44.2 | 44.6 | 42.4 | 43.2 | 40.3 | 40.8 |
| 36 | 10.5 | 14.8 | 12.9 | 18.2 | 11.6 | 18.6 | 16.4 | |

Table 8:
Provided are the values of each of the parameters (as described above) measured in Sorghum accessions (Line) under drought conditions.
Growth conditions are specified in the experimental procedure section.
"Corr." = correlation.

TABLE 9

Correlation between the expression level of selected genes of some embodiments of the invention in various tissues and the phenotypic performance under low nitrogen, normal or drought stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGA17 | 0.80 | 5.71E−03 | 6 | 31 | LGA17 | 0.79 | 6.36E−03 | 4 | 4 |
| LGB14 | 0.72 | 1.80E−02 | 6 | 41 | LGB14 | 0.75 | 1.17E−02 | 2 | 15 |
| LGB14 | 0.84 | 2.62E−03 | 2 | 18 | LGB14 | 0.84 | 2.54E−03 | 2 | 12 |
| LGB14 | 0.80 | 5.06E−03 | 2 | 6 | LGB14 | 0.76 | 1.07E−02 | 8 | 24 |
| LGB15 | 0.84 | 2.46E−03 | 9 | 37 | LGB15 | 0.77 | 8.63E−03 | 9 | 25 |
| LGB15 | 0.71 | 2.15E−02 | 9 | 23 | LGB15 | 0.73 | 1.76E−02 | 2 | 40 |
| LGB15 | 0.73 | 2.69E−02 | 4 | 10 | LGB16 | 0.84 | 2.15E−03 | 2 | 26 |
| LGB16 | 0.78 | 8.37E−03 | 2 | 24 | LGB16 | 0.80 | 5.55E−03 | 3 | 5 |
| LGM11 | 0.79 | 6.74E−03 | 2 | 40 | LGM11 | 0.89 | 5.34E−04 | 4 | 4 |
| LGM11 | 0.86 | 3.17E−03 | 7 | 10 | LGM11 | 0.80 | 9.12E−03 | 7 | 13 |
| LGM11 | 0.83 | 6.10E−03 | 7 | 16 | LGM12 | 0.75 | 1.20E−02 | 6 | 23 |
| LGM17 | 0.98 | 1.62E−06 | 3 | 5 | LGM23 | 0.72 | 1.85E−02 | 6 | 5 |
| LGM23 | 0.81 | 4.36E−03 | 6 | 20 | LGM23 | 0.71 | 2.16E−02 | 4 | 7 |
| LGM23 | 0.77 | 8.53E−03 | 3 | 2 | LGM23 | 0.87 | 2.09E−03 | 7 | 10 |
| LGM23 | 0.82 | 6.79E−03 | 7 | 19 | LGM23 | 0.78 | 1.27E−02 | 7 | 16 |

Table 9.
Provided are the correlations (R) between the genes expression levels in various tissues and the phenotypic performance.
"Corr. Set ID"—correlation set ID according to the correlated parameters specified in Table 2.
"Exp. Set"—Expression set specified in Table 1.
"R" = Pearson correlation coefficient;
"P" = p value.

Example 3

Production of Sorghum Transcriptome and High Throughput Correlation Analysis with Biomass, Nue, and Abst Related Parameters Measured in Semi-Hydroponics Conditions Using 44K Sorghum Oligonucleotide Micro-Arrays Sorghum vigor related parameters under high salinity (100 mM NaCl), low temperature (10±2° C.), low nitrogen conditions and normal growth conditions—Ten Sorghum hybrids were grown in 3 repetitive plots, each containing 17 plants, at a net house under semi-hydroponics conditions. Briefly, the growing protocol was as follows: Sorghum seeds were sown in trays filled with a mix of vermiculite and peat in a 1:1 ratio. Following germination, the trays were transferred to normal growth conditions (Full Hoagland containing 16 mM Nitrogen solution, at 28±2° C.), high salinity conditions (100 mM NaCl in addition to the Full Hoagland solution), low temperature conditions (10±2° C. in the presence of Full Hoagland solution), or low nitrogen conditions (the amount of total nitrogen was reduced in 90% from the full Hoagland solution (i.e., to a final concentration of 10% from full Hoagland solution, final amount of 1.2 mM Nitrogen). All plants were grown at 28±2° C. except where otherwise indicated (i.e., in the low temperature conditions).

Full Hoagland solution consists of: $KNO_3$-0.808 grams/liter, $MgSO_4$-0.12 grams/liter, $KH_2PO_4$-0.172 grams/liter and 0.01% (volume/volume) of 'Super coratin' micro elements (Iron-EDDHA [ethylenediamine-N,N'-bis(2-hydroxyphenylacetic acid)]—40.5 grams/liter, Mn—20.2 grams/liter; Zn 10.1 grams/liter, Co 1.5 grams/liter, and Mo 1.1 grams/liter), solution's pH should be 6.5-6.8].

Analyzed Sorghum tissues—All 10 selected Sorghum hybrids were sampled per each treatment. Three tissues [leaves, meristems and roots] growing at 100 mM NaCl, low temperature (10±2° C.), low Nitrogen (1.2 mM Nitrogen) or under Normal conditions were sampled and RNA was extracted as described above. Each micro-array expression information tissue type has received a Set ID as summarized in Table 10 below.

TABLE 10

Sorghum transcriptome expression sets
under semi hydroponics conditions

| Expression Set | Set ID |
|---|---|
| root at vegetative stage (V4-V5) under cold conditions | 1 |
| root vegetative stage (V4-V5) under normal conditions | 2 |
| root vegetative stage (V4-V5) under low nitrogen conditions | 3 |
| root vegetative stage (V4-V5) under salinity conditions | 4 |
| vegetative meristem at vegetative stage (V4-Y5) under cold conditions | 5 |
| vegetative meristem at vegetative stage (V4-V5) under low nitrogen conditions | 6 |
| vegetative meristem at vegetative stage (V4-V5) under salinity conditions | 7 |
| vegetative meristem at vegetative stage (V4-V5) under normal conditions | 8 |

Table 10: Provided are the Sorghum transcriptome expression sets as determined using the semihydroponic assay conditions. The growth conditions and the tested tissue are described. "Cold" = Cold growth conditions at 10 ± 2° C.; "NaCl"—salinity stress growth conditions at 100 mM NaCl; "low nitrogen" = nitrogen deficient conditions at 1.2 mM Nitrogen; "Normal" = Normal growth conditions at 16 mM Nitrogen.

Sorghum Biomass, Vigor, Nitrogen Use Efficiency and Growth-Related Components

Root DW [gr.]—At the end of the experiment, the root material was collected, measured and divided by the number of plants.

Shoot DW [gr.]—At the end of the experiment, the shoot material (without roots) was collected, measured and divided by the number of plants.

Total biomass [gr.]—total biomass including roots and shoots.

Leaf num [number]—number of opened leaves.

RGR Leaf Number—calculated based on Formula VIII above.

Shoot/Root ratio—calculated based on Formula XXX above.

NUE per total biomass—nitrogen use efficiency (NUE) of total biomass (including roots and shoots).

NUE per root biomass—nitrogen use efficiency (NUE) of root biomass.

NUE per shoot biomass—nitrogen use efficiency (NUE) of shoot biomass.

Percent of reduction of root biomass compared to normal—the difference (reduction in percent) between root biomass under normal and under low nitrogen conditions.

Percent of reduction of shoot biomass compared to normal—the difference (reduction in percent) between shoot biomass under normal and under low nitrogen conditions.

Percent of reduction of total biomass compared to normal—the difference (reduction in percent) between total biomass (shoot and root) under normal and under low nitrogen conditions.

Plant height [cm]—Plants were characterized for height during growing period at 5 time points. In each measure, plants were measured for their height using a measuring tape. Height was measured from ground level to top of the longest leaf.

SPAD [SPAD unit]—Chlorophyll content was determined using a Minolta SPAD 502 chlorophyll meter and measurement was performed 64 days post sowing. SPAD meter readings were done on young fully developed leaf. Three measurements per leaf were taken per plot.

Root Biomass [DW, gr.]/SPAD—root biomass divided by SPAD results.

Shoot Biomass [DW, gr.]/SPAD—shoot biomass divided by SPAD results.

Total Biomass (Root+Shoot) [DW, gr.]/SPAD—total biomass divided by SPAD results.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaves. Three measurements per leaf were taken per plot.

Experimental Results 10 different Sorghum hybrids were grown and characterized for various biomass and nitrogen use efficiency (NUE) parameters as described in Table 11 below. The average for each of the measured parameter was calculated using the JMP software and values are summarized in Table 12-19 below. Subsequent correlation analysis was performed (Table 20). Results were then integrated to the database.

TABLE 11

Sorghum correlated parameters (vectors)

| Correlated parameter with | Corr. ID |
|---|---|
| Leaf num [number] at 100 mM NaCl growth conditions | 1 |
| Leaf num [number], Cold growth conditions | 2 |
| Leaf num [number], Normal growth conditions | 3 |
| Leaf num [number], low nitrogen growth conditions | 4 |
| NUE per root biomass, Normal growth conditions | 5 |
| NUE per root biomass, low nitrogen growth conditions | 6 |
| NUE per shoot biomass, Normal growth conditions | 7 |
| NUE per shoot biomass, low nitrogen growth conditions | 8 |
| NUE per total biomass, Normal growth conditions | 9 |
| NUE per total biomass, low nitrogen growth conditions | 10 |
| Percent of reduction of root biomass compared to normal [%], low nitrogen growth conditions | 11 |
| Percent of reduction of shoot biomass compared to normal [%] at low nitrogen growth conditions | 12 |
| Percent of reduction of total biomass compared to normal [%] at low nitrogen growth conditions | 13 |
| Plant height [cm] at 100 mM NaCl growth conditions | 14 |
| Plant height [cm] at Cold growth conditions | 15 |
| Plant height [cm] at Normal growth conditions | 16 |
| Plant height [cm] at low nitrogen growth conditions | 17 |
| RGR Leaf Num [number] at Normal growth conditions | 18 |
| Root Biomass DW [gr.]/SPAD at 100 mM NaCl growth conditions | 19 |
| Root Biomass DW [gr.]/SPAD at Cold growth conditions | 20 |
| Root Biomass DW [gr.]/SPAD at Normal growth conditions | 21 |
| Root Biomass DW [gr.]/SPAD at low nitrogen growth conditions | 22 |
| Root DW [gr.] at 100 mM NaCl growth conditions | 23 |
| Root DW [gr.] at Cold growth conditions | 24 |
| Root DW [gr.] at Normal growth conditions | 25 |
| Root DW [gr.] at low nitrogen growth conditions | 26 |
| Shoot Biomass DW [gr.]/SPAD at 100 mM NaCl growth conditions | 27 |
| Shoot Biomass DW [gr.]/SPAD at Cold growth conditions | 28 |
| Shoot Biomass DW [gr.]/SPAD at Normal growth conditions | 29 |
| Shoot Biomass DW [gr.]/SPAD at low nitrogen growth conditions | 30 |
| Shoot DW [gr.] at 100 mM NaCl growth conditions | 31 |
| Shoot DW [gr.] at Cold growth conditions | 32 |
| Shoot DW [gr.] at Normal growth conditions | 33 |
| Shoot DW [gr] at low nitrogen growth conditions | 34 |
| Shoot/Root ratio at Normal growth conditions | 35 |
| Shoot/Root ratio at low nitrogen growth conditions | 36 |
| SPAD [SPAD unit] at 100 mM NaCl growth conditions | 37 |
| SPAD [SPAD unit] at Cold growth conditions | 38 |
| SPAD [SPAD unit] at Normal growth conditions | 39 |
| SPAD [SPAD unit] at low nitrogen growth conditions | 40 |
| Total Biomass (Root + Shoot) DW [gr.]/SPAD at 100 mM NaCl growth conditions | 41 |
| Total Biomass (Root + Shoot) DW [gr.]/SPAD at Cold growth conditions | 42 |

TABLE 11-continued

*Sorghum* correlated parameters (vectors)

| Correlated parameter with | Corr. ID |
|---|---|
| Total Biomass (Root + Shoot) DW [gr.]/SPAD at Normal growth conditions | 43 |
| Total Biomass (Root + Shoot) DW [gr.]/SPAD at low nitrogen growth conditions | 44 |

Table 11: Provided are the *Sorghum* correlated parameters. Cold conditions = 10 ± 2° C.; NaCl = 100 mM NaCl; Low nitrogen = 1.2 mM Nitrogen; Normal conditions = 16 mM Nitrogen; "Corr" = correlation.

TABLE 12

*Sorghum* accessions, measured parameters under low nitrogen growth conditions

| Corr. ID | Line-1 | Line-2 | Line-3 | Line-4 | Line-5 |
|---|---|---|---|---|---|
| 4 | 3.9 | 4.27 | 4.7 | 4.23 | 4.3 |
| 17 | 13.3 | 20.6 | 23.7 | 18 | 19.3 |
| 16 | 22.2 | 31.1 | 34.7 | 30 | 30.8 |
| 26 | 0.044 | 0.108 | 0.202 | 0.104 | 0.078 |
| 40 | 26.9 | 28 | 29.6 | 31.5 | 29.6 |
| 34 | 0.082 | 0.187 | 0.328 | 0.163 | 0.163 |
| 6 | 9.6 | 23.5 | 43.9 | 22.6 | 16.9 |
| 8 | 17.9 | 40.6 | 71.4 | 35.4 | 35.3 |
| 10 | 27.5 | 64.1 | 115.2 | 58 | 52.2 |
| 11 | 84.5 | 81 | 117 | 100.5 | 72.5 |
| 12 | 81.6 | 79.2 | 104.8 | 103.5 | 83.7 |
| 13 | 82.6 | 79.8 | 109.1 | 102.3 | 79.7 |
| 22 | 0.0017 | 0.0039 | 0.0068 | 0.0033 | 0.0026 |
| 30 | 0.0031 | 0.0067 | 0.0111 | 0.0052 | 0.0055 |
| 36 | 1.87 | 1.71 | 1.73 | 1.57 | 2.1 |
| 44 | 0.0047 | 0.0105 | 0.0179 | 0.0085 | 0.0081 |

Table 12: Provided are the values of each of the parameters (as described above) measured in *Sorghum* accessions (Line) under low nitrogen conditions. Growth conditions are specified in the experimental procedure section. "Corr" = correlation.

TABLE 13

Additional calculated parameters in *sorghum* accessions, measured parameters under low nitrogen growth conditions

| Corr. ID | Line-6 | Line-7 | Line-8 | Line-9 | Line-10 |
|---|---|---|---|---|---|
| 4 | 4.57 | 4.63 | 4.67 | 3.97 | 4.1 |
| 17 | 19.2 | 21.9 | 22.1 | 18.2 | 21 |
| 16 | 29.9 | 30.9 | 32.4 | 29.4 | 30.7 |
| 26 | 0.086 | 0.13 | 0.094 | 0.086 | 0.092 |
| 40 | 26.8 | 28.5 | 28.2 | 30.5 | 27.6 |
| 34 | 0.156 | 0.259 | 0.199 | 0.13 | 0.184 |
| 6 | 12.4 | 28.2 | 20.5 | 18.8 | 20.1 |
| 8 | 22.7 | 56.4 | 43.2 | 28.3 | 39.9 |
| 10 | 35.1 | 84.6 | 63.7 | 47 | 60 |
| 11 | 71.8 | 93.5 | 76.1 | 86.8 | 80.5 |
| 12 | 83.2 | 107.7 | 81.4 | 70.3 | 75.9 |
| 13 | 78.8 | 102.5 | 79.6 | 76.1 | 77.4 |
| 22 | 0.0032 | 0.0046 | 0.0033 | 0.0028 | 0.0033 |
| 30 | 0.0058 | 0.0091 | 0.007 | 0.0043 | 0.0066 |
| 36 | 1.81 | 2.06 | 2.1 | 1.5 | 2 |
| 44 | 0.009 | 0.0137 | 0.0104 | 0.0071 | 0.01 |

Table 13: Provided are the values of each of the parameters (as described above) measured in *Sorghum* accessions (Line) under low nitrogen conditions. Growth conditions are specified in the experimental procedure section. "Corr" = correlation.

TABLE 14

*Sorghum* accessions, measured parameters under salinity growth conditions

| Corr. ID | Line-1 | Line-2 | Line-3 | Line-4 | Line-5 |
|---|---|---|---|---|---|
| 1 | 4 | 4.13 | 4.57 | 4.43 | 4.07 |
| 14 | 21.8 | 23.2 | 30.4 | 22.8 | 23.7 |
| 23 | 0.05 | 0.104 | 0.124 | 0.069 | 0.076 |
| 37 | 32.7 | 35.1 | 28 | 30.9 | 34.5 |
| 31 | 0.094 | 0.186 | 0.202 | 0.137 | 0.13 |
| 19 | 0.0015 | 0.003 | 0.0044 | 0.0022 | 0.0022 |
| 27 | 0.0029 | 0.0053 | 0.0072 | 0.0044 | 0.0038 |
| 41 | 0.0044 | 0.0083 | 0.0116 | 0.0067 | 0.006 |

Table 14: Provided are the values of each of the parameters (as described above) measured in *Sorghum* accessions (Line) under salinity (100 mM NaCl) growth conditions. Growth conditions are specified in the experimental procedure section. "Corr" = correlation.

TABLE 15

Additional calculated parameters in *sorghum* accessions, measured parameters under salinity growth conditions

| Corr. ID | Line-6 | Line-7 | Line-8 | Line-9 | Line-10 |
|---|---|---|---|---|---|
| 1 | 4.33 | 4.13 | 4.5 | 3.78 | 4.2 |
| 14 | 23.3 | 22.5 | 26.8 | 20.3 | 23.6 |
| 23 | 0.075 | 0.135 | 0.095 | 0.165 | 0.139 |
| 37 | 30 | 32.1 | 31.9 | 32.5 | 34.3 |
| 31 | 0.133 | 0.154 | 0.189 | 0.099 | 0.124 |
| 19 | 0.0025 | 0.0042 | 0.003 | 0.0051 | 0.004 |
| 27 | 0.0044 | 0.0048 | 0.0059 | 0.0031 | 0.0036 |
| 41 | 0.0069 | 0.009 | 0.0089 | 0.0081 | 0.0077 |

Table 15: Provided are the values of each of the parameters (as described above) measured in *Sorghum* accessions (Line) under salinity (100 mM NaCl) growth conditions. Growth conditions are specified in the experimental procedure section. "Corr" = correlation.

TABLE 16

*Sorghum* accessions, measured parameters under cold growth conditions

| Corr. ID | Line-1 | Line-2 | Line-3 | Line-4 | Line-5 |
|---|---|---|---|---|---|
| 2 | 4.73 | 5.33 | 5.43 | 5.5 | 5.33 |
| 15 | 11.2 | 15.9 | 18.4 | 12.2 | 16 |
| 24 | 0.068 | 0.108 | 0.163 | 0.093 | 0.084 |
| 38 | 28.6 | 30.3 | 27 | 32.3 | 28.3 |
| 32 | 0.078 | 0.154 | 0.189 | 0.112 | 0.13 |
| 20 | 0.0024 | 0.0036 | 0.006 | 0.0029 | 0.003 |
| 28 | 0.0027 | 0.0051 | 0.007 | 0.0035 | 0.0046 |
| 42 | 0.0051 | 0.0087 | 0.013 | 0.0064 | 0.0076 |

Table 16: Provided are the values of each of the parameters (as described above) measured in *Sorghum* accessions (Line) under cold growth conditions. Growth conditions are specified in the experimental procedure section. "Corr" = correlation.

TABLE 17

Additional calculated parameters in *sorghum* accessions, measured parameters under cold growth conditions

| Corr. ID | Line-6 | Line-7 | Line-8 | Line-9 | Line-10 |
|---|---|---|---|---|---|
| 2 | 5.07 | 4.5 | 5.4 | 5.37 | 5.18 |
| 15 | 14.6 | 14.6 | 17.3 | 13.4 | 13.9 |
| 24 | 0.114 | 0.137 | 0.127 | 0.108 | 0.139 |
| 38 | 29.9 | 32.5 | 28.6 | 31.7 | 29.6 |
| 32 | 0.165 | 0.152 | 0.15 | 0.112 | 0.141 |

TABLE 17-continued

Additional calculated parameters in *sorghum* accessions, measured parameters under cold growth conditions

| Corr. ID | Line-6 | Line-7 | Line-8 | Line-9 | Line-10 |
|---|---|---|---|---|---|
| 20 | 0.0038 | 0.0042 | 0.0044 | 0.0034 | 0.0047 |
| 28 | 0.0055 | 0.0047 | 0.0052 | 0.0035 | 0.0048 |
| 42 | 0.0093 | 0.0089 | 0.0097 | 0.0069 | 0.0095 |

Table 17: Provided are the values of each of the parameters (as described above) measured in *Sorghum* accessions (Line) under cold growth conditions. Growth conditions are specified in the experimental procedure section. "Corr" = correlation.

TABLE 18

*Sorghum* accessions, measured parameters under regular growth conditions

| Corr. ID | Line-1 | Line-2 | Line-3 | Line-4 | Line-5 |
|---|---|---|---|---|---|
| 3 | 5.33 | 5.87 | 6.2 | 5.8 | 5.8 |
| 18 | 0.155 | 0.186 | 0.159 | 0.173 | 0.171 |
| 25 | 0.052 | 0.134 | 0.172 | 0.103 | 0.107 |
| 39 | 26.7 | 29.3 | 29.9 | 29.1 | 25 |
| 33 | 0.101 | 0.236 | 0.313 | 0.158 | 0.194 |
| 5 | 0.86 | 2.19 | 2.83 | 1.69 | 1.76 |
| 7 | 1.65 | 3.87 | 5.14 | 2.58 | 3.18 |
| 9 | 2.51 | 6.06 | 7.96 | 4.28 | 4.94 |
| 21 | 0.002 | 0.0046 | 0.0058 | 0.0036 | 0.0043 |
| 29 | 0.0038 | 0.008 | 0.0105 | 0.0054 | 0.0078 |
| 35 | 1.98 | 1.94 | 1.9 | 1.59 | 1.81 |
| 43 | 0.0057 | 0.0126 | 0.0163 | 0.009 | 0.0121 |

Table 18: Provided are the values of each of the parameters (as described above) measured in *Sorghum* accessions (Line) under regular growth conditions. Growth conditions are specified in the experimental procedure section. "Corr" = correlation.

TABLE 19

Additional measured parameters under regular growth conditions

| Corr. ID | Line-6 | Line-7 | Line-8 | Line-9 | Line-10 |
|---|---|---|---|---|---|
| 3 | 5.73 | 5.73 | 6 | 5.6 | 6.07 |
| 18 | 0.168 | 0.174 | 0.171 | 0.174 | 0.204 |
| 25 | 0.12 | 0.139 | 0.124 | 0.099 | 0.115 |
| 39 | 24.6 | 30.8 | 25.5 | 32.9 | 33.5 |
| 33 | 0.188 | 0.241 | 0.244 | 0.185 | 0.242 |
| 5 | 1.96 | 2.27 | 2.04 | 1.09 | 1.88 |
| 7 | 3.08 | 3.95 | 4 | 2.02 | 3.97 |
| 9 | 5.04 | 6.22 | 6.04 | 3.11 | 5.85 |
| 21 | 0.0049 | 0.0045 | 0.0049 | 0.003 | 0.0034 |
| 29 | 0.0076 | 0.0078 | 0.0096 | 0.0056 | 0.0072 |
| 35 | 1.58 | 1.76 | 1.99 | 1.89 | 2.2 |
| 43 | 0.0125 | 0.0123 | 0.0144 | 0.0086 | 0.0106 |

Table 19: Provided are the values of each of the parameters (as described above) measured in *Sorghum* accessions (Line) under regular growth conditions. Growth conditions are specified in the experimental procedure section. "Corr" = correlation.

TABLE 20

Correlation between the expression level of selected genes of some embodiments of the invention in various tissues and the phenotypic performance under low nitrogen, normal, cold or salinity stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LGA17 | 0.79 | 1.06E−02 | 5 | 32 | LGA17 | 0.86 | 2.99E−03 | 5 | 28 |
| LGA17 | 0.81 | 7.98E−03 | 5 | 15 | LGA17 | 0.82 | 7.36E−03 | 5 | 42 |
| LGA17 | 0.72 | 2.90E−02 | 5 | 20 | LGB14 | 0.73 | 6.20E−02 | 3 | 13 |
| LGM11 | 0.70 | 3.54E−02 | 5 | 32 | LGM11 | 0.82 | 6.43E−03 | 5 | 28 |
| LGM11 | 0.82 | 7.23E−03 | 5 | 15 | LGM11 | 0.77 | 1.44E−02 | 5 | 42 |
| LGM11 | 0.72 | 2.99E−02 | 8 | 25 | LGM12 | 0.77 | 1.58E−02 | 5 | 38 |
| LGM17 | 0.96 | 5.29E−04 | 3 | 6 | LGM17 | 0.79 | 3.33E−02 | 3 | 16 |
| LGM17 | 0.92 | 3.39E−03 | 3 | 10 | LGM17 | 0.86 | 1.30E−02 | 3 | 8 |
| LGM17 | 0.75 | 5.18E−02 | 3 | 34 | LGM17 | 0.75 | 5.12E−02 | 3 | 17 |
| LGM17 | 0.80 | 2.99E−02 | 3 | 22 | LGM17 | 0.88 | 8.30E−03 | 3 | 26 |
| LGM17 | 0.83 | 2.18E−02 | 3 | 12 | LGM17 | 0.70 | 7.70E−02 | 3 | 44 |
| LGM23 | 0.87 | 2.04E−03 | 6 | 6 | LGM23 | 0.86 | 2.79E−03 | 6 | 10 |
| LGM23 | 0.84 | 4.77E−03 | 6 | 8 | LGM23 | 0.84 | 4.77E−03 | 6 | 34 |
| LGM23 | 0.82 | 6.62E−03 | 6 | 30 | LGM23 | 0.88 | 1.76E−03 | 6 | 22 |
| LGM23 | 0.87 | 2.04E−03 | 6 | 26 | LGM23 | 0.85 | 3.41E−03 | 6 | 44 |
| LGM23 | 0.71 | 3.31E−02 | 7 | 23 | | | | | |

Table 20.

Provided are the correlations (R) between the genes expression levels in various tissues and the phenotypic performance.

"Corr. Set ID"—correlation set ID according to the correlated parameters specified in Table 11.

"Exp. Set"—Expression set specified in Table 10.

"R" = Pearson correlation coefficient;

"P" = p value.

Example 4

Production of Maize Transcriptome and High Throughput Correlation Analysis with Yield and Nue Related Parameters Using 60 K Maize Oligonucleotide Micro-Arrays In order to produce a high throughput correlation analysis between plant phenotype and gene expression level, the present inventors utilized a maize oligonucleotide micro-array, produced by Agilent Technologies [chem(dot)agilent(dot)com/Scripts/PDS(dot)asp?1Page=50879]. The array oligonucleotide represents about 60,000 maize genes and transcripts.

Correlation of Maize Hybrids Across Ecotypes Grown Under Low Nitrogen Conditions Experimental Procedures Twelve Maize hybrids were grown in 3 repetitive plots in field. Maize seeds were planted and plants were grown in the field using commercial fertilization and irrigation protocols (normal growth conditions), which included 485 m³ water per dunam (1000 square meters) per entire growth period and fertilization of 30 units of URAN® 21% fertilization per dunam per entire growth period. For nitrogen deficient assays, the growth conditions included 50% percent less Nitrogen as compared to the amount of nitrogen provided under the normal conditions. In order to define correlations between the levels of RNA expression with NUE and yield components or vigor related parameters, the 12 different maize hybrids were analyzed. Among them, 11 hybrids encompassing the observed variance were selected for RNA expression analysis. The correlation between the RNA levels and the characterized parameters was analyzed using Pearson correlation test [davidmlane (dot)com/hyperstat/A34739 (dot)html].

Analyzed Maize tissues—All 11 selected maize hybrids were sampled per each treatment (low Nitrogen and normal conditions), in three time points: TP2=V6-V8 (six to eight collar leaves are visible, rapid growth phase and kernel row determination begins; TP5=R1-R2 (silking-blister); and TP6=R3-R4 (milk-dough). Four types of plant tissues [Ear, flag leaf indicated in Table as leaf, grain distal part, and internode] were sampled and RNA was extracted as described above. Each micro-array expression information tissue type has received a Set ID as summarized in Tables 21-22 below.

TABLE 21

Maize transcriptome expression sets under low nitrogen conditions

| Expression Set | Set ID |
| --- | --- |
| Ear under low nitrogen conditions at reproductive stage: R1-R2 | 1 |
| Ear under low nitrogen conditions at reproductive stage: R3-R4 | 2 |
| Internode under low nitrogen conditions at vegetative stage: V6-V8 | 3 |
| Internode under low nitrogen conditions at reproductive stage: R1-R2 | 4 |
| Internode under low nitrogen conditions at reproductive stage: R3-R4 | 5 |
| Leaf under low nitrogen conditions at vegetative stage: V6-V8 | 6 |
| Leaf under low nitrogen conditions at reproductive stage: R1-R2 | 7 |
| Leaf under low nitrogen conditions at reproductive stage: R3-R4 | 8 |

Table 21: Provided are the maize transcriptome expression sets under low nitrogen (N) growth conditions Leaf = the leaf below the main ear; Ear = the female flower at the anthesis day; Internodes = internodes located above and below the main ear in the plant. "TP" = time point.

TABLE 22

Maize transcriptome expression sets under normal growth conditions

| Expression Set | Set ID |
| --- | --- |
| Ear at R1-R2 stage under normal conditions | 1 |
| Grain distal at R4-R5 stage under normal conditions | 2 |
| Internode at R3-R4 stage under normal conditions | 3 |
| Leaf at R1-R2 stage under normal conditions | 4 |
| Ear at R3-R4 stage under normal conditions | 5 |
| Internode at R1-R2 stage under normal conditions | 6 |
| Internode at V6-V8 stage under normal conditions | 7 |
| Leaf at V6-V8 stage under normal conditions | 8 |

Table 22: Provided are the maize transcriptome expression sets under normal growth conditions. Leaf = the leaf below the main ear; Ear = the female flower at the anthesis day. Grain Distal = maize developing grains from the cob extreme area; Internodes = internodes located above and below the main ear in the plant. "R1-R2" = silking - blister stages (reproductive stage, early grain development); "R3-R4" = milk-dough (reproductive development, grain filling stages); "R4-R5" = dough-dent stage (grain filling stages); "V6-V8" = vegetative stages, the collar of the 6-8 leaf is visible.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were photographed and images were processed using the below described image processing system. The Ear area was measured from those images and was divided by the number of Ears.

Ear Length (cm) and Ear Width (mm)—At the end of the growing period 5 ears were photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (kg)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (kg)—At the end of the experiment (when ears were harvested) total and 6 selected ears per plots within blocks A-C were collected separately. The plants (total and 6) were weighted (gr.) separately and the average ear per plant was calculated for total (Ear FW per plot) and for 6 plants (Ear FW per plant).

Plant height and Ear height [cm]—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant [number]—Plants were characterized for leaf number during growing period at 5 time points. In each measure, plants were measured for their leaf number by counting all the leaves of 3 selected plants per plot.

Relative Growth Rate was calculated using Formula VII (described above).

SPAD [SPAD unit]—Chlorophyll content was determined using a Minolta SPAD 502 chlorophyll meter and measurement was performed at early stages of grain filling (R1-R2) and late stage of grain filling (R3-R4). SPAD meter readings were done on young fully developed leaves. Three measurements per leaf were taken per plot. Data were taken after 46 and 54 days after (post) sowing (DPS).

Dry weight per plant [kg]—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index per plant was calculated using Formula XVII (described above).

Percent Filled Ear [%]—was calculated as the percentage of the Ear area with grains out of the total ear.

Cob diameter [mm]—The diameter of the cob without grains was measured using a ruler.

Kernel Row Number per Ear [number]—The number of rows in each ear was counted.

Experimental Results

Twelve different maize hybrids were grown and characterized for different parameters. Tables 23-24 describe the Maize correlated parameters. The average for each of the measured parameters was calculated using the JMP software (Tables 25-28) and a subsequent correlation analysis was performed (Tables 29-30). Results were then integrated to the database.

TABLE 23

Maize correlated parameters (vectors) under low nitrogen conditions

| Correlated parameter with | Corr. ID |
|---|---|
| Dry weight per plant [kg] at low nitrogen growth conditions | 1 |
| Ear height [cm] at low nitrogen growth conditions | 2 |
| Ear Length [cm] at low nitrogen growth conditions | 3 |
| Ear width [mm] at low nitrogen growth conditions | 4 |
| Kernel Row Number per Ear [num] at low nitrogen growth conditions | 5 |
| Leaf number per plant TP1 [num] at low nitrogen growth conditions | 6 |
| Leaf number per plant TP2 [num] at low nitrogen growth conditions | 7 |
| Leaf number per plant TP3 [num] at low nitrogen growth conditions | 8 |
| Leaf number per plant TP4 [num] at low nitrogen growth conditions | 9 |
| Leaf number per plant TP5 [num] at low nitrogen growth conditions | 10 |
| Plant height [cm] at low nitrogen growth conditions | 11 |
| SPAD R1-R2 [SPAD unit] at low nitrogen growth conditions | 12 |
| SPAD R3-R4 [SPAD unit] at low nitrogen growth conditions | 13 |

Table 23. "cm" = centimeters; "mm" = millimeters; "kg" = kilograms; SPAD at R1-R2 and SPAD R3-R4 = Chlorophyll level after early and late stages of grain filling. "R1-R2" = silking - blister stages (reproductive stage, early grain development); "R3-R4" = milk-dough (reproductive development, grain filling stages).

TABLE 24

Maize correlated parameters (vectors) under normal conditions

| Correlated parameter with | Corr. ID |
|---|---|
| Dry weight per plant [kg] at Normal growth conditions | 1 |
| Ear height [cm] at Normal growth conditions | 2 |
| Ear Length [cm] at Normal growth conditions | 3 |
| Ear Width [mm] at Normal growth conditions | 4 |
| Kernel Row Number per Ear [num] at Normal growth conditions | 5 |
| Leaf number per plant TP1 [num] at Normal growth conditions | 6 |
| Leaf number per plant TP2 [num] at Normal growth conditions | 7 |
| Leaf number per plant TP3 [num] at Normal growth conditions | 8 |
| Leaf number per plant TP4 [num] at Normal growth conditions | 9 |
| Leaf number per plant TP5 [num] at Normal growth conditions | 10 |
| Plant height [cm] at Normal growth conditions | 11 |
| SPAD [SPAD unit] at Normal growth conditions | 12 |

Table 24. "cm" = centimeters; "mm" = millimeters; "kg" = kilograms; SPAD: Chlorophyll level after early and late stages of grain filling; "dunam" = 1000 m$^2$.

TABLE 25

Measured parameters in Maize accessions under Low nitrogen conditions

| | Line | | | | | |
|---|---|---|---|---|---|---|
| Corr. ID | Line-1 | Line-2 | Line-3 | Line-4 | Line-5 | Line-6 |
| 1 | 1.59 | 1.43 | 1.53 | 1.95 | 1.48 | 1.6 |
| 3 | 20.6 | 21 | 20.2 | 20.1 | 20.1 | 18.5 |
| 2 | 158.1 | 136.2 | 128.4 | 133.1 | 137.8 | 99.6 |
| 4 | 46.7 | 48.2 | 48.3 | 49.9 | 52.9 | 47.4 |
| 5 | 14.2 | 15.2 | 15 | 15.7 | 16 | 15.9 |
| 6 | 6.5 | 7.86 | 7.67 | 7.17 | 4.97 | 8.61 |
| 7 | 8.22 | 8.28 | 8.56 | 8.22 | 7.61 | 10.44 |
| 8 | 9.7 | 10.3 | 10.4 | 10.4 | 7.9 | 11.2 |
| 9 | 11.2 | 11.6 | 12.1 | 11.5 | 8.9 | 11.8 |
| 10 | 12.7 | 12.4 | 14.4 | 13.1 | 12.2 | 14.3 |
| 11 | 305.8 | 270.9 | 290.6 | 252.2 | 260.2 | 227.2 |
| 12 | 60.2 | 57.9 | 58.8 | 59.5 | 58.5 | 64 |
| 13 | 59.3 | 57.6 | 58.4 | 59.2 | 58.2 | 62.7 |

Table 25.
Provided are the values of each of the parameters (as described above) measured in maize accessions (line) under low nitrogen gowth conditions.
Growth conditions are specified in the experimental procedure section.

TABLE 26

Additional parameters in Maize accessions under Low nitrogen conditions

| | Line | | | | |
|---|---|---|---|---|---|
| Corr. ID | Line-7 | Line-8 | Line-9 | Line-10 | Line-11 |
| 1 | 1.58 | 1.28 | 1.51 | 0.43 | 1.52 |
| 3 | 19.1 | 18.2 | 20.1 | 17.8 | 21.2 |

TABLE 26-continued

Additional parameters in Maize accessions under Low nitrogen conditions

| Corr. ID | Line-7 | Line-8 | Line-9 | Line-10 | Line-11 |
|---|---|---|---|---|---|
| 2 | 130.2 | 114.6 | 143.9 | 61.6 | 114.4 |
| 4 | 49.6 | 48.6 | 52.4 | 42.6 | 50 |
| 5 | 15.6 | 14.5 | 16.4 | 14.4 | 15.7 |
| 6 | 7.5 | 8.39 | 5.21 | 7.44 | 7.78 |
| 7 | 8.06 | 8.61 | 6.61 | 8.11 | 8.78 |
| 8 | 10.1 | 11.6 | 7.7 | 10.4 | 10.9 |
| 9 | 11.4 | 12.3 | 8.9 | 11.1 | 12.1 |
| 10 | 13.6 | 14.9 | 11.6 | 11.7 | 14.9 |
| 11 | 271.7 | 248.6 | 279.3 | 171.3 | 269.8 |
| 12 | 56.4 | 60 | 58.3 | 53.1 | 61.7 |
| 13 | 61 | 59.9 | 57.5 | 49.6 | 61.9 |

Table 26. Provided are the values of each of the parameters (as described above) measured in maize accessions (line) under low nitrogen growth conditions. Growth conditions are specified in the experimental procedure section.

TABLE 27

Measured parameters in Maize accessions under normal growth conditions

| Corr. ID | Line-1 | Line-2 | Line-3 | Line-4 | Line-5 | Line-6 |
|---|---|---|---|---|---|---|
| 1 | 1.27 | 1.3 | 1.33 | 1.5 | 1.3 | 1.58 |
| 3 | 19.9 | 20.2 | 18.1 | 19.9 | 19.5 | 17.7 |
| 4 | 51.1 | 46.3 | 45.9 | 47.6 | 51.4 | 47.4 |
| 2 | 130.3 | 122.3 | 127.7 | 113 | 135.3 | 94.3 |
| 5 | 16.1 | 14.7 | 15.4 | 15.9 | 16.2 | 15.2 |
| 6 | 5.67 | 7.83 | 7.61 | 7.11 | 5.11 | 7.94 |
| 7 | 7.33 | 8.83 | 9.5 | 8.94 | 7.11 | 10.06 |
| 8 | 8.4 | 10.3 | 10.8 | 10.4 | 7.9 | 11.8 |
| 9 | 9.4 | 11.1 | 11.8 | 11.3 | 9 | 11.4 |
| 10 | 12.4 | 12.8 | 14.2 | 13.4 | 12.8 | 14 |
| 11 | 273.5 | 260.5 | 288 | 238.5 | 286.9 | 224.8 |
| 12 | 59.9 | 60.9 | 56.9 | 58.7 | 58.7 | 63.2 |

Table 27. Provided are the values of each of the parameters (as described above) measured in maize accessions (line) under normal growth conditions. Growth conditions are specified in the experimental procedure section.

TABLE 28

Additional measured parameters in Maize accessions under normal growth conditions

| Corr. Id | Line-7 | Line-8 | Line-9 | Line-10 | Line-11 |
|---|---|---|---|---|---|
| 1 | 1.42 | 1.37 | 1.7 | 0.42 | 11.38 |
| 3 | 17.7 | 17.3 | 17.5 | 19.9 | 20.5 |
| 4 | 47.3 | 46.8 | 48.3 | 41.8 | 49.3 |
| 2 | 120.9 | 107.7 | 139.7 | 60.4 | 112.5 |
| 5 | 16 | 14.8 | 17.7 | 14.3 | 15.4 |
| 6 | 7.5 | 8 | 5.33 | 7.11 | 7.67 |
| 7 | 9.22 | 9.67 | 7.39 | 8.89 | 9.22 |
| 8 | 10.8 | 11.5 | 8.7 | 10.6 | 11.3 |
| 9 | 11.2 | 11.8 | 9.3 | 10.8 | 12 |
| 10 | 13.3 | 14.3 | 12.8 | 11.6 | 14.6 |
| 11 | 264.4 | 251.6 | 279 | 163.8 | 278.4 |
| 12 | 59.8 | 62.4 | 57.2 | 49.3 | 61.9 |

Table 28. Provided are the values of each of the parameters (as described above) measured in maize accessions (line) under normal growth conditions. Growth conditions are specified in the experimental procedure section.

TABLE 29

Correlation between the expression level of selected genes of some embodiments of the invention in various tissues and the phenotypic performance under low nitrogen conditions across maize accessions

| Gene Name | R | P value | Exp. set | Corr. Set ID | Gene Name | R | P value | Exp. set | Corr. Set ID |
|---|---|---|---|---|---|---|---|---|---|
| LGB7 | 0.80 | 3.06E−02 | 1 | 2 | LGB7 | 0.88 | 8.45E−03 | 1 | 4 |
| LGB7 | 0.74 | 5.56E−02 | 1 | 11 | LGB7 | 0.84 | 1.84E−02 | 1 | 1 |
| LGB7 | 0.75 | 5.22E−02 | 4 | 7 | LGB7 | 0.90 | 5.63E−03 | 4 | 8 |
| LGB7 | 0.73 | 6.18E−02 | 4 | 13 | LGB7 | 0.89 | 7.82E−03 | 4 | 12 |
| LGB7 | 0.74 | 5.79E−02 | 4 | 6 | LGB8 | 0.73 | 6.11E−02 | 1 | 2 |
| LGB8 | 0.78 | 3.96E−02 | 1 | 4 | LGB8 | 0.73 | 1.66E−02 | 3 | 2 |
| LGM14 | 0.74 | 5.76E−02 | 1 | 8 | LGM14 | 0.73 | 6.35E−02 | 1 | 2 |
| LGM14 | 0.81 | 2.73E−02 | 1 | 13 | LGM14 | 0.72 | 7.07E−02 | 1 | 12 |
| LGM14 | 0.75 | 5.22E−02 | 1 | 9 | LGM14 | 0.72 | 6.89E−02 | 1 | 4 |
| LGM14 | 0.80 | 3.17E−02 | 1 | 11 | LGM14 | 0.74 | 5.84E−02 | 1 | 6 |
| LGM14 | 0.93 | 6.62E−03 | 6 | 2 | LGM14 | 0.75 | 3.22E−02 | 7 | 2 |
| LGM14 | 0.83 | 1.16E−02 | 7 | 9 | LGM14 | 0.76 | 2.92E−02 | 7 | 4 |
| LGM14 | 0.79 | 1.93E−02 | 7 | 11 | LGM14 | 0.73 | 4.16E−02 | 7 | 10 |
| LGM16 | 0.77 | 4.19E−02 | 4 | 2 | LGM16 | 0.76 | 4.93E−02 | 1 | 2 |
| LGM16 | 0.76 | 4.87E−02 | 1 | 13 | LGM16 | 0.79 | 3.36E−02 | 1 | 9 |
| LGM16 | 0.81 | 2.66E−02 | 1 | 4 | LGM16 | 0.81 | 2.57E−02 | 1 | 11 |
| LGM16 | 0.82 | 2.29E−02 | 1 | 1 | LGM16 | 0.77 | 4.31E−02 | 1 | 10 |
| LGM19 | 0.92 | 3.18E−03 | 1 | 13 | LGM19 | 0.79 | 3.35E−02 | 1 | 12 |
| LGM19 | 0.73 | 6.16E−02 | 1 | 9 | LGM19 | 0.79 | 3.51E−02 | 1 | 3 |
| LGM19 | 0.89 | 7.42E−03 | 1 | 10 | LGM19 | 0.81 | 8.30E−03 | 5 | 2 |
| LGM19 | 0.77 | 1.42E−02 | 5 | 11 | LGM19 | 0.83 | 3.91E−02 | 6 | 9 |
| LGM19 | 0.78 | 6.83E−02 | 6 | 10 | LGM19 | 0.71 | 2.10E−02 | 3 | 13 |
| LGM19 | 0.75 | 3.29E−02 | 8 | 2 | LGM19 | 0.88 | 4.19E−03 | 8 | 13 |
| LGM19 | 0.91 | 1.45E−03 | 8 | 12 | LGM19 | 0.85 | 7.98E−03 | 8 | 10 |
| LGM19 | 0.73 | 3.84E−02 | 7 | 12 | LGM19 | 0.70 | 5.19E−02 | 7 | 1 |
| LGM19 | 0.78 | 4.05E−02 | 4 | 2 | LGM19 | 0.81 | 2.78E−02 | 4 | 12 |
| LGM19 | 0.73 | 6.42E−02 | 4 | 11 | LGM21 | 0.78 | 1.39E−02 | 5 | 7 |

TABLE 29-continued

Correlation between the expression level of selected genes of some embodiments of the invention in various tissues and the phenotypic performance under low nitrogen conditions across maize accessions

| Gene Name | R | P value | Exp. set | Corr. Set ID | Gene Name | R | P value | Exp. set | Corr. Set ID |
|---|---|---|---|---|---|---|---|---|---|
| LGM21 | 0.82 | 4.75E−02 | 6 | 2 | LGM21 | 0.77 | 7.32E−02 | 6 | 11 |
| LGM21 | 0.88 | 4.21E−03 | 2 | 1 | LGM21 | 0.86 | 1.29E−02 | 4 | 7 |
| LGM21 | 0.77 | 4.19E−02 | 4 | 8 | LGM21 | 0.88 | 8.23E−03 | 4 | 12 |
| LGM21 | 0.82 | 2.55E−02 | 4 | 6 | LGM4 | 0.72 | 1.09E−01 | 6 | 8 |
| LGM4 | 0.73 | 1.00E−01 | 6 | 10 | LGM4 | 0.73 | 1.75E−02 | 3 | 8 |
| LGM4 | 0.71 | 2.03E−02 | 3 | 9 | LGM4 | 0.92 | 1.90E−04 | 3 | 10 |
| LGM4 | 0.73 | 3.87E−02 | 2 | 13 | LGM4 | 0.70 | 5.13E−02 | 2 | 9 |
| LGM4 | 0.84 | 8.67E−03 | 2 | 10 | LGM4 | 0.77 | 4.46E−02 | 4 | 9 |
| LGM4 | 0.77 | 4.48E−02 | 4 | 10 | LGM5 | 0.79 | 3.50E−02 | 1 | 10 |
| LGM5 | 0.75 | 2.02E−02 | 5 | 1 | LGM5 | 0.74 | 3.39E−02 | 8 | 5 |
| LGM7 | 0.86 | 2.76E−02 | 6 | 3 | LGM7 | 0.71 | 4.77E−02 | 8 | 6 |
| LGM8 | 0.74 | 5.86E−02 | 1 | 13 | LGM8 | 0.70 | 7.72E−02 | 1 | 12 |
| LGM8 | 0.85 | 1.59E−02 | 1 | 10 | LGM8 | 0.71 | 1.12E−01 | 6 | 4 |
| LGM8 | 0.81 | 4.91E−02 | 6 | 3 | LGM8 | 0.80 | 1.65E−02 | 7 | 8 |
| LGM8 | 0.79 | 3.62E−02 | 4 | 13 | LGM8 | 0.72 | 6.69E−02 | 4 | 9 |
| LGM9 | 0.79 | 3.30E−02 | 1 | 9 | LGM9 | 0.80 | 3.00E−02 | 1 | 10 |
| LGM9 | 0.80 | 5.72E−02 | 6 | 4 | LGM9 | 0.76 | 1.09E−02 | 3 | 8 |
| LGM9 | 0.76 | 2.70E−02 | 8 | 7 | LGM9 | 0.74 | 3.72E−02 | 7 | 8 |
| LGM9 | 0.74 | 5.97E−02 | 4 | 8 | | | | | |

Table 29.
Provided are the correlations (R) between the genes expression levels in various tissues and the phenotypic performance.
"Corr. Set ID"—correlation set ID according to the correlated parameters specified in Table 23.
"Exp. Set"—Expression set specified in Table 21.
"R" = Pearson correlation coefficient;
"P" = p value.

TABLE 30

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LGB8 | 0.85 | 1.46E−02 | 1 | 6 | LGB8 | 0.81 | 2.59E−02 | 1 | 12 |
| LGB8 | 0.73 | 6.52E−02 | 1 | 7 | LGB8 | 0.73 | 9.92E−02 | 5 | 2 |
| LGB8 | 0.83 | 4.00E−02 | 5 | 5 | LGB8 | 0.72 | 4.47E−02 | 2 | 3 |
| LGB8 | 0.81 | 1.46E−02 | 2 | 4 | LGB8 | 0.72 | 4.30E−02 | 3 | 12 |
| LGM14 | 0.71 | 7.39E−02 | 1 | 6 | LGM14 | 0.79 | 3.31E−02 | 1 | 12 |
| LGM14 | 0.87 | 1.19E−02 | 1 | 2 | LGM14 | 0.82 | 2.50E−02 | 1 | 11 |
| LGM14 | 0.74 | 3.58E−02 | 2 | 10 | LGM14 | 0.82 | 1.24E−02 | 2 | 1 |
| LGM14 | 0.83 | 2.20E−02 | 4 | 2 | LGM14 | 0.73 | 6.07E−02 | 4 | 11 |
| LGM14 | 0.73 | 6.42E−02 | 6 | 12 | LGM14 | 0.74 | 5.75E−02 | 6 | 2 |
| LGM16 | 0.78 | 3.84E−02 | 1 | 8 | LGM16 | 0.81 | 2.83E−02 | 1 | 1 |
| LGM16 | 0.78 | 3.83E−02 | 1 | 11 | LGM16 | 0.86 | 1.32E−02 | 1 | 7 |
| LGM16 | 0.72 | 6.58E−02 | 1 | 4 | LGM16 | 0.73 | 3.89E−02 | 2 | 5 |
| LGM16 | 0.71 | 7.60E−02 | 6 | 10 | LGM16 | 0.78 | 4.00E−02 | 6 | 5 |
| LGM16 | 0.71 | 3.16E−02 | 7 | 4 | LGM19 | 0.91 | 4.55E−03 | 1 | 10 |
| LGM19 | 0.88 | 8.43E−03 | 1 | 12 | LGM19 | 0.71 | 7.18E−02 | 1 | 5 |
| LGM19 | 0.76 | 4.68E−02 | 1 | 9 | LGM19 | 0.93 | 2.17E−03 | 1 | 4 |
| LGM19 | 0.74 | 9.35E−02 | 5 | 1 | LGM19 | 0.81 | 1.58E−02 | 2 | 10 |
| LGM19 | 0.75 | 1.27E−02 | 8 | 10 | LGM19 | 0.92 | 1.62E−04 | 8 | 12 |
| LGM19 | 0.80 | 3.21E−02 | 4 | 5 | LGM19 | 0.76 | 4.94E−02 | 4 | 4 |
| LGM19 | 0.74 | 3.70E−02 | 3 | 12 | LGM19 | 0.76 | 4.87E−02 | 6 | 10 |
| LGM19 | 0.74 | 5.57E−02 | 6 | 12 | LGM19 | 0.87 | 1.06E−02 | 6 | 5 |
| LGM19 | 0.95 | 1.07E−03 | 6 | 4 | LGM19 | 0.85 | 3.94E−03 | 7 | 12 |
| LGM21 | 0.74 | 5.73E−02 | 1 | 10 | LGM21 | 0.80 | 3.05E−02 | 1 | 12 |
| LGM21 | 0.84 | 1.79E−02 | 1 | 2 | LGM21 | 0.79 | 3.53E−02 | 1 | 11 |
| LGM21 | 0.74 | 5.49E−02 | 1 | 4 | LGM21 | 0.75 | 8.73E−02 | 5 | 4 |
| LGM21 | 0.74 | 2.22E−02 | 7 | 5 | LGM21 | 0.76 | 1.65E−02 | 7 | 4 |
| LGM4 | 0.85 | 1.55E−02 | 1 | 1 | LGM4 | 0.71 | 7.26E−02 | 1 | 9 |
| LGM4 | 0.70 | 7.92E−02 | 1 | 4 | LGM4 | 0.76 | 7.90E−02 | 5 | 12 |
| LGM4 | 0.85 | 7.48E−03 | 2 | 2 | LGM4 | 0.89 | 2.96E−03 | 2 | 11 |
| LGM4 | 0.81 | 4.59E−03 | 8 | 1 | LGM4 | 0.74 | 5.57E−02 | 4 | 8 |
| LGM4 | 0.77 | 4.32E−02 | 4 | 6 | LGM4 | 0.72 | 6.58E−02 | 4 | 12 |
| LGM4 | 0.75 | 3.15E−02 | 3 | 12 | LGM4 | 0.71 | 7.63E−02 | 6 | 8 |
| LGM4 | 0.72 | 6.65E−02 | 6 | 10 | LGM4 | 0.76 | 4.95E−02 | 6 | 1 |
| LGM4 | 0.70 | 7.73E−02 | 6 | 9 | LGM4 | 0.70 | 7.90E−02 | 6 | 4 |

TABLE 30-continued

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LGM4 | 0.83 | 6.19E−03 | 7 | 10 | LGM4 | 0.71 | 3.22E−02 | 7 | 6 |
| LGM4 | 0.78 | 1.23E−02 | 7 | 9 | LGM5 | 0.88 | 8.20E−03 | 1 | 8 |
| LGM5 | 0.93 | 2.53E−03 | 1 | 7 | LGM5 | 0.76 | 7.66E−02 | 5 | 6 |
| LGM5 | 0.74 | 9.15E−02 | 5 | 9 | LGM5 | 0.74 | 8.97E−02 | 5 | 7 |
| LGM5 | 0.85 | 1.49E−02 | 4 | 1 | LGM5 | 0.81 | 8.53E−03 | 7 | 4 |
| LGM7 | 0.81 | 2.59E−02 | 1 | 6 | LGM7 | 0.82 | 2.27E−02 | 1 | 7 |
| LGM7 | 0.73 | 1.01E−01 | 5 | 2 | LGM7 | 0.71 | 4.72E−02 | 2 | 10 |
| LGM8 | 0.72 | 6.84E−02 | 1 | 8 | LGM8 | 0.73 | 6.09E−02 | 1 | 10 |
| LGM8 | 0.71 | 7.39E−02 | 1 | 6 | LGM8 | 0.73 | 6.04E−02 | 1 | 9 |
| LGM8 | 0.70 | 7.79E−02 | 1 | 7 | LGM8 | 0.81 | 5.17E−02 | 5 | 1 |
| LGM8 | 0.79 | 2.00E−02 | 3 | 10 | LGM8 | 0.72 | 6.83E−02 | 6 | 10 |
| LGM8 | 0.86 | 1.26E−02 | 6 | 6 | LGM8 | 0.75 | 5.25E−02 | 6 | 12 |

Table 30.
Provided are the correlations (R) between the genes expression levels in various tissues and the phenotypic performance.
"Corr. Set ID"—correlation set ID according to the correlated parameters specified in Table 24.
"Exp. Set"—Expression set specified in Table 22.
"R" = Pearson correlation coefficient;
"P" = p value.

Example 5

Production of Maize Transcriptome and High Throughput Correlation Analysis with Yield and Nue Related Parameters Using 44K Maize Oligonucleotide Micro-Arrays In order to produce a high throughput correlation analysis between plant phenotype and gene expression level, the present inventors utilized a maize oligonucleotide microarray, produced by Agilent Technologies [chem(dot)agilent (dot)com/Scripts/PDS(dot)asp?1Page=50879]. The array oligonucleotide represents about 45,000 maize genes and transcripts.

Correlation of Maize Hybrids Across Ecotypes Grown Under Regular Growth Conditions Experimental Procedures Twelve Maize hybrids were grown in 3 repetitive plots, in field. Maize seeds were planted and plants were grown in the field using commercial fertilization and irrigation protocols (normal growth conditions), which included 485 m³ water per dunam (1000 square meters) per entire growth period and fertilization of 30 units of URAN® 21% fertilization per dunam per entire growth period. In order to define correlations between the levels of RNA expression with stress and yield components or vigor related parameters, the 12 different maize hybrids were analyzed. Among them, 10 hybrids encompassing the observed variance were selected for RNA expression analysis. The correlation between the RNA levels and the characterized parameters were analyzed using Pearson correlation test [davidmlane (dot)com/hyperstat/A34739 (dot)html].

Analyzed Maize tissues—All 10 selected maize hybrids were sampled in three time points (TP2=V2-V3 (when two to three collar leaf are visible, rapid growth phase and kernel row determination begins), TP5=R1-R2 (silking-blister), TP6=R3-R4 (milk-dough). Four types of plant tissues [Ear, flag leaf indicated in Table as leaf, grain distal part, and internode] were sampled and RNA was extracted as described in "GENERAL EXPERIMENTAL AND BIOINFORMATICS METHODS". For convenience, each microarray expression information tissue type has received a Set ID as summarized in Table 31 below.

TABLE 31

Maize transcriptome expression sets under normal growth conditions

| Expression Set | Set ID |
|---|---|
| Ear under normal conditions at reproductive stage: R1-R2 | 1 |
| Ear under normal conditions at reproductive stage: R3-R4 | 2 |
| Internode under normal conditions at vegetative stage: Vegetative V2-3 | 3 |
| Internode under normal conditions at reproductive stage: R1-R2 | 4 |
| Internode under normal conditions at reproductive stage: R3-R4 | 5 |
| Leaf under normal conditions at vegetative stage: Vegetative V2-3 | 6 |
| Leaf under normal conditions at reproductive stage: R1-R2 | 7 |
| Grain distal under normal conditions at reproductive stage: R1-R2 | 8 |

Table 31: Provided are the maize transcriptome expression sets. Leaf = the leaf below the main ear; Ear = the female flower at the anthesis day. Grain Distal = maize developing grains from the cob extreme area; Internodes = internodes located above and below the main ear in the plant.

The following parameters were collected using digital imaging system:

Grain Area ($cm^2$)—At the end of the growing period the grains were separated from the ear. A sample of ~200 grains was weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were photographed and images were processed using the below described image processing system. The ear area was measured from those images and was divided by the number of ears.

Ear Length and Ear Width (cm)—At the end of the growing period 5 ears were photographed and images were processed using the below described image processing system. The ear length and width (longest axis) was measured from those images and was divided by the number of ears.

The image processing system which used consists of a personal desktop computer (Intel P4 3.0 GHz processor) and a public domain program—ImageJ 1.37, Java based image processing software, was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants (total and 6) were weighted (gr.) separately and the average ear per plant was calculated for total (Ear FW per plot) and for 6 plants (Ear FW per plant).

Plant height and Ear height [cm]—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant [num]—Plants were characterized for leaf number during growing period at 5 time points. In each measure, plants were measured for their leaf number by counting all the leaves of 3 selected plants per plot.

Relative Growth Rate was calculated using Formula VII (described above).

SPAD [SPAD unit]—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after (post) sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index was calculated using Formula XVII above.

Percent Filled Ear [%]—was calculated as the percentage of the Ear area with grains out of the total ear.

Cob diameter [mm]—The diameter of the cob without grains was measured using a ruler.

Kernel Row Number per Ear [number]—The number of rows in each ear was counted.

Data parameters collected are summarized in Table 32 herein below

TABLE 32

Maize correlated parameters (vectors)

| Correlated parameter with | Corr. ID |
|---|---|
| Cob diameter [mm] at normal growth conditions | 1 |
| Dry weight per plant [gr.] at normal growth conditions | 2 |
| Ear Area [cm²] at normal growth conditions | 3 |
| Ear FW (per plant) [gr.] at normal growth conditions | 4 |
| Ear FW (per plot) [gr.] at normal growth conditions | 5 |
| Ear height [cm] at normal growth conditions | 6 |
| Ear Length [cm] at normal growth conditions | 7 |
| Ear Width [cm] at normal growth conditions | 8 |
| Grain Area [cm²] at normal growth conditions | 9 |
| Grain Length [cm] at normal growth conditions | 10 |
| Grain width [cm] at normal growth conditions | 11 |
| Kernel Row Number per Ear [num] at normal growth conditions | 12 |
| Leaf number per plant [num] at normal growth conditions | 13 |
| Normalized Grain Weight per plant (per plant) [gr.] at normal growth conditions | 14 |
| Normalized Grain Weight per plant (per plot) [gr.] at normal growth conditions | 15 |
| Percent Filled Ear [%] at normal growth conditions | 16 |
| Plant height [cm] at normal growth conditions | 17 |
| Relative Growth Rate [leaves/day] at normal growth conditions | 18 |
| SPAD 46 DPS [SPAD unit] at normal growth conditions | 19 |
| SPAD 54 DPS [SPAD unit] at normal growth conditions | 20 |

Table 32. SPAD 46 DPS and SPAD 54 DPS: Chlorophyll level after 46 and 54 days after sowing (DPS), respectively. "FW" = fresh weight; "Corr." = correlation.

Experimental Results

Twelve different maize hybrids were grown and characterized for different parameters. The correlated parameters are described in Table 32 above. The average for each of the measured parameters was calculated using the JMP software (Tables 33-34) and a subsequent correlation analysis was performed (Table 35). Results were then integrated to the database.

TABLE 33

Measured parameters in Maize accessions under normal conditions

| | Line | | | | | |
|---|---|---|---|---|---|---|
| Corr. ID | Line-1 | Line-2 | Line-3 | Line-4 | Line-5 | Line-6 |
| 20 | 54.3 | 57.2 | 56 | 59.7 | 54.8 | 59.1 |
| 19 | 51.7 | 56.4 | 53.5 | 55.2 | 55.3 | 59.4 |
| 1 | 29 | 25.1 | 28.1 | 25.7 | 28.7 | 25.8 |
| 2 | 657.5 | 491.7 | 641.1 | 580.6 | 655.6 | 569.4 |
| 3 | 85.1 | 85.8 | 90.5 | 96 | 91.6 | 72.4 |
| 4 | 245.8 | 208.3 | 262.2 | 263.9 | 272.2 | 177.8 |
| 5 | 278.2 | 217.5 | 288.3 | 247.9 | 280.1 | 175.8 |
| 7 | 19.7 | 19.1 | 20.5 | 21.3 | 20.9 | 18.2 |
| 8 | 5.58 | 5.15 | 5.67 | 5.53 | 5.73 | 5.23 |
| 6 | 135.2 | 122.3 | 132 | 114 | 135.3 | 94.3 |
| 9 | 0.753 | 0.708 | 0.755 | 0.766 | 0.806 | 0.713 |
| 10 | 1.17 | 1.09 | 1.18 | 1.2 | 1.23 | 1.12 |
| 11 | 0.81 | 0.814 | 0.803 | 0.803 | 0.824 | 0.803 |
| 12 | 16.2 | 14.7 | 16.2 | 15.9 | 16.2 | 15.2 |
| 13 | 12 | 11.1 | 11.7 | 11.8 | 11.9 | 12.3 |
| 14 | 153.9 | 135.9 | 152.5 | 159.2 | 140.5 | 117.1 |
| 15 | 140.7 | 139.5 | 153.7 | 177 | 156.6 | 119.7 |
| 16 | 80.6 | 86.8 | 82.1 | 92.7 | 80.4 | 82.8 |
| 17 | 278.1 | 260.5 | 275.1 | 238.5 | 286.9 | 224.8 |
| 18 | 0.283 | 0.221 | 0.281 | 0.269 | 0.306 | 0.244 |

Table 33.
Provided are the values of each of the parameters (as described above) measured in maize accessions (Line) under regular growth conditions.
Growth conditions are specified in the experimental procedure section.
"Corr." = correlation.

TABLE 34

Additional measured parameters in Maize accessions under regular growth conditions

| Corr. ID | Line-7 | Line-8 | Line-9 | Line-10 | Line-11 | Line-12 |
|---|---|---|---|---|---|---|
| 20 | 58 | 60.4 | 54.8 | 51.4 | 61.1 | 53.3 |
| 19 | 58.5 | 55.9 | 53 | 53.9 | 59.7 | 50 |
| 1 | 26.4 | 25.2 | | 26.7 | | |
| 2 | 511.1 | 544.4 | | 574.2 | 522.2 | |
| 3 | 74 | 76.5 | | 55.2 | 95.4 | |
| 4 | 188.9 | 197.2 | | 141.1 | 261.1 | |
| 5 | 192.5 | 204.7 | | 142.7 | 264.2 | |
| 7 | 19 | 18.6 | | 16.7 | 21.7 | |
| 8 | 5.22 | 5.33 | | 4.12 | 5.58 | |
| 6 | 120.9 | 107.7 | | 60.4 | 112.5 | |
| 9 | 0.714 | 0.753 | | 0.502 | 0.762 | |
| 10 | 1.14 | 1.13 | | 0.92 | 1.18 | |
| 11 | 0.791 | 0.837 | | 0.675 | 0.812 | |
| 12 | 16 | 14.8 | | 14.3 | 15.4 | |
| 13 | 12.4 | 12.2 | | 9.3 | 12.6 | |
| 14 | 123.2 | 131.3 | | 40.8 | 170.7 | |
| 15 | 119.7 | 133.5 | | 54.3 | 173.2 | |
| 16 | 73.2 | 81.1 | | 81.1 | 91.6 | |
| 17 | 264.4 | 251.6 | | 163.8 | 278.4 | |
| 18 | 0.244 | 0.266 | | 0.194 | 0.301 | |

Table 34.
Provided are the values of each of the parameters (as described above) measured in maize accessions (Line) under regular growth conditions.
Growth conditions are specified in the experimental procedure section.
"Corr." = correlation.

TABLE 35

Correlation between the expression level of selected genes of some embodiments of the invention in various tissues and the phenotypic performance under normal across maize accessions

| Gene Name | R | P value | Exp. set | Corr. Set ID | Gene Name | R | P value | Exp. set | Corr. Set ID |
|---|---|---|---|---|---|---|---|---|---|
| LGB7 | 0.72 | 1.04E−01 | 4 | 1 | LGB7 | 0.77 | 7.17E−02 | 2 | 13 |
| LGB8 | 0.75 | 5.30E−02 | 1 | 11 | LGB8 | 0.75 | 3.31E−02 | 8 | 18 |
| LGB8 | 0.82 | 1.32E−02 | 8 | 14 | LGB8 | 0.73 | 3.94E−02 | 8 | 4 |
| LGB8 | 0.72 | 4.32E−02 | 8 | 2 | LGB8 | 0.73 | 4.04E−02 | 8 | 7 |
| LGB8 | 0.71 | 5.02E−02 | 8 | 15 | LGM14 | 0.89 | 8.03E−03 | 5 | 1 |
| LGM14 | 0.77 | 4.25E−02 | 4 | 6 | LGM14 | 0.74 | 5.49E−02 | 4 | 11 |
| LGM14 | 0.85 | 1.51E−02 | 7 | 6 | LGM14 | 0.72 | 6.88E−02 | 7 | 17 |
| LGM14 | 0.71 | 7.46E−02 | 7 | 11 | LGM14 | 0.83 | 4.07E−02 | 7 | 1 |
| LGM14 | 0.77 | 4.17E−02 | 1 | 6 | LGM14 | 0.73 | 6.32E−02 | 1 | 17 |
| LGM14 | 0.80 | 3.15E−02 | 1 | 11 | LGM14 | 0.74 | 2.20E−02 | 3 | 6 |
| LGM14 | 0.85 | 3.35E−02 | 2 | 13 | LGM16 | 0.73 | 6.27E−02 | 4 | 10 |
| LGM16 | 0.70 | 7.96E−02 | 4 | 18 | LGM16 | 0.75 | 5.10E−02 | 4 | 4 |
| LGM16 | 0.71 | 7.22E−02 | 4 | 7 | LGM16 | 0.86 | 1.32E−02 | 4 | 12 |
| LGM16 | 0.74 | 5.58E−02 | 7 | 2 | LGM16 | 0.76 | 7.74E−02 | 7 | 1 |
| LGM16 | 0.71 | 7.32E−02 | 1 | 10 | LGM16 | 0.85 | 1.44E−02 | 1 | 18 |
| LGM16 | 0.80 | 2.91E−02 | 1 | 13 | LGM16 | 0.74 | 5.73E−02 | 1 | 17 |
| LGM16 | 0.71 | 7.64E−02 | 1 | 9 | LGM16 | 0.77 | 4.08E−02 | 1 | 8 |
| LGM16 | 0.84 | 9.42E−03 | 8 | 10 | LGM16 | 0.81 | 1.55E−02 | 8 | 18 |
| LGM16 | 0.73 | 3.95E−02 | 8 | 3 | LGM16 | 0.86 | 6.35E−03 | 8 | 5 |
| LGM16 | 0.74 | 3.62E−02 | 8 | 9 | LGM16 | 0.84 | 9.80E−03 | 8 | 14 |
| LGM16 | 0.88 | 3.89E−03 | 8 | 4 | LGM16 | 0.87 | 4.53E−03 | 8 | 2 |
| LGM16 | 0.80 | 1.63E−02 | 8 | 7 | LGM16 | 0.77 | 2.39E−02 | 8 | 12 |
| LGM16 | 0.76 | 2.99E−02 | 8 | 1 | LGM16 | 0.72 | 4.56E−02 | 8 | 15 |
| LGM16 | 0.90 | 2.37E−03 | 8 | 8 | LGM19 | 0.92 | 3.49E−03 | 4 | 10 |
| LGM19 | 0.83 | 2.04E−02 | 4 | 18 | LGM19 | 0.89 | 6.91E−03 | 4 | 13 |
| LGM19 | 0.83 | 2.03E−02 | 4 | 3 | LGM19 | 0.71 | 7.22E−02 | 4 | 17 |
| LGM19 | 0.90 | 6.05E−03 | 4 | 9 | LGM19 | 0.90 | 5.66E−03 | 4 | 14 |
| LGM19 | 0.76 | 4.65E−02 | 4 | 4 | LGM19 | 0.80 | 3.01E−02 | 4 | 11 |
| LGM19 | 0.83 | 2.06E−02 | 4 | 7 | LGM19 | 0.72 | 7.04E−02 | 4 | 16 |
| LGM19 | 0.92 | 3.83E−03 | 4 | 15 | LGM19 | 0.87 | 1.17E−02 | 4 | 8 |
| LGM19 | 0.87 | 1.13E−02 | 7 | 10 | LGM19 | 0.74 | 5.89E−02 | 7 | 13 |
| LGM19 | 0.71 | 7.15E−02 | 7 | 3 | LGM19 | 0.79 | 3.41E−02 | 7 | 20 |
| LGM19 | 0.86 | 1.28E−02 | 7 | 9 | LGM19 | 0.78 | 4.06E−02 | 7 | 14 |
| LGM19 | 0.79 | 3.64E−02 | 7 | 11 | LGM19 | 0.81 | 2.64E−02 | 7 | 15 |
| LGM19 | 0.80 | 2.93E−02 | 7 | 8 | LGM19 | 0.84 | 1.92E−02 | 1 | 10 |
| LGM19 | 0.78 | 4.05E−02 | 1 | 18 | LGM19 | 0.96 | 4.73E−04 | 1 | 13 |
| LGM19 | 0.85 | 1.66E−02 | 1 | 9 | LGM19 | 0.78 | 4.05E−02 | 1 | 14 |
| LGM19 | 0.81 | 2.83E−02 | 1 | 11 | LGM19 | 0.76 | 4.92E−02 | 1 | 15 |
| LGM19 | 0.80 | 3.23E−02 | 1 | 8 | LGM19 | 0.87 | 1.14E−03 | 6 | 13 |
| LGM19 | 0.72 | 1.78E−02 | 6 | 14 | LGM19 | 0.81 | 4.09E−03 | 6 | 11 |
| LGM19 | 0.88 | 2.00E−02 | 2 | 11 | LGM19 | 0.97 | 1.74E−03 | 2 | 16 |
| LGM21 | 0.80 | 2.94E−02 | 1 | 10 | LGM21 | 0.87 | 1.19E−02 | 1 | 13 |
| LGM21 | 0.82 | 2.30E−02 | 1 | 6 | LGM21 | 0.81 | 2.68E−02 | 1 | 17 |
| LGM21 | 0.83 | 2.13E−02 | 1 | 9 | LGM21 | 0.79 | 3.51E−02 | 1 | 14 |
| LGM21 | 0.90 | 5.29E−03 | 1 | 11 | LGM21 | 0.73 | 6.18E−02 | 1 | 15 |
| LGM21 | 0.83 | 2.11E−02 | 1 | 8 | LGM21 | 0.81 | 5.27E−02 | 2 | 13 |
| LGM4 | 0.79 | 3.62E−02 | 4 | 13 | LGM4 | 0.72 | 6.62E−02 | 7 | 13 |
| LGM4 | 0.74 | 5.53E−02 | 1 | 13 | LGM4 | 0.81 | 1.39E−02 | 8 | 6 |

TABLE 35-continued

Correlation between the expression level of selected genes of some embodiments of the invention in various tissues and the phenotypic performance under normal across maize accessions

| Gene Name | R | P value | Exp. set | Corr. Set ID | Gene Name | R | P value | Exp. set | Corr. Set ID |
|---|---|---|---|---|---|---|---|---|---|
| LGM4 | 0.92 | 1.35E−03 | 8 | 17 | LGM4 | 0.72 | 1.93E−02 | 6 | 19 |
| LGM4 | 0.82 | 4.47E−02 | 2 | 13 | LGM5 | 0.76 | 7.78E−02 | 7 | 1 |
| LGM5 | 0.74 | 2.29E−02 | 6 | 1 | LGM7 | 0.72 | 1.07E−01 | 2 | 6 |
| LGM7 | 0.86 | 2.97E−02 | 2 | 12 | LGM8 | 0.74 | 5.90E−02 | 4 | 17 |
| LGM8 | 0.83 | 4.19E−02 | 4 | 1 | LGM8 | 0.78 | 2.29E−02 | 8 | 18 |
| LGM8 | 0.72 | 4.35E−02 | 8 | 17 | LGM8 | 0.77 | 2.49E−02 | 8 | 9 |
| LGM8 | 0.75 | 3.09E−02 | 8 | 11 | LGM8 | 0.71 | 4.83E−02 | 8 | 8 |
| LGM8 | 0.76 | 7.74E−02 | 2 | 10 | LGM8 | 0.81 | 4.96E−02 | 2 | 18 |
| LGM8 | 0.86 | 2.88E−02 | 2 | 3 | LGM8 | 0.82 | 4.67E−02 | 2 | 9 |
| LGM8 | 0.78 | 6.50E−02 | 2 | 14 | LGM8 | 0.78 | 6.56E−02 | 2 | 4 |
| LGM8 | 0.82 | 4.33E−02 | 2 | 7 | LGM8 | 0.71 | 1.17E−01 | 2 | 16 |
| LGM8 | 0.91 | 1.19E−02 | 2 | 15 | LGM8 | 0.74 | 9.46E−02 | 2 | 8 |

Table 35.
Provided are the correlations (R) between the genes expression levels in various tissues and the phenotypic performance.
"Corr. Set ID"—correlation set ID according to the correlated parameters specified in Table 32.
"Exp. Set"—Expression set specified in Table 31.
"R" = Pearson correlation coefficient;
"P" = p value.

Example 6

Production of Maize Transcriptome and High Throughput Correlation Analysis with Yield, Nue, and Abst Related Parameters Measured in Semi-Hydroponics Conditions Using 60 K Maize Oligonucleotide Micro-Arrays Maize vigor related parameters under low nitrogen (1.6 mM), salinity (100 mM NaCl), low temperature (10±2° C.) and normal growth conditions—Twelve Maize hybrids were grown in 5 repetitive plots, each containing 7 plants, at a net house under semi-hydroponics conditions. Briefly, the growing protocol was as follows: Maize seeds were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution, i.e., to a final concentration of 10% from full Hoagland solution, final amount of 1.6 mM N) or at Normal growth solution (Full Hoagland containing 16 mM N solution, at 28±2° C.). Plants were grown at 28±2° C. unless otherwise indicated.

Full Hoagland solution consists of: $KNO_3$-0.808 grams/liter, $MgSO_4$-0.12 grams/liter, $KH_2PO_4$-0.136 grams/liter and 0.01% (volume/volume) of 'Super coratin' micro elements (Iron-EDDHA [ethylenediamine-N,N'-bis(2-hydroxyphenylacetic acid)]—40.5 grams/liter Mn—20.2 grams/liter; Zn 10.1 grams/liter; Co 1.5 grams/liter; and Mo 1.1 grams/liter), solution's pH should be 6.5-6.8.

Experimental Procedures

Analyzed Maize tissues—Twelve selected Maize hybrids were sampled per each treatment. Two tissues [leaves and root tip] representing different plant characteristics were sampled. Plants were sampled from all 4 treatments applied: salinity (100 mM NaCl), low temperature (10±2° C.), low Nitrogen (1.6 mM N) and Normal conditions. Sampling was done at the vegetative stage (V4-5) and RNA was extracted as described above. Each micro-array expression information tissue type has received a Set ID as summarized in Table 36-39 below.

TABLE 36

Maize transcriptome expression sets under normal conditions at semi hydroponics system

| Expression Set | Set ID |
|---|---|
| leaf at vegetative stage (V4-V5) under Normal conditions | 1 |
| root tip at vegetative stage (V4-V5) under Normal conditions | 2 |

Table 36: Provided are the Maize transcriptome expression sets at normal conditions.

TABLE 37

Maize transcriptome expression sets under cold conditions at semi hydroponics system

| Expression Set | Set ID |
|---|---|
| leaf at vegetative stage (V4-V5) under cold conditions | 1 |
| root tip at vegetative stage (V4-V5) under cold conditions | 2 |

Table 37: Provided are the Maize transcriptome expression sets at cold conditions.

TABLE 38

Maize transcriptome expression sets under low nitrogen conditions at semi hydroponics system

| Expression Set | Set ID |
|---|---|
| leaf at vegetative stage (V4-V5) under low nitrogen conditions (1.6 mM N) | 1 |
| root tip at vegetative stage (V4-V5) under low nitrogen conditions (1.6 mM N) | 2 |

Table 38: Provided are the Maize transcriptome expression sets at low nitrogen conditions 1.6 mM Nitrogen.

TABLE 39

Maize transcriptome expression sets under high salinity conditions at semi hydroponics system

| Expression Set | Set ID |
|---|---|
| leaf at vegetative stage (V4-V5) under salinity conditions (NaCl 100 mM) | 1 |
| root tip at vegetative stage (V4-V5) under salinity conditions (NaCl 100 mM) | 2 |

Table 39: Provided are the Maize transcriptome expression sets at 100 mM NaCl.

Phenotypic Parameters Assessment

Ten different Maize hybrids were grown and characterized at the vegetative stage (V4-5) for the following parameters:

Leaves dry weight (DW)=leaves dry weight per plant (average of five plants);

Plant height growth—the relative growth rate (RGR) of Plant Height was calculated using Formula III (above).

Root dry weight (DW)—At the end of the experiment, the root material was collected, measured and divided by the number of plants (average of four plants);

Shoot dry weight (DW)—shoot dry weight per plant, all vegetative tissue above ground (average of four plants) after drying at 70° C. in oven for 48 hours;

Shoot fresh weight (FW)—shoot fresh weight per plant, all vegetative tissue above ground (average of four plants);

SPAD [SPAD unit]—Chlorophyll content was determined using a Minolta SPAD 502 chlorophyll meter and measurement was performed 30 days post sowing. SPAD meter readings were done on young fully developed leaf. Three measurements per leaf were taken per plot.

Root length—the length of the root was measured at V4 developmental stage.

Data parameters collected are summarized in Tables 40-42 herein below

TABLE 40

Maize correlated parameters (vectors) under cold conditions

| Correlated parameter with | Correlation ID |
|---|---|
| Leaves DW [gr.], under Cold growth conditions | 1 |
| Plant height growth [cm/day], under Cold growth conditions | 2 |
| Root DW [gr.], under Cold growth conditions | 3 |
| Root length [cm], under Cold growth conditions | 4 |
| Shoot DW [gr.], under Cold growth conditions | 5 |
| Shoot FW [gr.], under Cold growth conditions | 6 |
| SPAD [SPAD unit], under Cold growth conditions | 7 |

Table 40: Provided are the Maize correlated parameters under cold conditions. "DW" = dry weight; "gr." = gram; "cm" = centimeter; "FW" = fresh weight; "SPAD" = chlorophyll levels.

TABLE 41

Maize correlated parameters (vectors) under low nitrogen conditions

| Correlated parameter with | Correlation ID |
|---|---|
| Leaves DW [gr], under Low Nitrogen growth conditions | 1 |
| Root DW [gr], under Low Nitrogen growth conditions | 2 |
| Shoot DW [gr], under Low Nitrogen growth conditions | 3 |

Table 41: Provided are the Maize correlated parameters under low nitrogen conditions. "DW" = dry weight; "gr" = gram; "Low N" = low nitrogen conditions.

TABLE 42

Maize correlated parameters (vectors) under normal and salinity growth conditions

| Correlated parameter with | Correlation ID |
|---|---|
| Leaves DW [gr.] | 1 |
| Plant height growth [cm/day] | 2 |
| Root DW [gr.] | 3 |
| Root length [cm] | 4 |
| Shoot DW [gr.] | 5 |
| Shoot FW [gr.] | 6 |
| SPAD [SPAD unit] | 7 |

Table 42: Provided are the Maize correlated parameters under normal, and salinity growth conditions. "DW" = dry weight; "FW" = fresh weight; "SPAD" = chlorophyll levels; "gr" = gram.

Experimental Results

Twelve different maize accessions were grown and characterized for different parameters as described above. Tables 40-42 describe the maize correlated parameters. The average for each of the measured parameters was calculated using the JMP software and values are summarized in Tables 43-50 below. Subsequent correlation analyses between the various transcriptome sets and the average parameters (Tables 51-54) were conducted. Follow, results were integrated to the database.

TABLE 43

Maize accessions, measured parameters under low nitrogen growth conditions

| | Line | | | | | |
|---|---|---|---|---|---|---|
| Corr. ID | Line-1 | Line-2 | Line-3 | Line-4 | Line-5 | Line-6 |
| 1 | 0.566 | 0.451 | 0.464 | 0.476 | 0.355 | 0.514 |
| 2 | 0.38 | 0.353 | 0.255 | 0.36 | 0.313 | 0.297 |
| 3 | 2.56 | 1.96 | 2.01 | 1.94 | 1.94 | 2.52 |

Table 43:
Provided are the values of each of the parameters (as described above) measured in Maize accessions (Line) under low nitrogen conditions.
Growth conditions are specified in the experimental procedure section.
"Corr." = Correlation.

TABLE 44

Maize accessions, measured parameters under low nitrogen growth conditions

| Line/Corr. ID | Line-7 | Line-8 | Line-9 | Line-10 | Line-11 | Line-12 |
|---|---|---|---|---|---|---|
| 1 | 0.529 | 0.579 | 0.551 | 0.51 | 0.563 | 0.392 |
| 2 | 0.289 | 0.306 | 0.291 | 0.322 | 0.43 | 0.168 |
| 3 | 2.03 | 2.37 | 2.09 | 2.17 | 2.62 | 1.53 |

Table 44: Provided are the values of each of the parameters (as described above) measured in Maize accessions (Line) under low nitrogen conditions. Growth conditions are specified in the experimental procedure section.
"Corr." = Correlation.

TABLE 45

Maize accessions, measured parameters under 100 mM NaCl (salinity) growth conditions

| Line/Corr. ID | Line-1 | Line-2 | Line-3 | Line-4 | Line-5 | Line-6 |
|---|---|---|---|---|---|---|
| 1 | 0.407 | 0.502 | 0.432 | 0.481 | 0.434 | 0.564 |
| 2 | 0.457 | 0.398 | 0.454 | 0.316 | 0.322 | 0.311 |
| 3 | 0.047 | 0.0503 | 0.0295 | 0.071 | 0.0458 | 0.0307 |
| 4 | 10.9 | 11.3 | 11.8 | 10.1 | 8.5 | 10.6 |
| 7 | 36.5 | 39.9 | 37.8 | 41.3 | 40.8 | 44.4 |
| 5 | 2.43 | 2.19 | 2.25 | 2.26 | 1.54 | 1.94 |
| 6 | 19.6 | 20.8 | 18.4 | 19.4 | 15.6 | 16.1 |

Table 45 Provided are the values of each of the parameters (as described above) measured in Maize accessions (Line) under 100 mM NaCl gowth conditions. Growth conditions are specified in the experimental procedure section.
"Corr." = Correlation.

TABLE 46

Additional Maize accessions, measured parameters under 100 mM NaCl (salinity) growth conditions

| Line/Corr. ID | Line-7 | Line-8 | Line-9 | Line-10 | Line-11 | Line-12 |
|---|---|---|---|---|---|---|
| 1 | 0.327 | 0.507 | 0.465 | 0.984 | 0.475 | 0.154 |
| 2 | 0.29 | 0.359 | 0.37 | 0.355 | 0.305 | 0.272 |
| 3 | 0.0954 | 0.0625 | 0.0163 | 0.0355 | 0.0494 | 0.0146 |
| 4 | 10.1 | 11.8 | 10.5 | 11.2 | 10.1 | 8.9 |
| 7 | 37.9 | 43.2 | 39.8 | 38.2 | 38.1 | 37.8 |
| 5 | 1.78 | 1.9 | 1.89 | 2.2 | 1.86 | 0.97 |
| 6 | 12.5 | 16.9 | 16.8 | 17.6 | 15.9 | 9.4 |

Table 46 Provided are the values of each of the parameters (as described above) measured in Maize accessions (Line) under 100 mM NaCl growth conditions. Growth conditions are specified in the experimental procedure section.
"Corr." = Correlation.

TABLE 47

Maize accessions, measured parameters under cold growth conditions

| Line/Corr. ID | Line-1 | Line-2 | Line-3 | Line-4 | Line-5 | Line-6 | Line-7 |
|---|---|---|---|---|---|---|---|
| 1 | 1.19 | 1.17 | 1.02 | 1.18 | 1.04 | 1.23 | 1.13 |
| 2 | 2.15 | 1.93 | 2.12 | 1.8 | 2.32 | 2.15 | 2.49 |
| 3 | 0.0466 | 0.0683 | 0.1 | 0.0808 | 0.0659 | 0.0667 | 0.1367 |
| 7 | 28.9 | 29.1 | 27.1 | 32.4 | 32.7 | 32.9 | 31.6 |
| 5 | 5.74 | 4.86 | 3.98 | 4.22 | 4.63 | 4.93 | 4.82 |
| 6 | 73.8 | 55.5 | 51.3 | 54.9 | 59 | 62.4 | 63.6 |

Table 47: Provided are the values of each of the parameters (as described above) measured in Maize accessions (Line) under cold growth conditions. Growth conditions are specified in the experimental procedure section.
"Corr." = Correlation.

TABLE 48

Additional Maize accessions, measured parameters under cold growth conditions

| Line/Corr. ID | Line-8 | Line-9 | Line-10 | Line-11 | Line-12 |
|---|---|---|---|---|---|
| 1 | 0.98 | 0.88 | 1.28 | 1.1 | 0.6 |
| 2 | 2.01 | 1.95 | 2.03 | 1.85 | 1.21 |
| 3 | 0.0667 | 0.0733 | 0.0204 | 0.0517 | 0.0567 |
| 7 | 33 | 28.6 | 31.4 | 30.6 | 30.7 |
| 5 | 4.03 | 3.57 | 3.99 | 4.64 | 1.89 |
| 6 | 54.9 | 48.2 | 52.8 | 55.1 | 29.6 |

Table 48: Provided are the values of each of the parameters (as described above) measured in Maize accessions (Line) under cold growth conditions. Growth conditions are specified in the experimental procedure section.
"Corr." = Correlation.

TABLE 49

Maize accessions, measured parameters under normal growth conditions

| Line/Corr. ID | Line-1 | Line-2 | Line-3 | Line-4 | Line-5 | Line-6 |
|---|---|---|---|---|---|---|
| 1 | 1.161 | 1.099 | 0.924 | 1.013 | 0.935 | 0.907 |
| 2 | 1.99 | 1.92 | 1.93 | 1.93 | 2.15 | 1.95 |
| 3 | 0.14 | 0.106 | 0.227 | 0.155 | 0.077 | 0.049 |
| 4 | 20.1 | 15.9 | 18.6 | 18.7 | 16.4 | 14.9 |
| 7 | 34.5 | 35.8 | 34.7 | 34.4 | 35.3 | 37.5 |
| 5 | 5.27 | 4.67 | 3.88 | 5.08 | 4.1 | 4.46 |
| 6 | 79 | 62.8 | 59.7 | 63.9 | 60.1 | 64.7 |

Table 49: Provided are the values of each of the parameters (as described above) measured in Maize accessions (Line) under regular growth conditions. Growth conditions are specified in the experimental procedure section.
"Corr." = Correlation.

TABLE 50

Maize accessions, measured parameters under normal growth conditions

| Line/Corr. ID | Line-7 | Line-8 | Line-9 | Line-10 | Line-11 | Line-12 |
|---|---|---|---|---|---|---|
| 1 | 1.105 | 1.006 | 1.011 | 1.024 | 1.23 | 0.44 |
| 2 | 2.23 | 1.94 | 1.97 | 2.05 | 1.74 | 1.26 |
| 3 | 0.175 | 0.101 | 0.069 | 0.104 | 0.138 | 0.03 |
| 4 | 17.5 | 15.7 | 15.7 | 17.6 | 16.1 | 17.4 |
| 7 | 36.5 | 36.1 | 33.7 | 34.3 | 35.7 | 29 |

TABLE 50-continued

Maize accessions, measured parameters under normal growth conditions

| Line/Corr. ID | Line-7 | Line-8 | Line-9 | Line-10 | Line-11 | Line-12 |
|---|---|---|---|---|---|---|
| 5 | 4.68 | 4.59 | 4.08 | 4.61 | 5.42 | 2.02 |
| 6 | 68.1 | 65.8 | 58.3 | 61.9 | 70 | 36 |

Table 50: Provided are the values of each of the parameters (as described above) measured in Maize accessions (Line) under regular growth conditions. Growth conditions are specified in the experimental procedure section.
"Corr." = Correlation.

TABLE 51

Correlation between the expression level of selected genes of some embodiments of the invention in various tissues and the phenotypic performance under normal conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGB8 | 0.72 | 2.81E−02 | 2 | 6 | LGB8 | 0.72 | 2.87E−02 | 2 | 4 |
| LGB8 | 0.71 | 3.29E−02 | 2 | 3 | LGM14 | 0.70 | 3.52E−02 | 2 | 7 |
| LGM19 | 0.73 | 1.56E−02 | 1 | 7 | LGM5 | 0.90 | 1.07E−03 | 2 | 4 |

Table 51. Provided are the correlations (R) between the genes expression levels in various tissues and the phenotypic performance.
"Corr. Set ID"—correlation set ID according to the correlated parameters specified in Table 42.
"Exp. Set"—Expression set specified in Table 36.
"R" = Pearson correlation coefficient;
"P" = p value.

TABLE 52

Correlation between the expression level of selected genes of some embodiments of the invention in various tissues and the phenotypic performance under low nitrogen conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGM14 | 0.79 | 1.06E−02 | 2 | 1 | LGM19 | 0.75 | 1.26E−02 | 1 | 1 |

Table 52. Provided are the correlations (R) between the genes expression levels in various tissues and the phenotypic performance.
"Corr. Set ID"—correlation set ID according to the correlated parameters specified in Table 41.
"Exp. Set"—Expression set specified in Table 38.
"R" = Pearson correlation coefficient;
"P" = p value.

TABLE 53

Correlation between the expression level of selected genes of some embodiments of the invention in various tissues and the phenotypic performance under cold conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGB8 | 0.72 | 2.89E−02 | 2 | 5 | LGM16 | 0,77 | 2.60E−02 | 1 | 6 |
| LGM16 | 0.83 | 1.15E−02 | 1 | 5 | LGM19 | 0.82 | 1.19E−02 | 1 | 1 |
| LGM21 | 0.80 | 1.70E−02 | 1 | 3 | | | | | |

Table 53. Provided are the correlations (R) between the genes expression levels in various tissues and the phenotypic performance.
"Corr. Set ID"—correlation set ID according to the correlated parameters specified in Table 40.
"Exp. Set"—Expression set specified in Table 37.
"R" = Pearson correlation coefficient;
"P" = p value.

TABLE 54

Correlation between the expression level of selected genes of some embodiments of the invention in various tissues and the phenotypic performance under salinity conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGM14 | 0.77 | 1.50E−02 | 2 | 4 | LGM14 | 0.92 | 4.56E−04 | 2 | 7 |
| LGM4 | 0.85 | 3.58E−03 | 2 | 1 | LGM4 | 0.88 | 1.66E−03 | 2 | 7 |
| LGIVI8 | 0.73 | 1.56E−02 | 1 | 3 | LGM9 | 0.82 | 3.85E−03 | 1 | 3 |

Table 54. Provided are the correlations (R) between the genes expression levels in various tissues and the phenotypic performance.
"Corr. Set ID"—correlation set ID according to the correlated parameters specified in Table 42.
"Exp. Set"—Expression set specified in Table 39.
"R" = Pearson correlation coefficient;
"P" = p value.

Example 7

Production of Foxtail Millet Transcriptome and High Throughput Correlation Analysis Using 60 K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [chem (dot)agilent(dot)com/Scripts/PDS(dot)asp?1Page=50879]. The array oligonucleotide represents about 60K foxtail millet genes and transcripts. In order to define correlations between the levels of RNA expression and yield or vigor related parameters, various plant characteristics of 14 different foxtail millet accessions were analyzed. Among them, 11 accessions encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

Fourteen foxtail millet varieties were grown in 5 repetitive plots, in field. Briefly, the growing protocol was as follows:

1. Regular growth conditions: foxtail millet plants were grown in the field using commercial fertilization and irrigation protocols (normal growth conditions), which include 283 m$^3$ water per dunam (100 square meters) per entire growth period and fertilization of 16 units of URAN® 32% (Nitrogen Fertilizer Solution; PCS Sales, Northbrook, Ill., USA).

2. Drought conditions: foxtail millet seeds were sown in soil and grown under normal condition until the heading stage (22 days from sowing), and then drought treatment was imposed by irrigating plants with 50% water relative to the normal treatment (171 m$^3$ water per dunam per entire growth period).

Analyzed Foxtail millet tissues—All 14 foxtail millet lines were sample per each treatment. Four tissues [leaf, flower, grain and stem] at 2 different developmental stages [flowering, grain filling], representing different plant characteristics were sampled and RNA was extracted as described above. Each micro-array expression information tissue type has received a Set ID as summarized in Tables 55-58 below.

TABLE 55

Foxtail millet transcriptome expression sets under drought conditions at flowering stage

| Expression Set | Set ID |
|---|---|
| Flower at flowering stage, under drought growth conditions | 1 |
| Leaf at flowering stage, under drought growth conditions | 2 |
| Stem at flowering stage, under drought growth conditions | 3 |

Table 55. Provided are the foxtail millet transcriptome expression sets under drought conditions at flowering stage.

TABLE 56

Foxtail millet transcriptome expression sets under drought conditions at grain filling stage

| Expression Set | Set ID |
|---|---|
| Grain at grain filling stage, under drought growth conditions | 1 |
| Leaf at grain filling stage, under drought growth conditions | 2 |
| Stem at grain filling stage, under drought growth conditions | 3 |

Table 56. Provided are the foxtail millet transcriptome expression sets under drought conditions at grain filling stage.

TABLE 57

Foxtail millet transcriptome expression sets under normal conditions at flowering stage

| Expression Set | Set ID |
|---|---|
| Flower at flowering stage, under normal growth conditions | 1 |
| Leaf at flowering stage, under normal growth conditions | 2 |

Table 57. Provided are the foxtail millet transcriptome expression sets under normal conditions at flowering stage.

TABLE 58

Foxtail millet transcriptome expression sets under normal conditions at grain filling stage

| Expression Set | Set ID |
|---|---|
| Grain at grain filling stage, under normal growth conditions | 1 |
| Leaf at grain filling stage, under normal growth conditions | 2 |
| Stem at grain filling stage, under normal growth conditions | 3 |

Table 58. Provided are the foxtail millet transcriptome expression sets under normal conditions at grain filling stage.

Foxtail millet yield components and vigor related parameters assessment—Plants were continuously phenotyped during the growth period and at harvest (Table 59-60, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

Average Grain Area ($cm^2$)—A sample of ~200 grains was weighted, photographed and images were processed using the below described image processing system. The grain area was measured from those images and was divided by the number of grains.

Average Grain Length and width (cm)—A sample of ~200 grains was weighted, photographed and images were processed using the below described image processing system. The sum of grain lengths and width (longest axis) were measured from those images and were divided by the number of grains.

At the end of the growing period 14 'Heads' were photographed and images were processed using the below described image processing system.

Average Grain Perimeter (cm)—At the end of the growing period the grains were separated from the Plant 'Head'. A sample of ~200 grains were weighted, photographed and images were processed using the below described image processing system. The sum of grain perimeter was measured from those images and was divided by the number of grains.

Head Average Area ($cm^2$)—The 'Head' area was measured from those images and was divided by the number of 'Heads'.

Head Average Length and width (cm)—The 'Head' length and width (longest axis) were measured from those images and were divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Head weight (Kg.) and head number (num.)—At the end of the experiment, heads were harvested from each plot and were counted and weighted.

Total Grain Yield (gr.)—At the end of the experiment (plant 'Heads') heads from plots were collected, the heads were threshed and grains were weighted. In addition, the average grain weight per head was calculated by dividing the total grain weight by number of total heads per plot (based on plot).

1000 Seeds weight [gr.]—was calculated based on Formula XIV (above).

Biomass at harvest [kg]—At the end of the experiment the vegetative portion above ground (excluding roots) from plots was weighted.

Total dry mater per plot [kg]—Calculated as Vegetative portion above ground plus all the heads dry weight per plot.

Number (num) of days to anthesis—Calculated as the number of days from sowing till 50% of the plot arrives anthesis.

Maintenance of performance under drought conditions: Represent ratio for the specified parameter of Drought condition results divided by Normal conditions results (maintenance of phenotype under drought in comparison to normal conditions).

Data parameters collected are summarized in Tables 61-62, herein below.

TABLE 59

Foxtail millet correlated parameters under drought and normal conditions (vectors)

| Correlated parameter with | Correlation ID |
|---|---|
| 1000 Seeds weight [gr.] | 1 |
| Average Grain Area [$cm^2$] | 2 |
| Average Grain Length [cm] | 3 |
| Average Grain Perimeter [cm] | 4 |
| Average Grain Width [cm] | 5 |
| Biomass at harvest [kg] | 6 |
| Head Average Area [$cm^2$] | 7 |
| Head Average Length [cm] | 8 |
| Head Average Width [cm] | 9 |
| Head number [num] | 10 |
| Number of days to anthesis [num] | 11 |
| Total dry matter per plot [kg] | 12 |
| Total Grain Yield [gr.] | 13 |

Table 59. Provided are the foxtail millet collected parameters under drought and normal conditions.
"gr" = gram;
"cm" = centimeter;
"num" = number;
"kg" = kilogram.

TABLE 60

Foxtail millet correlated parameters under drought vs. normal conditions (maintenance) (vectors)

| Correlated parameter with | Correlation ID |
|---|---|
| 1000 Seeds weight [gr.], Drought/Normal | 1 |
| Average Grain Area [$cm^2$], Drought/Normal | 2 |
| Average Grain Length [cm], Drought/Normal | 3 |
| Average Grain Perimeter [cm], Drought/Normal | 4 |
| Average Grain Width [cm], Drought/Normal | 5 |
| Biomass at harvest [kg], Drought/Normal | 6 |
| Head Average Area [$cm^2$], Drought/Normal | 7 |
| Head Average Length [cm], Drought/Normal | 8 |
| Head Average Width [cm], Drought/Normal | 9 |
| Head number [num], Drought/Normal | 10 |
| Total dry matter per plot [kg], Drought/Normal | 11 |
| Total Grain Yield [gr.], Drought/Normal | 12 |

Table 60. Provided are the foxtail millet collected parameters under drought vs. normal conditions (maintenance).
"gr." = gram;
"cm" = centimeter;
"num" = number;
"kg" = kilogram.

Experimental Results

Fourteen different foxtail millet accessions were grown and characterized for different parameters as described above (Table 59-60). The average for each of the measured parameter was calculated using the JMP software and values are summarized in Tables 61-72 below. Subsequent correlation analysis between the various transcriptome sets and the average parameters was conducted (Tables 73-77). Follow, results were integrated to the database.

TABLE 61

Measured parameters of correlation IDs in foxtail millet accessions under drought conditions at flowering

| Line/Corr. ID | Line-1 | Line-2 | Line-3 | Line-4 | Line-5 | Line-6 | Line-7 |
|---|---|---|---|---|---|---|---|
| 1 | 2.64 | 3.33 | 2.61 | 2.29 | 2.3 | 2.64 | 2.22 |
| 2 | 0.0333 | 0.0373 | 0.0335 | 0.0319 | 0.0326 | 0.0334 | 0.0297 |
| 3 | 0.242 | 0.244 | 0.25 | 0.254 | 0.257 | 0.25 | 0.233 |
| 4 | 0.683 | 0.722 | 0.689 | 0.683 | 0.69 | 0.692 | 0.648 |
| 5 | 0.175 | 0.194 | 0.171 | 0.16 | 0.162 | 0.17 | 0.163 |
| 6 | 1.53 | 3.46 | 2.87 | 2.93 | 3.02 | 2.66 | 2.98 |
| 7 | 35.7 | 50.7 | 18.4 | 14.9 | 17.7 | 9.9 | 21 |
| 8 | 22.4 | 21.9 | 16.5 | 13.3 | 14 | 9.1 | 15.1 |
| 9 | 1.87 | 2.68 | 1.33 | 1.33 | 1.5 | 1.17 | 1.67 |
| 10 | 374.4 | 127 | 737.8 | 1100.8 | 1047.2 | 2050 | 581.5 |
| 11 | 34 | 41 | 51 | 41 | 41 | 30 | 38 |
| 13 | 1141.5 | 1116.2 | 988.2 | 1202.8 | 1360.5 | 995.2 | 946.8 |
| 12 | 0.504 | 0.733 | 0.798 | 0.616 | 0.708 | 0.47 | 0.608 |

Table 61: Provided are the values of each of the parameters (as described above) measured in Foxtail millet accessions (Line). Growth conditions are specified in the experimental procedure section.
"Corr." = Correlation.

TABLE 62

Additional measured parameters of correlation IDs in foxtail millet accessions under drought conditions at flowering

| Line/Corr. ID | Line-8 | Line-9 | Line-10 | Line-11 | Line-12 | Line-13 | Line-14 |
|---|---|---|---|---|---|---|---|
| 1 | 1.84 | 2.54 | 1.69 | 3.1 | 2.54 | 3.24 | 2.25 |
| 2 | 0.0238 | 0.0317 | 0.0252 | 0.0365 | 0.0321 | 0.0391 | 0.0301 |
| 3 | 0.194 | 0.223 | 0.203 | 0.261 | 0.245 | 0.27 | 0.242 |
| 4 | 0.569 | 0.661 | 0.593 | 0.72 | 0.675 | 0.748 | 0.659 |
| 5 | 0.156 | 0.181 | 0.158 | 0.178 | 0.167 | 0.184 | 0.159 |
| 6 | 0.77 | 2.66 | 2.95 | 3.23 | 3.3 | 2.63 | 0.89 |
| 7 | 39.9 | 42.1 | 43.5 | 26.9 | 21.2 | 7.3 | 13.1 |
| 8 | 21.1 | 20 | 21.8 | 20.8 | 15.8 | 6.4 | 9.2 |
| 9 | 2.15 | 2.36 | 2.32 | 1.54 | 1.59 | 1.25 | 1.74 |
| 10 | 311.6 | 147.2 | 95.4 | 414.4 | 667.8 | 2441 | 687.5 |
| 11 | 30 | 38 | NA | 44 | 51 | 31 | 27 |
| 13 | 1159.8 | 1391.4 | 394.5 | 1199.5 | 872.5 | 873.9 | 1188 |
| 12 | 0.349 | 0.437 | 0.645 | 0.748 | 0.872 | 0.523 | 0.36 |

Table 62: Provided are the values of each of the parameters (as described above) measured in Foxtail millet accessions (Line). Growth conditions are specified in the experimental procedure section.

TABLE 63

Measured parameter of correlation IDs in foxtail millet accessions under drought conditions at grain filling

| Line/Corr. ID | Line-1 | Line-2 | Line-3 | Line-4 | Line-5 | Line-6 | Line-7 |
|---|---|---|---|---|---|---|---|
| 1 | 2.64 | 3.33 | 2.61 | 2.29 | 2.3 | 2.64 | 2.22 |
| 2 | 0.0333 | 0.0373 | 0.0335 | 0.0319 | 0.0326 | 0.0334 | 0.0297 |
| 3 | 0.242 | 0.244 | 0.25 | 0.254 | 0.257 | 0.25 | 0.233 |
| 4 | 0.683 | 0.722 | 0.689 | 0.683 | 0.69 | 0.692 | 0.648 |
| 5 | 0.175 | 0.194 | 0.171 | 0.16 | 0.162 | 0.17 | 0.163 |
| 6 | 1.53 | 3.46 | 2.87 | 2.93 | 3.02 | 2.66 | 2.98 |
| 7 | 35.7 | 50.7 | 18.4 | 14.9 | 17.7 | 9.9 | 21 |
| 8 | 22.4 | 21.9 | 16.5 | 13.3 | 14 | 9.1 | 15.1 |
| 9 | 1.87 | 2.68 | 1.33 | 1.33 | 1.5 | 1.17 | 1.67 |
| 10 | 374.4 | 127 | 737.8 | 1100.8 | 1047. | 2050 | 581.5 |
| 11 | 34 | 41 | 51 | 41 | 41 | 30 | 38 |

TABLE 63-continued

Measured parameter of correlation IDs in foxtail millet accessions under drought conditions at grain filling

| Line/Corr. ID | Line-1 | Line-2 | Line-3 | Line-4 | Line-5 | Line-6 | Line-7 |
|---|---|---|---|---|---|---|---|
| 13 | 1141.5 | 1116.2 | 988.2 | 1202.8 | 1360.5 | 995.2 | 946.8 |
| 12 | 0.504 | 0.733 | 0.798 | 0.616 | 0.708 | 0.47 | 0.608 |

Table 63: Provided are the values of each of the parameters (as described above) measured in Foxtail millet accessions (Line). Growth conditions are specified in the experimental procedure section.

TABLE 64

Additional measured parameters of correlation IDs in foxtail millet accessions under drought conditions at grain filling

| Line/Corr. ID | Line-8 | Line-9 | Line-10 | Line-11 | Line-12 | Line-13 | Line-14 |
|---|---|---|---|---|---|---|---|
| 1 | 1.84 | 2.54 | 1.69 | 3.1 | 2.54 | 3.24 | 2.25 |
| 2 | 0.0238 | 0.0317 | 0.0252 | 0.0365 | 0.0321 | 0.0391 | 0.0301 |
| 3 | 0.194 | 0.223 | 0.203 | 0.261 | 0.245 | 0.27 | 0.242 |
| 4 | 0.569 | 0.661 | 0.593 | 0.72 | 0.675 | 0.748 | 0.659 |
| 5 | 0.156 | 0.181 | 0.158 | 0.178 | 0.167 | 0.184 | 0.159 |
| 6 | 0.77 | 2.66 | 2.95 | 3.23 | 3.3 | 2.63 | 0.89 |
| 7 | 39.9 | 42.1 | 43.5 | 26.9 | 21.2 | 7.3 | 13.1 |
| 8 | 21.1 | 20 | 21.8 | 20.8 | 15.8 | 6.4 | 9.2 |
| 9 | 2.15 | 2.36 | 2.32 | 1.54 | 1.59 | 1.25 | 1.74 |
| 10 | 311.6 | 147.2 | 95.4 | 414.4 | 667.8 | 2441 | 687.5 |
| 11 | 30 | 38 | NA | 44 | 51 | 31 | 27 |
| 13 | 1159.8 | 1391.4 | 394.5 | 1199.5 | 872.5 | 873.9 | 1188 |
| 12 | 0.349 | 0.437 | 0.645 | 0.748 | 0.872 | 0.523 | 0.36 |

Table 64: Provided are the values of each of the parameters (as described above) measured in Foxtail millet accessions (Line). Growth conditions are specified in the experimental procedure section.

TABLE 65

Measured parameters of correlation IDs in foxtail millet accessions for Maintenance of performance under drought conditions at flowering

| Line/Corr. ID | Line-1 | Line-2 | Line-3 | Line-4 | Line-5 | Line-6 | Line-7 |
|---|---|---|---|---|---|---|---|
| 1 | 107.3 | 97.4 | 99.9 | 97.3 | 95.7 | 99.5 | 101.4 |
| 2 | 103.1 | 101.1 | 102.8 | 100.9 | 101.6 | 99.8 | 101.1 |
| 3 | 100.7 | 101.1 | 100.4 | 100.4 | 100.2 | 99.5 | 101 |
| 4 | 101.1 | 100.6 | 101 | 100.3 | 100.6 | 99.4 | 100.9 |
| 5 | 102.3 | 100 | 102.4 | 100.4 | 101.3 | 100.2 | 100.2 |
| 6 | 63.8 | 86.7 | 90.6 | 82 | 84 | 87.2 | 73.6 |
| 7 | 94.5 | 87.6 | 93.9 | 87.4 | 89.5 | 105.3 | 91.6 |
| 8 | 96.7 | 90.2 | 94 | 90 | 91 | 106.4 | 93.9 |
| 9 | 98.2 | 98.3 | 99.9 | 98.4 | 97.9 | 98.8 | 99 |
| 10 | 87.6 | 85.1 | 85.1 | 91.4 | 91.3 | 96.2 | 77.3 |
| 12 | 78.7 | 104.5 | 64.4 | 76.7 | 75.8 | 67.4 | 59.8 |
| 11 | 71.7 | 85.8 | 82.9 | 66.7 | 78.3 | 98 | 66.3 |

Table 65: Provided are the values of each of the parameters (as described above) measured in Foxtail millet accessions (Line). Growth conditions are specified in the experimental procedure section.

TABLE 66

Additional measured parameters of correlation IDs in foxtail millet accessions for Maintenance of performance under drought conditions at flowering

| Line/Corr. ID | Line-8 | Line-9 | Line-10 | Line-11 | Line-12 | Line-13 | Line-14 |
|---|---|---|---|---|---|---|---|
| 1 | 102.2 | 94.5 | 102.7 | 97.6 | 97.8 | 101.7 | 99.5 |
| 2 | 100 | 98.9 | 102.7 | 97.9 | 96.4 | 101.2 | 99.2 |
| 3 | 99.2 | 100.7 | 102 | 99.4 | 97.8 | 100.3 | 99 |
| 4 | 99.6 | 99.8 | 101.8 | 98.9 | 98 | 100.4 | 99.2 |
| 5 | 100.8 | 98.2 | 100.6 | 98.5 | 98.5 | 100.9 | 100.3 |
| 6 | 66.8 | 83.2 | 75.5 | 90.2 | 89.8 | 89.5 | 59.9 |
| 7 | 97.7 | 93.1 | 88.2 | 97.3 | 87.8 | 102.5 | 89.4 |
| 8 | 96.6 | 98.1 | 93.5 | 99.7 | 88.1 | 101.5 | 93.8 |
| 9 | 101.3 | 94.5 | 95.7 | 99.5 | 100.4 | 100.8 | 95.5 |
| 10 | 79 | 78.9 | 72.4 | 95.4 | 103.3 | 87.2 | 69.1 |
| 12 | 88 | 65.3 | 42.1 | 63.8 | 61.1 | 71.9 | 91.6 |
| 11 | 77 | 73.5 | 64.6 | 82 | 85 | 83.9 | 77.8 |

Table 66: Provided are the values of each of the parameters (as described above) measured in Foxtail millet accessions (Line). Growth conditions are specified in the experimental procedure section.

TABLE 67

Measure parameters of correlation IDs in foxtail millet accessions for Maintenance of performance under drought conditions at grain filling

| Line/Corr. ID | Line-1 | Line-2 | Line-3 | Line-4 | Line-5 | Line-6 | Line-7 |
|---|---|---|---|---|---|---|---|
| 1 | 107.3 | 97.4 | 99.9 | 97.3 | 95.7 | 99.5 | 101.4 |
| 2 | 103.1 | 101.1 | 102.8 | 100.9 | 101.6 | 99.8 | 101.1 |
| 3 | 100.7 | 101.1 | 100.4 | 100.4 | 100.2 | 99.5 | 101 |
| 4 | 101.1 | 100.6 | 101 | 100.3 | 100.6 | 99.4 | 100.9 |
| 5 | 102.3 | 100 | 102.4 | 100.4 | 101.3 | 100.2 | 100.2 |
| 6 | 63.8 | 86.7 | 90.6 | 82 | 84 | 87.2 | 73.6 |
| 7 | 94.5 | 87.6 | 93.9 | 87.4 | 89.5 | 105.3 | 91.6 |
| 8 | 96.7 | 90.2 | 94 | 90 | 91 | 106.4 | 93.9 |

TABLE 67-continued

Measure parameters of correlation IDs in foxtail millet accessions for Maintenance of performance under drought conditions at grain filling

| Line/Corr. ID | Line-1 | Line-2 | Line-3 | Line-4 | Line-5 | Line-6 | Line-7 |
|---|---|---|---|---|---|---|---|
| 9 | 98.2 | 98.3 | 99.9 | 98.4 | 97.9 | 98.8 | 99 |
| 10 | 87.6 | 85.1 | 85.1 | 91.4 | 91.3 | 96.2 | 77.3 |
| 12 | 78.7 | 104.5 | 64.4 | 76.7 | 75.8 | 67.4 | 59.8 |
| 11 | 71.7 | 85.8 | 82.9 | 66.7 | 78.3 | 98 | 66.3 |

Table 67: Provided are the values of each of the parameters (as described above) measured in Foxtail millet accessions (Line). Growth conditions are specified in the experimental procedure section.

TABLE 68

Additional measured parameters of correlation IDs in foxtail millet accessions for Maintenance of performance under drought conditions at grain filling

| Line/Corr. ID | Line-8 | Line-9 | Line-10 | Line-11 | Line-12 | Line-13 | Line-14 |
|---|---|---|---|---|---|---|---|
| 1 | 102.2 | 94.5 | 102.7 | 97.6 | 97.8 | 101.7 | 99.5 |
| 2 | 100 | 98.9 | 102.7 | 97.9 | 96.4 | 101.2 | 99.2 |
| 3 | 99.2 | 100.7 | 102 | 99.4 | 97.8 | 100.3 | 99 |
| 4 | 99.6 | 99.8 | 101.8 | 98.9 | 98 | 100.4 | 99.2 |
| 5 | 100.8 | 98.2 | 100.6 | 98.5 | 98.5 | 100.9 | 100.3 |
| 6 | 66.8 | 83.2 | 75.5 | 90.2 | 89.8 | 89.5 | 59.9 |
| 7 | 97.7 | 93.1 | 88.2 | 97.3 | 87.8 | 102.5 | 89.4 |
| 8 | 96.6 | 98.1 | 93.5 | 99.7 | 88.1 | 101.5 | 93.8 |
| 9 | 101.3 | 94.5 | 95.7 | 99.5 | 100.4 | 100.8 | 95.5 |
| 10 | 79 | 78.9 | 72.4 | 95.4 | 103.3 | 87.2 | 69.1 |
| 12 | 88 | 65.3 | 42.1 | 63.8 | 61.1 | 71.9 | 91.6 |
| 11 | 77 | 73.5 | 64.6 | 82 | 85 | 83.9 | 77.8 |

Table 68: Provided are the values of each of the parameters (as described above) measured in Foxtail millet accessions (Line). Growth conditions are specified in the experimental procedure section.

TABLE 69

Measured parameters of correlation IDs in foxtail millet accessions under normal conditions at flowering

| Line/Corr. ID | Line-1 | Line-2 | Line-3 | Line-4 | Line-5 | Line-6 | Line-7 |
|---|---|---|---|---|---|---|---|
| 1 | 2.46 | 3.42 | 2.61 | 2.36 | 2.41 | 2.65 | 2.18 |
| 2 | 0.0323 | 0.0369 | 0.0326 | 0.0316 | 0.0321 | 0.0335 | 0.0294 |
| 3 | 0.24 | 0.242 | 0.249 | 0.253 | 0.256 | 0.252 | 0.231 |
| 4 | 0.675 | 0.717 | 0.682 | 0.681 | 0.686 | 0.697 | 0.642 |
| 5 | 0.172 | 0.194 | 0.167 | 0.159 | 0.16 | 0.17 | 0.162 |
| 6 | 2.4 | 3.99 | 3.17 | 3.58 | 3.6 | 3.06 | 4.04 |
| 7 | 37.8 | 57.9 | 19.6 | 17.1 | 19.8 | 9.4 | 22.9 |
| 8 | 23.1 | 24.2 | 17.6 | 14.8 | 15.4 | 8.6 | 16.1 |
| 9 | 1.91 | 2.72 | 1.33 | 1.36 | 1.53 | 1.18 | 1.68 |
| 10 | 427.6 | 149.2 | 867 | 1204 | 1146.4 | 2132 | 752.2 |
| 11 | 34 | 41 | 45 | 41 | 41 | 30 | 38 |
| 13 | 1449.6 | 1067.9 | 1534.9 | 1567.2 | 1794.8 | 1476.1 | 1582.6 |
| 12 | 0.703 | 0.854 | 0.963 | 0.924 | 0.904 | 0.479 | 0.917 |

Table 69: Provided are the values of each of the parameters (as described above) measured in Foxtail millet accessions (Line). Growth conditions are specified in the experimental procedure section

TABLE 70

Additional measured parameters of correlation IDs in foxtail millet accessions under normal conditions at flowering

| Line/Corr. ID | Line-8 | Line-9 | Line-10 | Line-11 | Line-12 | Line-13 | Line-14 |
|---|---|---|---|---|---|---|---|
| 1 | 1.8 | 2.69 | 1.65 | 3.17 | 2_6 | 3.18 | 2.26 |
| 2 | 0.0239 | 0.032 | 0.0246 | 0.0373 | 0.0333 | 0.0386 | 0.0303 |
| 3 | 0.196 | 0.221 | 0.199 | 0.262 | 0.25 | 0.269 | 0.244 |
| 4 | 0.571 | 0.662 | 0.582 | 0.728 | 0.689 | 0.745 | 0.665 |
| 5 | 0.155 | 0.184 | 0.157 | 0.181 | 0.169 | 0.183 | 0.158 |
| 6 | 1.15 | 3.2 | 3.9 | 3.58 | 3.68 | 2_94 | 1.48 |
| 7 | 40.9 | 45.3 | 49.3 | 27.7 | 24.2 | 7.1 | 14.7 |
| 8 | 21.9 | 20.4 | 23.3 | 20.9 | 18 | 6.4 | 9.8 |
| 9 | 2.12 | 2.5 | 2.43 | 1.55 | 1.58 | 1.24 | 1.82 |
| 10 | 394.2 | 186.6 | 131.8 | 434.2 | 646.4 | 2797.8 | 994.6 |
| 11 | 30 | 38 | 51 | 44 | 51 | 31 | 27 |
| 13 | 1317.9 | 2131.6 | 937.9 | 1880.2 | 1427.1 | 1216.2 | 1296.7 |
| 12 | 0.453 | 0.594 | 0.998 | 0.913 | 1.027 | 0.623 | 0.464 |

Table 70: Provided are the values of each of the parameters (as described above) measured in Foxtail millet accessions (Line). Growth conditions are specified in the experimental procedure section.

TABLE 71

Measured parameters of correlation IDs in foxtail millet accessions under normal conditions grain filling

| Line/Corr. ID | Line-1 | Line-2 | Line-3 | Line-4 | Line-5 | Line-6 | Line-7 |
|---|---|---|---|---|---|---|---|
| 1 | 2.46 | 3.42 | 2.61 | 2.36 | 2.41 | 2.65 | 2.18 |
| 2 | 0.0323 | 0.0369 | 0.0326 | 0.0316 | 0.0321 | 0.0335 | 0.0294 |
| 3 | 0.24 | 0.242 | 0.249 | 0.253 | 0.256 | 0.252 | 0.231 |
| 4 | 0.675 | 0.717 | 0.682 | 0.681 | 0.686 | 0.697 | 0.642 |
| 5 | 0.172 | 0.194 | 0.167 | 0.159 | 0.16 | 0.17 | 0.162 |
| 6 | 2.4 | 3.99 | 3.17 | 3.58 | 3.6 | 3.06 | 4.04 |
| 7 | 37.8 | 57.9 | 19.6 | 17.1 | 19.8 | 9.4 | 22.9 |
| 8 | 23.1 | 24.2 | 17.6 | 14.8 | 15.4 | 8.6 | 16.1 |
| 9 | 1.91 | 2.72 | 1.33 | 1.36 | 1.53 | 1.18 | 1.68 |
| 10 | 427.6 | 149.2 | 867 | 1204 | 1146.4 | 2132 | 752.2 |
| 11 | 34 | 41 | 45 | 41 | 41 | 30 | 38 |
| 13 | 1449.6 | 1067.9 | 1534.9 | 1567.2 | 1794.8 | 1476.1 | 1582.6 |
| 12 | 0.703 | 0.854 | 0.963 | 0.924 | 0.904 | 0.479 | 0.917 |

Table 71: Provided are the values of each of the parameters (as described above) measured in Foxtail millet accessions (Line). Growth conditions are specified in the experimental procedure section

TABLE 72

Additional measured parameters of correlation IDs in foxtail millet accessions under normal conditions at grain filling

| Line/Corr. ID | Line-8 | Line-9 | Line-10 | Line-11 | Line-12 | Line-13 | Line-14 |
|---|---|---|---|---|---|---|---|
| 1 | 1.8 | 2.69 | 1.65 | 3.17 | 2.6 | 3.18 | 2.26 |
| 2 | 0.0239 | 0.032 | 0.0246 | 0.0373 | 0.0333 | 0.0386 | 0.0303 |
| 3 | 0.196 | 0.221 | 0.199 | 0.262 | 0.25 | 0.269 | 0.244 |
| 4 | 0.571 | 0.662 | 0.582 | 0.728 | 0.689 | 0.745 | 0.665 |
| 5 | 0.155 | 0.184 | 0.157 | 0.181 | 0.169 | 0.183 | 0.158 |
| 6 | 1.15 | 3.2 | 3.9 | 3.58 | 3.68 | 2.94 | 1.48 |
| 7 | 40.9 | 45.3 | 49.3 | 27.7 | 24.2 | 7.1 | 14.7 |
| 8 | 21.9 | 20.4 | 23.3 | 20.9 | 18 | 6.4 | 9.8 |
| 9 | 2.12 | 2.5 | 2.43 | 1.55 | 1.58 | 1.24 | 1.82 |
| 10 | 394.2 | 186.6 | 131.8 | 434.2 | 646.4 | 2797.8 | 994.6 |
| 11 | 30 | 38 | 51 | 44 | 51 | 31 | 27 |
| 13 | 1317.9 | 2131.6 | 937.9 | 1880.2 | 1427.1 | 1216.2 | 1296.7 |
| 12 | 0.453 | 0.594 | 0.998 | 0.913 | 1.027 | 0.623 | 0.464 |

Table 72: Provided are the values of each of the parameters (as described above) measured in Foxtail millet accessions (Line). Growth conditions are specified in the experimental procedure section.

TABLE 73

Correlation between the expression level of selected genes of some embodiments of the invention in various tissues and the phenotypic performance under drought conditions at flowering stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LGB4 | 0.72 | 2.79E−02 | 3 | 4 | LGB4 | 0.73 | 2.62E−02 | 3 | 2 |

Table 73. Provided are the correlations (R) between the genes expression levels in various tissues and the phenotypic performance.
"Corr. Set ID"—correlation set ID according to the correlated parameters specified in Table 59.
"Exp. Set"—Expression set specified in Table 55.
"R" = Pearson correlation coefficient;
"P" = p value.

TABLE 74

Correlation between the expression level of selected genes of some embodiments of the invention in various tissues and the phenotypic performance under normal conditions at flowering stage across foxtail millet varieties

| Gene Name | R | P value | Exp. set | Corr. Set ID |
|---|---|---|---|---|
| LGB2 | 0.75 | 1.27E−02 | 2 | 13 |

Table 74. Provided are the correlations (R) between the genes expression levels in various tissues and the phenotypic performance.
"Corr. Set ID"—correlation set ID according to the correlated parameters specified in Table 59.
"Exp. Set"—Expression set specified in Table 57.
"R" = Pearson correlation coefficient;
"P" = p value.

TABLE 75

Correlation between the expression level of selected genes of some embodiments of the invention in various tissues and the phenotypic performance under normal conditions at grain filling stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LGB2 | 0.74 | 3.78E−02 | 3 | 13 | LGB2 | 0.82 | 4.56E−02 | 1 | 8 |
| LGB4 | 0.91 | 1.29E−02 | 1 | 10 | LGB4 | 0.85 | 3.37E−02 | 1 | 3 |
| LGB5 | 0.95 | 3.09E−03 | 1 | 8 | LGB5 | 0.78 | 6.98E−02 | 1 | 7 |

Table 75. Provided are the correlations (R) between the genes expression levels in various tissues and the phenotypic performance.
"Corr. Set ID"—correlation set ID according to the correlated parameters specified in Table 59.
"Exp. Set"—Expression set specified in Table 58.
"R" = Pearson correlation coefficient;
"P" = p value.

TABLE 76

Correlation between the expression level of selected genes of some embodiments of the invention in various tissues and the phenotypic performance of maintenance of performance under drought vs. normal conditions at flowering stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LGB2 | 0.74 | 9.51E−03 | 2 | 1 | LGB4 | 0.78 | 7.25E−03 | 1 | 7 |
| LGB4 | 0.73 | 1.56E−02 | 1 | 8 | LGB5 | 0.83 | 5.65E−03 | 3 | 1 |

Table 76. Provided are the correlations (R) between the genes expression levels in various tissues and the phenotypic performance.
"Corr. Set ID"—ccorrelation set ID according to the correlated parameters specified in Table 60.
"Exp. Set"—Expression set specified in Table 55.
"R" = Pearson correlation coefficient;
"P" = p value.

TABLE 77

Correlation between the expression level of selected genes of some embodiments of the invention in various tissues and the phenotypic perfirmance of maintenance of performance under drought vs. normal conditions at grain filling stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LGB2 | 0.77 | 7.51E−02 | 1 | 1 | LGB2 | 0.75 | 8.54E−02 | 1 | 5 |
| LGB2 | 0.72 | 1.80E−02 | 2 | 2 | LGB2 | 0.71 | 2.25E−02 | 2 | 4 |
| LGB2 | 0.81 | 4.34E−03 | 3 | 12 | LGB4 | 0.79 | 6.17E−03 | 2 | 5 |
| LGB4 | 0.78 | 7.84E−03 | 3 | 1 | LGB5 | 0.79 | 6.05E−02 | 1 | 1 |
| LGB5 | 0.75 | 8.36E−02 | 1 | 2 | LGB5 | 0.74 | 8.94E−02 | 1 | 5 |
| LGB5 | 0.81 | 4.83E−03 | 2 | 1 | | | | | |

Table 77. Provided are the correlations (R) between the genes expression levels in various tissues and the phenotypic performance.
"Corr. Set ID"—correlation set ID according to the correlated parameters specified in Table 60.
"Exp. Set"—Expression set specified in Table 56.
"R" = Pearson correlation coefficient;
"P" = p value.

Example 8

Production of Barley Transcriptome and High Throughput Correlation Analysis Using 44K Barley Oligonucleotide Micro-Array In order to produce a high throughput correlation analysis comparing between plant phenotype and gene expression level under normal conditions, the present inventors utilized a Barley oligonucleotide micro-array, produced by Agilent Technologies [chem(dot)agilent(dot)com/Scripts/PDS(dot)asp?1Page=50879]. The array oligonucleotide represents about 44,000 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [davidmlane (dot)com/hyperstat/A34739(dot)html].

Experimental Procedures

Analyzed Barley tissues—Four tissues at different developmental stages [meristem, flowering spike, booting spike, stem], representing different plant characteristics, were sampled and RNA was extracted as described above. Each micro-array expression information tissue type has received a Set ID as summarized in Table 78 below.

TABLE 78

Barley transcriptome expression sets

| Expression Set | Set ID |
| --- | --- |
| Booting spike at flowering stage under normal conditions | 1 |
| Flowering spike at flowering stage under normal conditions | 2 |
| Meristem at flowering stage under normal conditions | 3 |
| Stem at flowering stage under normal conditions | 4 |

Table 78. Provided are the Barley transcriptome expression sets.

Barley yield components and vigor related parameters assessment—25 Barley accessions in 4 repetitive blocks (named A, B, C, and D), each containing 4 plants per plot were grown at net house. Plants were phenotyped on a daily basis following the standard descriptor of barley (Table 79, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 [Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

TABLE 79

Barley standard descriptors

| Trait | Parameter | Range | Description |
| --- | --- | --- | --- |
| Growth habit | Scoring | 1-9 | Prostrate (1) or Erect (9) |
| Hairiness of basal leaves | Scoring | P (Presence)/A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 79

Grains per spike—At the end of the experiment (50% of the spikes were dry) all spikes from plots within blocks A-D were collected. The total number of grains from 5 spikes that were manually threshed was counted. The average grain per spike is calculated by dividing the total grain number by the number of spikes.

Grain average size (cm)—At the end of the experiment (50% of the spikes were dry) all spikes from plots within blocks A-D were collected. The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

Grain average weight (mgr)—At the end of the experiment (50% of the spikes were dry) all spikes from plots within blocks A-D were collected. The total grains from 5 spikes that were manually threshed were counted and weight. The average weight was calculated by dividing the total weight by the total grain number. "Mgr"=milligrams.

Grain yield per spike (gr.)—At the end of the experiment (50% of the spikes were dry) all spikes from plots within blocks A-D were collected. The total grains from 5 spikes that were manually threshed were weight. The grain yield was calculated by dividing the total weight by the spike number.

Spike length analysis—At the end of the experiment (50% of the spikes were dry) all spikes from plots within blocks A-D were collected. The five chosen spikes per plant were measured using measuring tape excluding the awns.

Spike number analysis—At the end of the experiment (50% of the spikes were dry) all spikes from plots within blocks A-D were collected. The spikes per plant were counted.

Growth habit scoring—At the growth stage 10 (booting), each of the plants was scored for its growth habit nature. The scale that was used was "1" for prostate nature till "9" for erect.

Hairiness of basal leaves—At the growth stage 5 (leaf sheath strongly erect; end of tillering), each of the plants was scored for its hairiness nature of the leaf before the last. The scale that was used was "1" for prostate nature till "9" for erect.

Plant height—At the harvest stage (50% of spikes were dry) each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At the growth stage 10 (booting), each of the plants was scored for its stem color. The scale that was used was "1" for green till "5" for full purple.

Vegetative dry weight and spike yield—At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours.

Spike yield per plant=total spike weight per plant (gr.) after drying at 30° C. in oven for 48 hours.

Harvest Index (for barley)—The harvest index is calculated using Formula XVIII (above).

Data parameters collected are summarized in Table 80, herein below Table 80

TABLE 80

Barley correlated parameters (vectors)

| Correlated parameter with | Correlation ID |
|---|---|
| Days to flowering [days], under Normal growth conditions | 1 |
| Grain average size [cm], under Normal growth conditions | 2 |
| Grain average weight [mg], under Normal growth conditions | 3 |
| Grains per spike [num], under Normal growth conditions | 4 |
| Grain yield per spike [gr], under Normal growth conditions | 5 |
| Growth habit scoring [num], under Normal growth conditions | 6 |
| Hairiness of basal leaves [num], under Normal growth conditions | 7 |
| Plant height [cm], under Normal growth conditions | 8 |
| Spike length analysis [cm], under Normal growth conditions | 9 |
| Spike number analysis [num], under Normal growth conditions | 10 |
| Stem pigmentation | 11 |
| Vegetative DW [gr.], under Normal growth conditions | 12 |

Table 80. Provided are the barley correlated parameters.
"gr." = Grams;
"cm" = centimeters;
"mg" = milligrams;
"num" = number;
"DW" = dry weight.

Experimental Results 13 different Barley accessions were grown and characterized for parameters as described above. The average for each of the measured parameters was calculated using the JMP software and values are summarized in Table 81 below. Subsequent correlation analysis between the various transcriptome sets and the measured parameters was conducted (Table 88). Follow, results were integrated to the database.

TABLE 81

Measured parameters of correlation IDs in Barley accessions

| Line/Corr. ID | Line-1 | Line-2 | Line-3 | Line-4 | Line-5 | Line-6 | Line-7 |
|---|---|---|---|---|---|---|---|
| 1 | 62.4 | 64.1 | 65.2 | 58.9 | 63 | 70.5 | 52.8 |
| 2 | 0.265 | 0.229 | 0.244 | 0.166 | 0.295 | 0.275 | 0.22 |
| 3 | 35 | 28.1 | 28.8 | 17.9 | 41.2 | 29.7 | 25.2 |
| 5 | 3.56 | 2.54 | 2.58 | 1.57 | 3.03 | 2.52 | 1.55 |
| 4 | 20.2 | 18 | 17.3 | 17.7 | 14.5 | 16.8 | 12.1 |
| 6 | 2.6 | 2 | 1.92 | 3.17 | 4.33 | 2.69 | 3.6 |
| 7 | 1.53 | 1.33 | 1.69 | 1.08 | 1.42 | 1.69 | 1.3 |
| 8 | 134.3 | 130.5 | 138.8 | 114.6 | 127.8 | 129.4 | 103.9 |
| 9 | 12 | 10.9 | 11.8 | 9.9 | 11.7 | 11.5 | 8.9 |
| 10 | 48.8 | 48.3 | 37.4 | 61.9 | 33.3 | 41.7 | 40 |
| 11 | 1.13 | 2.5 | 1.69 | 1.75 | 2.33 | 2.31 | 1.7 |
| 12 | 78.9 | 66.1 | 68.5 | 53.4 | 68.3 | 74.2 | 35.4 |

Table 81. Provided are the values of each of the parameters (as described above) measured in Barley accessions (line). Growth conditions are specified in the experimental procedure section.
"Corr." = correlation.

TABLE 82

Measured parameters of correlation IDs in Barley accessions

| Line/Corr. ID | Line-8 | Line-9 | Line-10 | Line-11 | Line-12 | Line-13 |
|---|---|---|---|---|---|---|
| 1 | 60.9 | 58.1 | 53 | 60A | 64.6 | 56 |
| 2 | 0.278 | 0.187 | 0.224 | 0.273 | 0.271 | 0.178 |
| 3 | 35 | 20.6 | 27.5 | 37.1 | 29.6 | 19.6 |
| 5 | 2.62 | 2.3 | 1.68 | 2.68 | 2.35 | 1.67 |
| 4 | 14.1 | 21.5 | 12.1 | 13.4 | 15.3 | 17.1 |
| 6 | 3.5 | 3 | 3.67 | 2.47 | 3.5 | 3 |
| 7 | 1.19 | 1 | 1.17 | 1.6 | 1.08 | 1.17 |
| 8 | 121.6 | 126.8 | 99.8 | 121.4 | 118.4 | 117.2 |
| 9 | 11.2 | 11.1 | 8.6 | 10.2 | 10.5 | 9.8 |
| 10 | 40.6 | 62 | 49.3 | 50.6 | 43.1 | 51.4 |
| 11 | 2.19 | 2.3 | 1.83 | 3.07 | 1.58 | 2.17 |
| 12 | 58.3 | 62.2 | 38.3 | 68.3 | 56.1 | 42.7 |

Table 82. Provided are the values of each of the parameters (as described above) measured in Barley accessions (line). Growth conditions are specified in the experimental procedure section.
"Corr." = correlation.

TABLE 83

Correlation between the expression level of selected genes of some embodiments of the invention in various tissues and the phenotypic performance under normal fertilization conditions across barley accessions

| Gene Name | R | P value | Exp. set | Corr. Set ID | Gene Name | R | P value | Exp. set | Corr. Set ID |
|---|---|---|---|---|---|---|---|---|---|
| LGA1 | 0.77 | 8.85E−03 | 2 | 6 | LGA1 | 0.77 | 5.58E−03 | 3 | 10 |

Table 83. Provided are the correlations (R) between the genes expression levels in various tissues and the phenotypic performance.
"Corr. Set ID"—correlation set ID according to the correlated parameters specified in Table 80.
"Exp. Set"—Expression set specified in Table 78.
"R" = Pearson correlation coefficient;
"P" = p value.

Example 9

Production of Barley Transcriptome and High Throughput Correlation Analysis Using 60 K Barley Oligonucleotide Micro-Array In order to produce a high throughput correlation analysis comparing between plant phenotype and gene expression level, the present inventors utilized a Barley oligonucleotide micro-array, produced by Agilent Technologies [(dot)chem(dot)agilent(dot)com/Scripts/PDS(dot)asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

Analyzed Barley tissues—Six tissues stages [leaf, meristem, root tip, adventitious (Adv.) root, spike, stem] at different developmental stages [vegetative (V), reproductive], representing different plant characteristics, were sampled and RNA was extracted as described above. Each micro-array expression information tissue type has received a Set ID as summarized in Tables 84-86 below.

TABLE 84

Barley transcriptome expression sets under drought and recovery conditions

| Expression Set | Set ID |
|---|---|
| Booting spike at reproductive under drought growth conditions | 1 |
| Leaf at reproductive under drought growth conditions | 2 |
| Leaf at vegetative stage under drought growth conditions | 3 |
| Meristems at vegetative stage under drought growth conditions | 4 |
| Root tip at vegetative stage under drought growth conditions | 5 |
| Root tip at vegetative stage under drought recovery growth conditions | 6 |

Table 84. Provided are the barley transcriptome expression sets under drought and recovery conditions.

TABLE 85

Barley transcriptome expression sets under normal and low nitrogen conditions (set 1)

| Expression Set | Set ID |
|---|---|
| Adventitious roots under low nitrogen conditions | 1 |
| Adventitious roots under normal conditions | 2 |
| Leaf under low nitrogen conditions | 3 |
| Leaf under normal conditions | 4 |
| Root tip under low nitrogen conditions | 5 |
| Root tip under normal conditions | 6 |

Table 85. Provided are the barley transcriptome expression sets under normal and low nitrogen conditions (set 1 - vegetative stage).

TABLE 86

Barley transcriptome expression sets under normal and low nitrogen conditions (set 2)

| Expression Set | Set ID |
|---|---|
| Booting spike at reproductive stage under low Nitrogen growth conditions | 1 |
| Booting spike at reproductive stage under Normal growth conditions | 2 |
| Leaf at reproductive/stage under low Nitrogen growth conditions | 3 |
| Leaf at reproductive/stage under Normal growth conditions | 4 |
| Stem at reproductive stage under low Nitrogen growth conditions | 5 |
| Stem at reproductive stage under normal growth conditions | 6 |

Table 86. Provided are the barley transcriptome expression sets under normal and low nitrogen conditions (set 2 - reproductive stage).

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting (as recommended for commercial growth, normal growth conditions which included irrigation 2-3 times a week, and fertilization given in the first 1.5 months of the growth period); under low Nitrogen (80% percent less Nitrogen); or under drought stress (cycles of drought and re-irrigating were conducted throughout the whole experiment, overall 40% less water were given in the drought treatment). Plants were phenotyped on a daily basis following the parameters listed in Tables 87-89 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Spikelet per spike=number of spikelets per spike was counted.

Root/Shoot Ratio—The Root/Shoot Ratio is calculated using Formula XXII (above).

Total No. of tillers—all tillers were counted per plot at two time points at the Vegetative growth (30 days after sowing) and at harvest.

Percent of reproductive tillers—was calculated based on Formula XXVI (above).

SPAD [SPAD unit]—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area (cm$^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—was calculated based on Formula I.

Harvest Index (for barley)—The harvest index is calculated using Formula XVIII (above).

Relative growth rate: the relative growth rates (RGR) of Plant Height, SPAD and number of tillers were calculated based on Formulas III, IV and V respectively.

RATIO Drought/Normal: Represent ratio for the specified parameter of Drought condition results divided by Normal conditions results (maintenance of phenotype under drought in comparison to normal conditions).

Data parameters collected are summarized in Table 87-89, hereinbelow

TABLE 87

Barley correlated parameters (vectors) under drought or drought recovery conditions

| Correlated parameter with | Correlation ID |
|---|---|
| Grain yield [gr.] | 1 |
| Harvest index | 2 |
| Heading date [days] | 3 |
| No. of lateral roots [num] | 4 |
| Plant height TP1 [cm] | 5 |
| Plant height TP2 [cm] | 6 |
| Relative water content [%] | 7 |
| RGR of Plant Height [cm/day] | 8 |
| RGR of SPAD [SPAD unit/day] | 9 |
| RGR of Tillers [tiller/day] | 10 |
| Root FW [gr.] | 11 |
| Root length [cm] | 12 |
| Shoot FW [gr.] | 13 |
| Spike length [cm] | 14 |
| Spike number [num] | 15 |
| Spike weight [gr.] | 16 |
| Spike width [cm] | 17 |
| Total No. of tillers TP1 [num] | 18 |
| Total No. of tillers TP2 [num] | 19 |

Table 87. Provided are the barley correlated parameters.
"DW" = dry weight;
"gr = gram;
"num" = number;
"cm" = centimeter;
"RGR" = relative growth rate;
"TP" = time point.

TABLE 88

Barley correlated parameters (vectors) under low nitrogen and normal growth conditions (set 1)

| Correlated parameter with | Correlation ID |
|---|---|
| Grain yield [gr.], Normal | 1 |
| Grain yield [gr.], Low N | 2 |
| No. of lateral roots [num], Normal | 3 |
| No. of lateral roots [num], Low N | 4 |
| Plant height TP1 [cm], Normal | 5 |
| Plant height TP1 [cm], Low N | 6 |
| Plant height TP2 [cm], Normal | 7 |
| Plant height TP2 [cm], Low N | 8 |
| Root FW [gr.], Normal | 9 |
| Root FW [gr.], Low N | 10 |
| Root length [cm], Normal | 11 |
| Root length [cm], Low N | 12 |
| Shoot FW [gr.], Normal | 13 |
| Shoot FW [gr.], Low N | 14 |
| SPAD [SPAD unit], Normal | 15 |
| SPAD [SPAD unit], Low N | 16 |

TABLE 88-continued

Barley correlated parameters (vectors) under low nitrogen and normal growth conditions (set 1)

| Correlated parameter with | Correlation ID |
|---|---|
| Spike length [cm], Normal | 17 |
| Spike length [cm], Low N | 18 |
| Spike number [num], Normal | 19 |
| Spike number [num], Low N | 20 |
| Spike weight [gr.], Normal | 21 |
| Spike weight [gr.], Low N | 27 |
| Spike width [cm], Normal | 23 |
| Spike width [cm], Low N | 24 |
| Total No. of tillers [num], Normal | 25 |
| Total No. of tillers [num], Low N | 26 |

Table 88. Provided are the barley correlated parameters.
"TP" = time point;
"DW" = dry weight;
"FW" = fresh weight;
"Low N" = Low Nitrogen growth conditions;
"Normal" = regular growth conditions.
"Max" = maximum;
"gr." = gram;
"num" = number;
"cm" = centimeter.

TABLE 89

Barley correlated parameters (vectors) under low nitrogen or normal conditions (set 2)

| Correlated parameter with | Corr. ID |
|---|---|
| Average Grain Area (H) [cm$^2$] | 1 |
| Grain yield per plant (reproductive) [gr.] | 2 |
| Grain yield per plot (reproductive) [gr.] | 3 |
| Percent of reproductive tillers [%] | 4 |
| Plant height (reproductive) TP2 [cm] | 5 |
| Total No. of tillers TP2 (H) [num] | 6 |

Table 89. Provided are the barley correlated parameters.
"TP" = time point;
"DW" = dry weight;
"FW" = fresh weight;
"Low N" = Low Nitrogen growth conditions;
"Normal" = regular growth conditions.
"Max" = maximum;
"gr." = gram;
"H" = harvest;
"cm" = centimeter;
"nun" = number.

Experimental Results 15 different Barley accessions were grown and characterized for different parameters as described above. Tables 87-89 describe the Barley correlated parameters. The average for each of the measured parameters was calculated using the JMP software and values are summarized in 90-98 below. Subsequent correlation analysis between the various transcriptome sets and the average parameters (Tables 99-101) was conducted. Follow, results were integrated to the database.

TABLE 90

Measured parameters correlation IDs in Barley accessions under drought and recovery conditions

| | Line | | | | |
|---|---|---|---|---|---|
| Corr. ID | Line-1 | Line-2 | Line-3 | Line-4 | Line-5 |
| 1 | 5.55 | 9.8 | 3.55 | 7.2 | 5.28 |
| 2 | 0.474 | 0.66 | 0.526 | 0.687 | 0.526 |
| 3 | 75 | 71 | 65 | | 66.8 |

TABLE 90-continued

Measured parameters correlation IDs in Barley accessions under drought and recovery conditions

| | Line | | | | |
|---|---|---|---|---|---|
| Corr. ID | Line-1 | Line-2 | Line-3 | Line-4 | Line-5 |
| 4 | 8.33 | 8.67 | 7.33 | 7.67 | 6.67 |
| 5 | 33.3 | 27 | 31.3 | 34.2 | 31.3 |
| 6 | 46 | 52.8 | 35 | 38 | 45.2 |
| 8 | 0.273 | 0.856 | 0.733 | 0.881 | 0.401 |
| 9 | 0.087 | −0.123 | 0.001 | 0.01 | 0.037 |
| 10 | 0.07 | 0.097 | 0.059 | 0.071 | 0.164 |
| 7 | 80.6 | 53.4 | 55.9 | | 43.2 |
| 11 | 2.07 | 1.48 | 1.12 | 1.87 | 1.67 |
| 12 | 21.7 | 20.3 | 22 | 24 | 20.7 |
| 13 | 1.9 | 1.52 | 1.17 | 1.95 | 1.9 |
| 14 | 16.7 | 16.8 | 13.3 | 13.5 | 14.2 |
| 15 | 4.2 | 4.36 | 7.6 | 8.44 | 4.92 |
| 16 | 17.7 | 24.2 | 18.2 | 18 | 19.5 |
| 17 | 8.64 | 9.07 | 7.82 | 7.32 | 8.74 |
| 18 | 2 | 2 | 1.67 | 1.67 | 2 |
| 19 | 11.7 | 9 | 10.9 | 10.2 | 10.3 |

Table 90. Provided are the values of each of the parameters (as described above in Table 87) measured in Barley accessions (line) under drought growth conditions. Growth conditions are specified in the experimental procedure section.

TABLE 91

Additional measured parameters of correlation IDs in Barley accessions under drought and recovery conditions

| | Line | | | | |
|---|---|---|---|---|---|
| Corr. ID | Line-6 | Line-7 | Line-8 | Line-9 | Line-10 |
| 1 | 7.75 | 9.92 | 10.25 | 8.5 | 14.03 |
| 2 | 0.686 | 0.687 | 0.752 | 0.6 | 0.809 |
| 3 | 90 | 90 | | 90 | |
| 4 | 6.67 | 7.67 | 6.67 | 6 | 8.67 |
| 5 | 30.3 | 28.7 | 38.7 | 33.7 | 28.4 |
| 6 | 48 | 37.7 | 41.2 | 40.8 | 49.9 |
| 8 | 0.939 | 0.699 | 0.713 | 0.774 | 0.8 |
| 9 | −0.072 | 0.013 | 0.003 | −0.063 | 0.035 |
| 10 | 0.061 | 0.104 | 0.049 | 0.1 | 0.061 |
| 7 | 69.8 | 45.5 | 76.5 | 87.4 | |
| 11 | 1.68 | 1.62 | 0.85 | 1.45 | 1.38 |
| 12 | 18.3 | 21 | 20.3 | 21.7 | 19.7 |
| 13 | 1.22 | 1.75 | 1.58 | 1.88 | 1.73 |
| 14 | 15.6 | 15.7 | 17.5 | 16 | 18.3 |
| 15 | 3.43 | 6.9 | 5.8 | 8.55 | 9.67 |
| 16 | 15 | 23.4 | 28.2 | 22 | 33 |
| 17 | 7.62 | 6.98 | 8.05 | 6.06 | 6.72 |
| 18 | 1.67 | 2.33 | 1 | 2.33 | 3 |
| 19 | 8.8 | 13 | 7.4 | 13.9 | 11 |

Table 91. Provided are the values of each of the parameters (as described above in Table 87) measured in Barley accessions (line) under drought growth conditions. Growth conditions are specified in the experimental procedure section.

TABLE 92

Additional measured parameters of correlation IDs in Barley accessions under drought and recovery conditions

| | Line | | | | |
|---|---|---|---|---|---|
| Corr. ID | Line-11 | Line-12 | Line-13 | Line-14 | Line-15 |
| 1 | 17.52 | 2.05 | 5.38 | 11 | 2.56 |
| 2 | 0.869 | 0.286 | 0.439 | 0.78 | 0.406 |
| 3 | | 90 | 81.6 | 90 | |
| 4 | 7.67 | 6.33 | 7 | 7 | 6.67 |
| 5 | 27.5 | 25 | 27 | 31 | 22.3 |
| 6 | 43 | 47.4 | 64.8 | 52.6 | 32 |
| 8 | 0.915 | 0.388 | 0.884 | −0.13 | 0.198 |
| 9 | 0.05 | −0.004 | −0.072 | 0.025 | −0.063 |
| 10 | 0.063 | 0.183 | 0.149 | 0.022 | 0.442 |

TABLE 92-continued

Additional measured parameters of correlation IDs in Barley accessions under drought and recovery conditions

| Corr. ID | Line-11 | Line-12 | Line-13 | Line-14 | Line-15 |
|---|---|---|---|---|---|
| 7 |  | 58.3 | 80.6 | 73.1 |  |
| 11 | 0.82 | 0.58 | 0.63 | 1.07 | 0.7 |
| 12 | 16.7 | 17 | 15.2 | 27 | 15 |
| 13 | 1 | 0.9 | 0.9 | 1.43 | 0.83 |
| 14 | 17.4 | 14.2 | 14.8 | 16.5 | 12.7 |
| 15 | 5.42 | 3.05 | 4.07 | 3.72 | 3.21 |
| 16 | 34.8 | 11.7 | 18.8 | 21 | 9.9 |
| 17 | 9.55 | 7.84 | 7.81 | 8.35 | 5.47 |
| 18 | 1 | 1 | 1 | 1 | 1 |
| 19 | 6.8 | 8.4 | 9.2 | 5.1 | 16.1 |

Table 92. Provided are the values of each of the parameters (as described above in Table 87) measured in Barley accessions (line) under drought growth conditions. Growth conditions are specified in the experimental procedure section.

TABLE 93

Measured parameters of correlation IDs in Barley accessions under low nitrogen and normal conditions (set 1)

| Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 2 | 9.76 | 7.31 | 3.3 | 5.06 | 6.02 | 9.74 | 7.35 | 5.8 | 7.83 | 6.29 |
| 1 | 46.4 | 19.8 | 10.8 | 22.6 | 30.3 | 54.1 | 37 | 42 | 35.4 | 38.3 |
| 4 | 5 | 6 | 4.33 | 6 | 6.33 | 6 | 6.67 | 4.67 | 5.67 | 7.33 |
| 6 | 41 | 82 | 61.4 | 59.4 | 65.8 | 47.8 | 53.8 | 56.4 | 81.8 | 44.6 |
| 8 | 16.3 | 18.8 | 17.3 | 26 | 22.5 | 18.2 | 19.7 | 19.8 | 19.2 | 19.2 |
| 10 | 0.383 | 0.233 | 0.117 | 0.4 | 0.883 | 0.5 | 0.433 | 0.317 | 0.3 | 0.55 |
| 12 | 24.7 | 21.7 | 22 | 21.7 | 22.2 | 23 | 30.5 | 22.8 | 23.8 | 24.5 |
| 16 | 24 | 23.3 | 26.5 | 23.9 | 26.6 | 23.2 | 25.4 | 24.2 | 25 | 26.1 |
| 14 | 0.433 | 0.433 | 0.333 | 0.583 | 0.783 | 0.533 | 0.45 | 0.433 | 0.5 | 0.617 |
| 18 | 15.2 | 19.6 | 16.3 | 19.3 | 90.2 | 16.4 | 20.4 | 18.8 | 18.8 | 16.6 |
| 20 | 12.2 | 9 | 11.6 | 25 | 7.8 | 14.5 | 15 | 7 | 5.4 | 8.4 |
| 22 | 13.7 | 13.4 | 9.2 | 11.6 | 11.3 | 15.1 | 12.2 | 10.9 | 12.2 | 10.6 |
| 24 | 7.95 | 8.13 | 9.43 | 4.94 | 9.6 | 7.16 | 7.06 | 8.51 | 10.01 | 9.4 |
| 26 | 16.2 | 14.6 | 16 | 20.8 | 12.5 | 18.8 | 21.2 | 11 | 6.8 | 14 |

Table 93. Provided are the values of each of the parameters (as described above in Table 88) measured in Barley accessions (line) under low N and normal growth conditions. Growth conditions are specified in the experimental procedure section.

TABLE 94

Measured parameters of correlation IDs in Barley accessions under normal conditions (set 1)

| Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 3 | 7 | 8.67 | 8.33 | 9.67 | 10.7 | 9.67 | 9.67 | 8.67 | 10 | 9.67 |
| 5 | 39.2 | 37 | 36.8 | 49.8 | 46.8 | 34.8 | 43.2 | 35.7 | 46.2 | 40.2 |
| 7 | 64.7 | 84 | 67.4 | 82 | 72 | 56.6 | 65.8 | 62.8 | 91.6 | 66.2 |
| 9 | 0.267 | 0.267 | 0.25 | 0.35 | 0.617 | 0.267 | 0.35 | 0.317 | 0.233 | 0.267 |
| 11 | 21.3 | 15 | 21.8 | 20.3 | 27.2 | 16 | 24 | 13.5 | 21.5 | 15.2 |
| 15 | 39.1 | 41.4 | 35.2 | 33.7 | 34.2 | 42.8 | 37 | 36.9 | 35 | 36.8 |
| 13 | 2.17 | 1.9 | 1.25 | 3 | 15.6 | 3.02 | 2.58 | 1.75 | 2.18 | 1.82 |
| 17 | 16.5 | 19.2 | 18.3 | 20.4 | 17.2 | 19.1 | 20.3 | 21.7 | 16.5 | 16.1 |
| 19 | 41.5 | 32 | 36 | 71.4 | 34.2 | 45.6 | 49.8 | 28 | 19.3 | 38 |
| 21 | 69.4 | 39.4 | 34.9 | 50.3 | 60.8 | 79.1 | 62.7 | 60 | 55.9 | 59.7 |
| 23 | 9.54 | 9.05 | 8.25 | 6.55 | 10.5 | 8.83 | 7.38 | 10.4 | 10.2 | 10.3 |
| 25 | 46.7 | 41.6 | 40 | 48.8 | 34.6 | 48.6 | 49.2 | 29 | 27.5 | 38.8 |

Table 94. Provided are the values of each of the parameters (as described above in Table 88) measured in Barley accessions (line) under normal growth conditions. Growth conditions are specified in the experimental procedure section.

TABLE 95

Measured parameters of correlation IDs in Barley accessions under normal conditions (set 2)

| Corr. ID | Line-1 | Line-2 | Line-3 | Line-4 | Line-5 | Line-6 | Line-7 | Line-8 |
|---|---|---|---|---|---|---|---|---|
| 1 | 0.246 | 0.241 | 0.238 | 0.232 | 0.237 | 0.248 | 0.244 | 0.218 |
| 2 | 6.65 | 3.96 | 9.27 | 7.65 | 6.06 | 10.83 | 7.94 | 7.4 |
| 3 | 33.2 | 19.8 | 46.4 | 38.3 | 30.3 | 54.1 | 39.7 | 37 |
| 4 | 82.3 | 77.7 | 86.7 | 94.2 | 89.7 | 93.7 | 89.5 | 90.3 |
| 5 | 76.4 | 84 | 64.7 | 66.2 | 72 | 56.6 | 68 | 65.8 |
| 6 | 44.2 | 41.6 | 46.7 | 38.8 | 34.6 | 48.6 | 32.4 | 55.2 |

Table 95. Provided are the values of each of the parameters (as described above in Table 89) measured in Barley accessions (line) under normal growth conditions. Growth conditions are specified in the experimental procedure section.

TABLE 96

Additional measured parameters of correlation IDs in Barley accessions under normal conditions (set 2)

| Corr. ID | Line-9 | Line-10 | Line-11 | Line-12 | Line-13 | Line-14 | Line-15 |
|---|---|---|---|---|---|---|---|
| 1 | 0.232 | 0.223 | 0.235 | 0.213 | 0.177 | 0.191 | 0.174 |
| 2 | 4.52 | 8.41 | 2 | 8.05 | 7.07 | 0.75 | 1.14 |
| 3 | 22.6 | 39.7 | 10.8 | 40.3 | 35.4 | 3.7 | 5.7 |
| 4 | 91.2 | 92.5 | 91.7 | 85.3 | | | |
| 5 | 82 | 62.8 | 67.4 | 76.2 | 91.6 | 44 | 52.8 |
| 6 | 50.6 | 29 | 40 | 28.5 | 27.5 | 26 | |

Table 96 Provided are the values of each of the parameters (as described above in Table 89) measured in Barley accessions (line) under normal growth conditions. Growth conditions are specified in the experimental procedure section.

TABLE 97

Measured parameters of correlation IDs in Barley accessions under low nitrogen conditions (set 2)

| Corr. ID | Line-1 | Line-2 | Line-3 | Line-4 | Line-5 | Line-6 | Line-7 | Line-8 |
|---|---|---|---|---|---|---|---|---|
| 1 | 0.25 | 0.251 | 0.255 | 0.235 | 0.249 | 0.227 | 0.227 | 0.205 |
| 2 | 1.34 | 1.46 | 1.95 | 1.26 | 1.13 | 1.95 | 1.28 | 1.47 |
| 3 | 6.68 | 7.31 | 9.76 | 6.29 | 5.67 | 9.74 | 6.4 | 7.35 |
| 4 | 68.7 | 61.8 | 76.9 | 59.6 | 65.6 | 79.8 | 73.8 | 71 |
| 5 | 75.2 | 82 | 41 | 44.6 | 65.8 | 47.8 | 60.6 | 53.8 |
| 6 | 16 | 14.6 | 16.2 | 14 | 12.5 | 18.8 | 11.6 | 21.2 |

Table 97. Provided are the values of each of the parameters (as described above in Table 89) measured in Barley accessions (line) under low N growth conditions. Growth conditions are specified in the experimental procedure section.

TABLE 98

Additional measured parameters of correlation IDs in Barley accessions under low nitrogen conditions (set 2)

| Corr. ID | Line-9 | Line-10 | Line-11 | Line-12 | Line-13 | Line-14 | Line-15 |
|---|---|---|---|---|---|---|---|
| 1 | 0.235 | 0.201 | 0.222 | 0.234 | 0.193 | 0.19 | 0.17 |
| 2 | 0.98 | 1.16 | 0.92 | 1.33 | 1.57 | 0.29 | 0.22 |
| 3 | 5.06 | 5.43 | 4.62 | 6.67 | 7.83 | 1.44 | 1.12 |
| 4 | 95.8 | 64.9 | 68.8 | 74.2 | 81.4 | 37.1 | |
| 5 | 59.4 | 56.4 | 61.4 | 65.6 | 81.8 | 69 | 57.4 |
| 6 | 23.5 | 11 | 16 | 10.8 | 6.8 | 35 | |

Table 98. Provided are the values of each of the parameters (as described above in Table 89) measured in Barley accessions (line) under low N growth conditions. Growth conditions are specified in the experimental procedure section.

TABLE 99

Correlation between the expression level of selected genes of some embodiments of the invention in various tissues and the phenotypic performance under drought and recovery conditions across Barley accessions

| Gene Name | R | P value | Exp. set | Corr. Set ID | Gene Name | R | P value | Exp. set | Corr. Set ID |
|---|---|---|---|---|---|---|---|---|---|
| LGA1 | 0.77 | 7.57E−02 | 1 | 16 | LGA1 | 0.82 | 4.50E−02 | 1 | 14 |
| LGA1 | 0.87 | 4.46E−03 | 3 | 16 | LGA1 | 0.83 | 1.09E−02 | 3 | 1 |
| LGA1 | 0.75 | 3.05E−02 | 3 | 18 | LGA1 | 0.77 | 2.47E−02 | 3 | 2 |
| LGA1 | 0.83 | 1.97E−02 | 2 | 5 | LGA1 | 0.78 | 6.65E−02 | 5 | 3 |
| LGA2 | 0.85 | 3.13E−02 | 1 | 6 | LGA2 | 0.72 | 1.07E−01 | 1 | 16 |
| LGA2 | 0.77 | 7.28E−02 | 1 | 2 | LGA2 | 0.75 | 3.26E−02 | 3 | 9 |
| LGA2 | 0.72 | 2.77E−02 | 6 | 1 | LGA2 | 0.76 | 1.85E−02 | 6 | 2 |
| LGA2 | 0.73 | 6.43E−02 | 2 | 12 | LGA2 | 0.87 | 9.97E−03 | 2 | 5 |
| LGA2 | 0.90 | 1.41E−02 | 5 | 3 | LGA2 | 0.77 | 2.46E−02 | 5 | 18 |
| LGA2 | 0.75 | 2.06E−02 | 4 | 18 | LGA2 | 0.80 | 1.02E−02 | 4 | 15 |

Table 99. Provided are the correlations (R) between the genes expression levels in various tissues and the phenotypic performance. "Corr. Set ID"—correlation set ID according to the correlated parameters specified in Table 87. "Exp. Set"—Expression set specified in Table 84. "R" = Pearson correlation coefficient; "P" = p value.

TABLE 100

Correlation between the expression level of selected genes of some embodiments of the invention in various tissues and the phenotypic performance under normal and low nitrogen growth conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LGA1 | 0.81 | 1.38E−02 | 6 | 25 | LGA1 | 0.76 | 1.81E−02 | 1 | 24 |
| LGA1 | 0.81 | 7.49E−03 | 1 | 4 | LGA1 | 0.80 | 1.83E−02 | 4 | 19 |
| LGA1 | 0.82 | 1.30E−02 | 4 | 25 | LGA2 | 0.72 | 4.19E−02 | 6 | 3 |
| LGA2 | 0.91 | 6.79E−04 | 1 | 24 | LGA2 | 0.91 | 6.44E−04 | 1 | 18 |

Table 100. Provided are the correlations (R) between the genes expression levels in various tissues and the phenotypic performance. "Corr. Set ID"—correlation set ID according to the correlated parameters specified in Table 88. "Exp. Set"—Expression set specified in Table 85. "R" = Pearson correlation coefficient; "P" = p value.

TABLE 101

Correlation between the expression level of selected genes of some embodiments of the invention in various tissues and the phenotypic performance under low nitrogen and normal growth conditions across Barley accessions (set 2)

| Gene Name | R | P value | Exp. set | Corr. Set ID |
|---|---|---|---|---|
| LGA1 | 0.90 | 1.01E−03 | 6 | 4 |

Table 101. Provided are the correlations (R) between the genes expression levels in various tissues and the phenotypic performance. "Corr. Set ID"—correlation set ID according to the correlated parameters specified in Table 89. "Exp. Set"—Expression set specified in Table 86. "R" = Pearson correlation coefficient; "P" = p value.

Example 10

Production of Tomato Transcriptome and High Throughput Correlation Analysis Using 44K Tomato Oligonucleotide Micro-Array In order to produce a high throughput correlation analysis between ABST and NUE related phenotypes and gene expression, the present inventors utilized a Tomato oligonucleotide micro-array, produced by Agilent Technologies [chem(dot)agilent(dot)com/Scripts/PDS(dot)asp?1Page=50879]. The array oligonucleotide represents about 44,000 Tomato genes and transcripts. In order to define correlations between the levels of RNA expression with ABST, NUE, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [davidmlane(dot)com/hyperstat/A34739(dot)html].

I. Correlation of Tomato Varieties Across Ecotypes Grown Under Drought Low Nitrogen and Regular Growth Conditions Experimental Procedures:

Ten Tomato varieties were grown in 3 repetitive blocks, each containing 6 plants per plot, at net house. Briefly, the growing protocol was as follows:

1. Regular growth conditions: Tomato varieties were grown under normal conditions: 4-6 Liters/$m^2$ of water per day and fertilized with NPK (nitrogen, phosphorous and potassium at a ratio 6:6:6, respectively) as recommended in protocols for commercial tomato production.

2. Drought stress: Tomato varieties were grown under normal conditions (4-6 Liters/$m^2$ per day with fertilizers) until flowering. At this time, irrigation was reduced to 50% compared to normal conditions.

3. Low Nitrogen fertilization conditions: Tomato varieties were grown under normal conditions (4-6 Liters/$m^2$ per day and fertilized with NPK as recommended in protocols for commercial tomato production) until flowering. At this time, Nitrogen fertilization was stopped.

Plants were phenotyped on a daily basis following the standard descriptor of tomato (Table 103). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute).

Analyzed tomato tissues—Two tissues at different developmental stages [flower and leaf], representing different plant characteristics, were sampled and RNA was extracted as described above. For convenience, each micro-array expression information tissue type has received a Set ID as summarized in Table 102 below.

TABLE 102

Tomato transcriptome expression sets

| Expression Set | Set ID |
|---|---|
| Leaf, under normal growth conditions | 1 |
| Flower, under normal growth conditions | 2 |
| Leaf, under low Nitrogen growth conditions | 3 |
| Flower, under low Nitrogen growth conditions | 4 |
| Leaf, under drought growth conditions | 5 |
| Flower, under drought growth conditions | 6 |
| Leaf, under drought growth conditions | 7 |
| Flower, under drought growth conditions | 8 |
| Leaf, under low Nitrogen growth conditions | 9 |
| Flower, under low Nitrogen growth conditions | 10 |
| Leaf, under normal growth conditions | 11 |
| Flower, under normal growth conditions | 12 |

Table 102: Provided are the tomato transcriptome expression sets (measured in a tomato field experiment).

Data parameters collected are summarized in Table 103 below. The average for each of the measured parameters was calculated using the JMP software and values are summarized in Tables 104-111 below. Subsequent correlation analysis was conducted (Table 112) with the correlation coefficient (R) and the p-values. Results were integrated to the database.

TABLE 103

Tomato correlated parameters (vectors)

| Correlated parameter with | Corr. ID |
|---|---|
| 100 weight green fruit [gr.], under Drought growth conditions | 1 |
| 100 weight green fruit [gr], under Normal growth conditions | 2 |
| 100 weight green fruit [gr], under low Nitrogen growth conditions | 3 |
| 100 weight red fruit [gr], under Drought growth conditions | 4 |
| 100 weight red fruit [gr], under Normal growth conditions | 5 |
| 100 weight red fruit [gr], under low Nitrogen growth conditions | 6 |
| average red fruit weight [gr], under Drought growth conditions | 7 |
| average red fruit weight [gr], under Normal growth conditions | 8 |
| average red fruit weight [gr], under low Nitrogen growth conditions | 9 |
| Cluster (flower) Weight [gr], low N/Normal (the ratio between the results under low N conditions divided by the results under normal conditions) | 10 |
| flower cluster weight [ratio], Drought/Normal (ratio) | 11 |
| flower cluster weight [ratio], Drought/low N (ratio) | 12 |
| Fruit [ratio], Drought/low N (ratio) | 13 |
| Fruit [ratio], low N/Normal (ratio) | 14 |
| Fruit Yield/Plant [gr], under Drought growth conditions | 15 |
| Fruit yield/Plant [gr], under Normal growth conditions | 16 |
| Fruit Yield/Plant [gr], under low Nitrogen growth conditions | 17 |
| Fruit Yield [ratio], Drought/Normal (ratio) | 18 |
| FW/Plant [gr], under Drought growth conditions | 19 |

TABLE 103-continued

Tomato correlated parameters (vectors)

| Correlated parameter with | Corr. ID |
|---|---|
| FW/Plant [gr], under Normal growth conditions | 20 |
| FW/Plant [gr], under low Nitrogen growth conditions | 21 |
| FW [ratio], Drought/Normal (ratio) | 22 |
| FW [ratio], NUE/Normal (ratio) | 23 |
| Harvest index [yield/yield + biomass], under Normal growth conditions | 24 |
| Harvest index [yield/yield + biomass], under low Nitrogen growth conditions | 25 |
| Leaflet Length [cm], under Drought growth conditions | 26 |
| Leaflet Length [cm], under Normal growth conditions | 27 |
| Leaflet Length [cm], under low Nitrogen growth conditions | 28 |
| Leaflet Width [cm], under Drought growth conditions | 29 |
| Leaflet Width [cm], under Normal growth conditions | 30 |
| Leaflet Width [cm], under low Nitrogen growth conditions | 31 |
| No flowers [num], under Normal growth conditions | 32 |
| No flowers [num], under low Nitrogen growth conditions | 33 |
| NUE2 [total biomass/SPAD], under Normal growth conditions | 34 |
| NUE2 [total biomass/SPAD], under low Nitrogen growth conditions | 35 |
| NUE [yield/SPAD], under Normal growth conditions | 36 |
| NUE [yield/SPAD], under low Nitrogen growth conditions | 37 |
| Num. Flowers [ratio], Low N/Normal (ratio) | 38 |
| Num of Flowers [num], under Drought growth conditions | 39 |
| Num of Flowers [ratio], Drought/Normal (ratio) | 40 |
| Num of Flowers [ratio], Drought/low N (ratio) | 41 |
| NUpE [biomass/SPAD], under Normal growth conditions | 42 |
| NUpE [biomass/SPAD], under low Nitrogen growth conditions | 43 |
| Red fruit weight [ratio], Drought/Normal (ratio) | 44 |
| RWC [%], under Drought growth conditions | 45 |
| RWC Drought/Normal [ratio] (ratio) | 46 |
| RWC [%], under Normal growth conditions | 47 |
| RWC [%], under low Nitrogen growth conditions | 48 |
| RWC NUE/Normal [ratio] (ratio) | 49 |
| SLA [leaf area/plant biomass], under Normal growth conditions | 50 |
| SLA [leaf area/plant biomass], under low Nitrogen growth conditions | 51 |
| SPAD 100% RWC NUE/Normal [ratio] (ratio) | 52 |
| SPAD 100% RWC, [SPAD unit], under Normal growth conditions | 53 |
| SPAD 100% RWC [SPAD unit], under low Nitrogen growth conditions | 54 |
| SPAD NUE/Normal [ratio] (ratio) | 55 |
| SPAD under Low Nitrogen growth conditions [SPAD unit] | 56 |
| SPAD [SPAD unit], under Normal growth conditions | 57 |
| Total Leaf Area) [cm$^2$], under Drought growth conditions | 58 |
| Total Leaf Area [cm$^2$], under Normal growth conditions | 59 |
| Total Leaf Area [cm$^2$], under low Nitrogen growth conditions | 60 |
| Weight clusters (flowers) [gr], under low Nitrogen growth conditions | 61 |
| Weight flower clusters [gr], under Drought growth conditions | 62 |
| Weight Flower clusters [gr], under Normal growth conditions | 63 |
| Yield/SLA [ratio], under Normal growth conditions | 64 |
| Yield/SLA [ratio], under low Nitrogen growth conditions | 65 |
| Yield/total leaf area [ratio], under Normal growth conditions | 66 |
| Yield/total leaf area [ratio], under low Nitrogen growth conditions | 67 |

Table 103. Provided are the tomato correlated parameters. "gr." = grams; "FW" = fresh weight; "NUE" = nitrogen use efficiency; "RWC" = relative water content; "NUpE" = nitrogen uptake efficiency; "SPAD" = chlorophyll levels; "HI" = harvest index (vegetative weight divided on yield); "SLA" = specific leaf area (leaf area divided by leaf dry weight); "num" = number; "cm" = centimeter.

Fruit Yield (grams)—At the end of the experiment [when 50% of the fruit were ripe (red)] all fruits from plots within blocks A-C were collected. The total fruits were counted and weighted. The average fruits weight was calculated by dividing the total fruit weight by the number of fruits.

Yield/SLA—Fruit yield divided by the specific leaf area, gives a measurement of the balance between reproductive and vegetative processes.

Yield/total leaf area—Fruit yield divided by the total leaf area, gives a measurement of the balance between reproductive and vegetative processes.

Plant Fresh Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two inflorescence from plots within blocks A-C were collected. The inflorescence weight (gr.) and number of flowers per inflorescence were counted.

SPAD [SPAD unit]—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the Formula I (above).

Plants that maintain high relative water content (RWC) compared to control lines were considered more tolerant to drought than those exhibiting a reduced relative water content.

Experimental Results

TABLE 104

Measured parameters in Tomato accessions under drought conditions

| Corr. ID | Line-1 | Line-2 | Line-3 | Line-4 | Line-5 | Line-6 | Line-7 | Line-8 | Line-9 |
|---|---|---|---|---|---|---|---|---|---|
| 22 | 1.72 | 0.34 | 0.61 | 2.63 | 1.18 | 1.36 | 4.02 | 1.01 | 0.61 |
| 19 | 2.62 | 1.09 | 1.85 | 2.22 | 2.63 | 2.71 | 3.41 | 2.11 | 1.95 |
| 18 | 0.57 | 1.41 | 1.27 | 2.88 | 4.2 | 0.55 | 0.09 | 1.03 | 1.39 |
| 15 | 0.467 | 0.483 | 0.629 | 0.347 | 2.044 | 0.25 | 0.045 | 0.453 | 0.292 |
| 13 | 1.15 | 0.73 | 1.32 | 0.76 | 1.51 | 0.71 | 5.06 | 0.89 | 0.67 |
| 39 | 16.7 | 6.5 | 15.7 | 20.3 | 11.7 | 25.3 | 29.7 | 17.3 | 14.7 |
| 41 | 0.88 | 1.22 | 1.74 | 1.56 | 1.09 | 1.52 | 4.96 | 1.08 | 0.98 |
| 40 | 2.94 | 0.34 | 2.47 | 2.65 | 1.21 | 3.04 | 5.95 | 2.08 | 1.47 |
| 46 | 0.99 | 0.97 | 1.02 | 1.08 | 1.21 | 0.88 | 1.34 | 0.28 | 1.13 |
| 45 | 72.1 | 74.5 | 65.3 | 72.2 | 66.1 | 68.3 | 78.1 | 18.5 | 73.2 |
| 44 | 0.19 | 24.37 | 25.38 | 0.02 | 20.26 | 0.04 | 0.15 | 0.02 | 0.86 |
| 62 | 0.368 | 0.407 | 0.325 | 0.288 | 0.551 | 0.311 | 0.445 | 0.555 | 0.304 |
| 7 | 0.0092 | 0.1948 | 0.209 | 0.0047 | 0.102 | 0.0019 | 0.0346 | 0.0063 | 0.0053 |
| 12 | 0.69 | 1.11 | 1.06 | 0.82 | 1.16 | 1.25 | 1.52 | 1.19 | 0.76 |
| 11 | 0.32 | 1.19 | 0.47 | 0.01 | 1.25 | 0.03 | 0.56 | 0.96 | 0.42 |

Table 104: Provided are the values of each of the parameters (as described above) measured in Tomato accessions (Line) under drought conditions. Growth conditions are specified in the experimental procedure section.

TABLE 105

Additional Measured parameters in Tomato accessions under drought conditions

| Corr. ID | Line-10 | Line-11 | Line-12 | Line-13 | Line-14 | Line-15 | Line-16 | Line-17 | Line-18 |
|---|---|---|---|---|---|---|---|---|---|
| 22 | 0.64 | 0.95 | 0.51 | 1.17 | 1.94 | 0.35 | 1.06 | 0.21 | 0.48 |
| 19 | 1.76 | 1.72 | 1.92 | 2.21 | 3.73 | 0.75 | 1.76 | 0.63 | 1.11 |
| 18 | 3.28 | 0.91 | 2.62 | 0.32 | 2.48 | 0.41 | 1.62 | 1.76 | 1.42 |
| 15 | 1.017 | 0.6 | 0.494 | 0.272 | 0.679 | 0.14 | 0.529 | 0.554 | 0.414 |
| 13 | 2.17 | 0.38 | 1.27 | 0.84 | 1.51 | 0.98 | 1.34 | 0.38 | 0.84 |
| 39 | 29.7 | 15 | 10.3 | 18.3 | 12 | 20.3 | 12.7 | 12.7 | 11.3 |
| 41 | 4.94 | 0.88 | 0.79 | 2.12 | 1.29 | 1.61 | 1.9 | 1.36 | 1.42 |
| 40 | 4.24 | 1.67 | 1.29 | 3.44 | 1.5 | 2.65 | 1.41 | 1.19 | 1.26 |
| 46 | 0.83 | 1.01 | 1.2 | 1.11 | 1.97 | 0.72 | 0.75 | 1.01 | 0.83 |
| 45 | 62.5 | 67.2 | 75.8 | 62.8 | 70.7 | 55.8 | 75.2 | 63.7 | 62.3 |
| 44 | 0.74 | 0.09 | 1.72 | 0.17 | 0.02 | 10.5 | 27.89 | 11.79 | 9.98 |
| 62 | 0.315 | 0.308 | 0.311 | 8.36 | 0.288 | 0.342 | 0.441 | 0.268 | 0.426 |
| 7 | 0.0049 | 0.0052 | 0.012 | 0.0045 | 0.0063 | 0.3032 | 0.1376 | 0.0405 | 0.0885 |
| 12 | 1.04 | 0.38 | 0.78 | 24.12 | 0.67 | 0.97 | 0.99 | 0.95 | 0.91 |
| 11 | 0.38 | 0.36 | 0.62 | 8.2 | 0.41 | 0.91 | 0.67 | 0.38 | 1.31 |
| 1 |  |  | 0.8 | 0.28 | 0.38 | 0.63 | 2.86 | 1.16 | 4.4 |
| 4 |  |  | 0.89 | 0.35 | 0.63 | 2.27 | 7.4 | 2.94 | 11.6 |
| 26 |  |  | 5.15 | 3.38 | 7.14 | 5.48 | 8.62 | 6.35 | 6.77 |
| 29 |  |  | 2.55 | 2.04 | 4.17 | 3.09 | 4.69 | 3.87 | 2.91 |
| 58 |  |  | 337.6 | 130.8 | 557.9 | 176.7 | 791.9 | 517 | 832.3 |

Table 105. Provided are the values of each of the parameters (as described above) measured in Tomato accessions (Line) under drought conditions. Growth conditions are specified in the experimental procedure section.

TABLE 106

Measured parameters in Tomato accessions under normal conditions

| Corr. ID | Line-1 | Line-2 | Line-3 | Line-4 | Line-5 | Line-6 | Line-7 | Line-8 | Line-9 |
|---|---|---|---|---|---|---|---|---|---|
| 20 | 1.53 | 3.17 | 3.02 | 0.84 | 2.24 | 1.98 | 0.85 | 2.09 | 3.21 |
| 16 | 0.826 | 0.342 | 0.494 | 0.121 | 0.487 | 0.454 | 0.529 | 0.44 | 0.21 |
| 32 | 5.67 | 19.33 | 6.33 | 7.67 | 9.67 | 8.33 | 5 | 8.33 | 10 |
| 47 | 72.8 | 76.5 | 64.3 | 67.1 | 54.8 | 77.6 | 58.2 | 66.5 | 64.7 |
| 53 | 36.2 | 28.4 | 35.9 | 31.1 | 26.4 | 33.7 | 25 | 35.5 | 37.9 |
| 57 | 49.7 | 37.2 | 55.8 | 46.4 | 48.2 | 43.4 | 42.9 | 53.3 | 58.5 |
| 63 | 1.17 | 0.34 | 0.69 | 56.35 | 0.44 | 11.31 | 0.79 | 0.58 | 0.73 |
| 8 | 0.0479 | 0.008 | 0.0082 | 0.2861 | 0.005 | 0.0541 | 0.2306 | 0.2898 | 0.0061 |
| 24 | 0.351 | 0.097 | 0.14 | 0.125 | 0.179 | 0.186 | 0.384 | 0.174 | 0.061 |
| 36 | 0.0166 | 0.0092 | 0.0089 | 0.0026 | 0.0101 | 0.0105 | 0.0123 | 0.0083 | 0.0036 |
| 34 | 0.0473 | 0.0945 | 0.063 | 0.0208 | 0.0565 | 0.0562 | 0.0321 | 0.0474 | 0.0584 |
| 42 | 0.0307 | 0.0853 | 0.0542 | 0.0182 | 0.0464 | 0.0457 | 0.0198 | 0.0392 | 0.0548 |
| 2 | | | 0.56 | 3.05 | 0.24 | 2.58 | 6.32 | 5.75 | 0.38 |
| 5 | | | 0.82 | 2.46 | 0.5 | 2.76 | 5.32 | 5.24 | 0.61 |
| 27 | | | 6.34 | 7.99 | 5.59 | 7.7 | 7.85 | 6.22 | 6.16 |
| 30 | | | 3.69 | 4.77 | 3.43 | 4.56 | 4.44 | 3.15 | 3.37 |
| 50 | | | 141 | 689.7 | 130.2 | 299.1 | 1117.7 | 111.8 | 106.3 |
| 59 | | | 426.1 | 582.4 | 291.4 | 593.6 | 947.6 | 233.4 | 340.7 |
| 64 | | | 0.0035 | 0.0002 | 0.0037 | 0.0015 | 0.0005 | 0.0039 | 0.002 |
| 66 | | | 0.0012 | 0.0002 | 0.0017 | 0.0008 | 0.0006 | 0.0019 | 0.0006 |

Table 107: Provided are the values of each of the parameters (as described above) measured in Tomato accessions (Line) under normal growth conditions. Growth conditions are specified in the experimental procedure section.

TABLE 108

Additional measured parameters in Tomato accessions under normal conditions

| Corr. ID | Line-10 | Line-11 | Line-12 | Line-13 | Line-14 | Line-15 | Line-16 | Line-17 | Line-18 |
|---|---|---|---|---|---|---|---|---|---|
| 20 | 2.75 | 1.81 | 3.77 | 1.89 | 1.93 | 2.14 | 1.65 | 3.01 | 2.29 |
| 16 | 0.31 | 0.662 | 0.189 | 0.852 | 0.273 | 0.347 | 0.327 | 0.314 | 0.291 |
| 32 | 7 | 9 | 8 | 5.33 | 8 | 7.67 | 9 | 10.67 | 9 |
| 47 | 75.2 | 66.2 | 63.2 | 56.8 | 36 | 77.6 | 100 | 63.2 | 75.1 |
| 53 | 38.4 | 26.5 | 30.1 | 32.9 | 17.4 | 33.8 | 54.5 | 26.3 | 44.4 |
| 57 | 51.1 | 40 | 47.6 | 57.9 | 48.3 | 43.6 | 54.5 | 41.6 | 59.1 |
| 63 | 0.83 | 0.86 | 0.5 | 1.02 | 0.7 | 0.38 | 0.66 | 0.7 | 0.33 |
| 8 | 0.0066 | 0.0577 | 0.007 | 0.0264 | 0.2611 | 0.0289 | 0.0049 | 0.0034 | 0.0089 |
| 24 | 0.101 | 0.268 | 0.048 | 0.311 | 0.124 | 0.139 | 0.165 | 0.095 | 0.113 |
| 36 | 0.0061 | 0.0166 | 0.004 | 0.0147 | 0.0057 | 0.008 | 0.006 | 0.0076 | 0.0049 |
| 34 | 0.06 | 0.0618 | 0.0832 | 0.0473 | 0.0455 | 0.0571 | 0.0363 | 0.0799 | 0.0437 |
| 42 | 0.0539 | 0.0453 | 0.0792 | 0.0326 | 0.0399 | 0.0492 | 0.0303 | 0.0724 | 0.0388 |
| 2 | 0.3 | 1.95 | 2.53 | 1.42 | 2.03 | 1.39 | 2.27 | 0.45 | 0.42 |
| 5 | 0.66 | 2.7 | 0.7 | 2.64 | 4.67 | 2.17 | 0.49 | 0.34 | 0.75 |
| 27 | 5.65 | 4.39 | 4.44 | 6.77 | 7.42 | 6.71 | 5.87 | 4.16 | 10.29 |
| 30 | 3.13 | 2.4 | 2.02 | 3.8 | 3.74 | 2.98 | 3.22 | 2.09 | 5.91 |
| 50 | 123.1 | 105 | 111.9 | 307.9 | 419.4 | 365.8 | 212.9 | 84.9 | 469.9 |
| 59 | 339.1 | 190.1 | 421.8 | 581.3 | 807.5 | 784.1 | 351.8 | 255.8 | 1078.1 |
| 64 | 0.0025 | 0.0063 | 0.0017 | 0.0028 | 0.0007 | 0.0009 | 0.0015 | 0.0037 | 0.0006 |
| 66 | 0.0009 | 0.0035 | 0.0004 | 0.0015 | 0.0003 | 0.0004 | 0.0009 | 0.0012 | 0.0003 |

Table 109: Provided are the values of each of the parameters (as described above) measured in Tomato accessions (Line) under normal growth conditions. Growth conditions are specified in the experimental procedure section.

TABLE 110

Measured parameters in Tomato accessions under low nitrogen conditions

| Corr. ID | Line-1 | Line-2 | Line-3 | Line-4 | Line-5 | Line-6 | Line-7 | Line-8 | Line-9 |
|---|---|---|---|---|---|---|---|---|---|
| 10 | 0.457 | 1.072 | 0.442 | 0.006 | 1.076 | 0.022 | 0.371 | 0.809 | 0.548 |
| 23 | 2.65 | 0.38 | 0.74 | 3.01 | 0.83 | 1.54 | 3.7 | 1.22 | 0.58 |
| 21 | 4.04 | 1.21 | 2.25 | 2.54 | 1.85 | 3.06 | 3.13 | 2.54 | 1.84 |
| 17 | 0.406 | 0.66 | 0.477 | 0.458 | 1.351 | 0.354 | 0.009 | 0.509 | 0.436 |

TABLE 110-continued

Measured parameters in Tomato accessions under low nitrogen conditions

| | Line | | | | | | | | |
|---|---|---|---|---|---|---|---|---|---|
| Corr. ID | Line-1 | Line-2 | Line-3 | Line-4 | Line-5 | Line-6 | Line-7 | Line-8 | Line-9 |
| 14 | 0.49 | 1.93 | 0.97 | 3.8 | 2.78 | 0.78 | 0.02 | 1.16 | 2.07 |
| 33 | 19 | 5.3 | 9 | 13 | 10.7 | 16.7 | 6 | 16 | 15 |
| 38 | 3.35 | 0.28 | 1.42 | 1.7 | 1.1 | 2 | 1.2 | 1.92 | 1.5 |
| 48 | 74.1 | 99.1 | 69.5 | 63.2 | 77.4 | 77.9 | 80.5 | 67.4 | 67.2 |
| 49 | 1.02 | 1.3 | 1.08 | 0.94 | 1.41 | 1 | 1.38 | 1.01 | 1.04 |
| 52 | 0.79 | 1.37 | 0.92 | 0.75 | 1.31 | 0.97 | 1.11 | 0.95 | 0.79 |
| 54 | 28.5 | 39 | 33 | 23.4 | 34.5 | 32.5 | 27.7 | 33.7 | 30 |
| 56 | 38.4 | 39.4 | 47.5 | 37 | 44.6 | 41.7 | 34.4 | 50 | 44.7 |
| 55 | 0.773 | 1.059 | 0.851 | 0.797 | 0.925 | 0.961 | 0.802 | 0.938 | 0.764 |
| 61 | 0.533 | 0.367 | 0.307 | 0.35 | 0.473 | 0.249 | 0.293 | 0.467 | 0.4 |
| 9 | 0.0239 | 0.1907 | 0.0065 | 0.0053 | 0.0963 | 0.0044 | 0.0055 | 0.0075 | 0.0058 |
| 3 | 0.87 | 3.66 | 0.57 | 0.37 | 3.4 | 0.68 | 0.45 | 0.47 | 0.54 |
| 25 | 0.091 | 0.352 | 0.175 | 0.153 | 0.422 | 0.104 | 0.003 | 0.167 | 0.191 |
| 28 | 6.4 | 5.92 | 3.69 | 5.43 | 6.95 | 3.73 | 4.39 | 6.72 | 6.66 |
| 31 | 3.47 | 1.97 | 1.79 | 2.55 | 3.52 | 1.73 | 1.87 | 3.54 | 3.28 |
| 37 | 0.0142 | 0.0169 | 0.0144 | 0.0196 | 0.0391 | 0.0109 | 0.0003 | 0.0151 | 0.0145 |
| 35 | 0.1562 | 0.048 | 0.0825 | 0.128 | 0.0927 | 0.1051 | 0.1136 | 0.0906 | 0.0759 |
| 43 | 0.1419 | 0.0311 | 0.068 | 0.1085 | 0.0536 | 0.0942 | 0.1133 | 0.0755 | 0.0614 |
| 51 | 140 | 317.1 | 131.3 | 148.8 | 257.5 | 64.3 | 144.6 | 246.1 | 405.5 |
| 60 | 565.9 | 384.8 | 294.8 | 378 | 476.4 | 197.1 | 453.2 | 625.5 | 748 |
| 65 | 0.0029 | 0.0021 | 0.0036 | 0.0031 | 0.0052 | 0.0055 | 0.0001 | 0.0021 | 0.0011 |
| 67 | 0.0007 | 0.0017 | 0.0016 | 0.0012 | 0.0028 | 0.0018 | 0 | 0.0008 | 0.0006 |
| 6 | 1.06 | 6.87 | 0.65 | 0.53 | 7.17 | 0.44 | | 0.55 | 0.75 |

Table 110: Provided are the values of each of the parameters (as described above) measured in Tomato accessions (Line) under low nitrogen growth conditions. Growth conditions are specified in the experimental procedure section.

TABLE 111

Additional measured parameters in Tomato accessions under low nitrogen conditions

| | Line | | | | | | | | |
|---|---|---|---|---|---|---|---|---|---|
| Corr. ID | Line-10 | Line-11 | Line-12 | Line-13 | Line-14 | Line-15 | Line-16 | Line-17 | Line-18 |
| 10 | 0.364 | 0.953 | 0.8 | 0.34 | 0.611 | 0.938 | 0.677 | 0.404 | 1.439 |
| 23 | 0.55 | 1.06 | 0.49 | 1.31 | 1.36 | 0.51 | 0.71 | 0.31 | 0.47 |
| 21 | 1.52 | 1.91 | 1.86 | 2.47 | 2.62 | 1.08 | 1.17 | 0.92 | 1.09 |
| 17 | 0.468 | 1.593 | 0.388 | 0.323 | 0.449 | 0.143 | 0.396 | 1.442 | 0.495 |
| 14 | 1.51 | 2.41 | 2.06 | 0.38 | 1.64 | 0.41 | 1.21 | 4.59 | 1.7 |
| 33 | 6 | 17 | 13 | 8.7 | 9.3 | 12.7 | 6.7 | 9.3 | 8 |
| 38 | 0.86 | 1.89 | 1.62 | 1.62 | 1.17 | 1.65 | 0.74 | 0.88 | 0.89 |
| 48 | 66.1 | 69.6 | 69.3 | 100 | 57.7 | 90.8 | 68 | 59.6 | 72.2 |
| 49 | 0.88 | 1.05 | 1.1 | 1.76 | 1.6 | 1.17 | 0.68 | 0.94 | 0.96 |
| 52 | 0.92 | 0.94 | 1.36 | 1.44 | 1.5 | 1.05 | 0.56 | 1.48 | 0.84 |
| 54 | 35.5 | 24.8 | 40.8 | 47.5 | 26.1 | 35.4 | 30.6 | 39 | 37.5 |
| 56 | 53.7 | 35.7 | 58.8 | 47.5 | 45.2 | 39 | 45 | 65.3 | 51.9 |
| 55 | 1.051 | 0.892 | 1.235 | 0.82 | 0.936 | 0.894 | 0.826 | 1.57 | 0.878 |
| 61 | 0.303 | 0.82 | 0.4 | 0.347 | 0.428 | 0.353 | 0.447 | 0.283 | 0.47 |
| 9 | 0.0127 | 0.0212 | 0.0052 | 0.0057 | 0.0475 | 0.3573 | 0.0367 | 0.6265 | |
| 3 | 0.39 | 0.97 | 0.91 | 0.36 | 0.35 | 0.57 | 4.38 | 2.02 | 8.13 |
| 25 | 0.236 | 0.454 | 0.173 | 0.115 | 0.146 | 0.116 | 0.253 | 0.61 | 0.313 |
| 28 | 4.39 | 3.9 | 5.29 | 6.32 | 5.11 | 4.72 | 6.83 | 7.1 | 8.21 |
| 31 | 2.52 | 2.61 | 2.61 | 3.58 | 2.56 | 2.48 | 3.43 | 3.3 | 3.69 |
| 37 | 0.0132 | 0.0642 | 0.0095 | 0.0068 | 0.0172 | 0.004 | 0.0129 | 0.037 | 0.0132 |
| 35 | 0.0559 | 0.1413 | 0.055 | 0.0589 | 0.1178 | 0.0347 | 0.051 | 0.0606 | 0.0423 |
| 43 | 0.0427 | 0.0771 | 0.0455 | 0.0521 | 0.1006 | 0.0307 | 0.0381 | 0.0236 | 0.029 |
| 51 | 299.3 | 86.2 | 182.3 | 160.2 | 90.1 | 161 | 379 | 531.1 | 650.7 |
| 60 | 454 | 164.9 | 338.3 | 396 | 236.1 | 174.6 | 441.8 | 489.2 | 707.8 |
| 65 | 0.0016 | 0.0185 | 0.0021 | 0.002 | 0.005 | 0.0009 | 0.001 | 0.0027 | 0.0008 |
| 67 | 0.001 | 0.0097 | 0.0011 | 0.0008 | 0.0019 | 0.0008 | 0.0009 | 0.0029 | 0.0007 |
| 6 | 0.58 | 1.27 | 1.34 | 0.52 | 0.57 | 0.94 | 6.17 | 3.67 | 11.32 |

Table 111: Provided are the values of each of the parameters (as described above) measured in Tomato accessions (Line) under low nitrogen growth conditions. Growth conditions are specified in the experimental procedure section.

TABLE 112

Correlation between the expression level of selected genes of some embodiments of the invention in various tissues and the phenotypic performance under low nitrogen, normal or drought stress conditions across Tomato accessions

| Gene Name | R | P value | Exp. set | Corr. Set ID | Gene Name | R | P value | Exp. set | Corr. Set ID |
|---|---|---|---|---|---|---|---|---|---|
| LGD2 | 0.76 | 1.10E−02 | 10 | 3 | LGD2 | 0.78 | 7.59E−03 | 10 | 6 |
| LGD2 | 0.76 | 1.06E−02 | 4 | 10 | LGD24 | 0.72 | 1.77E−02 | 6 | 19 |
| LGD24 | 0.75 | 1.31E−02 | 4 | 33 | LGD25 | 0.73 | 2.61E−02 | 11 | 42 |
| LGD25 | 0.70 | 3.43E−02 | 11 | 34 | LGD25 | 0.91 | 2.59E−04 | 1 | 63 |
| LGD25 | 0.82 | 4.00E−03 | 4 | 54 | LGD25 | 0.90 | 3.82E−04 | 5 | 39 |
| LGD25 | 0.73 | 1.74E−02 | 5 | 40 | LGD25 | 0.88 | 8.75E−04 | 5 | 41 |
| LGD26 | 0.75 | 2.02E−02 | 11 | 24 | LGD26 | 0.76 | 1.12E−02 | 2 | 57 |
| LGD26 | 0.74 | 1.42E−02 | 2 | 53 | LGD26 | 0.73 | 1.70E−02 | 5 | 40 |
| LGD26 | 0.79 | 6.61E−03 | 5 | 41 | | | | | |

Table 112. Provided are the correlations (R) between the genes expression levels in various tissues and the phenotypic performance. "Corr. Set ID"—correlation set ID according to the correlated parameters specified in Table 103. "Exp. Set"—Expression set specified in Table 102. "R" = Pearson correlation coefficient; "P" = p value.

Example 11

Production of Soybean (*Glycine Max*) Transcriptome and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies chem(dot)agilent(dot)com/Scripts/PDS(dot)asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 26 varieties were further used for RNA expression analysis. The correlation between the RNA levels and the characterized parameters was analyzed using Pearson correlation test.

Correlation of *Glycine max* Genes' Expression Levels with Phenotypic Characteristics Across Ecotype Experimental Procedures 29 Soybean varieties were grown in three repetitive plots, in field. Briefly, the growing protocol was as follows: Soybean seeds were sown in soil and grown under normal conditions (no irrigation, good organomic particles) which included high temperature about 82.38 (° F.), low temperature about 58.54 (° F.); total precipitation rainfall from May through September (from sowing until harvest) was about 16.97 inch.

In order to define correlations between the levels of RNA expression with yield components or plant architecture related parameters or vigor related parameters, 26 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

For convenience, each micro-array expression information tissue type has received a Set ID as summarized in Table 113 below.

TABLE 113

Soybean transcriptome expression sets

| Expression Set | Set ID |
|---|---|
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

Table 113: Provided are the soybean transcriptome expression sets.

RNA extraction—All 12 selected Soybean varieties were sample per treatment. Plant tissues [leaf, root, Stem, Pod, apical meristem, Flower buds] growing under normal conditions were sampled and RNA was extracted as described above. The collected data parameters were as follows:

Main branch base diameter [mm] at pod set—the diameter of the base of the main branch (based diameter) average of three plants per plot.

Fresh weight [gr./plant] at pod set—total weight of the vegetative portion above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr./plant]—weight of all lateral branches at pod set, average of three plants per plot.

Total weight of pods on main stem at pod set [gr./plant]—weight of all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count of the number of pods containing 1 seed in all lateral branches at pod set, average of three plants per plot.

Total number of pods with 2 seeds on lateral branches at pod set [value/plant]—count of the number of pods containing 2 seeds in all lateral branches at pod set, average of three plants per plot.

Total number of pods with 3 seeds on lateral branches at pod set [value/plant]—count of the number of pods containing 3 seeds in all lateral branches at pod set, average of three plants per plot.

Total number of pods with 4 seeds on lateral branches at pod set [value/plant]—count of the number of pods containing 4 seeds in all lateral branches at pod set, average of three plants per plot.

Total number of pods with 1 seed on main stem at pod set [value/plant]—count of the number of pods containing 1 seed in main stem at pod set, average of three plants per plot.

Total number of pods with 2 seeds on main stem at pod set [value/plant]—count of the number of pods containing 2 seeds in main stem at pod set, average of three plants per plot.

Total number of pods with 3 seeds on main stem at pod set [value/plant]—count of the number of pods containing 3 seeds in main stem at pod set, average of three plants per plot.

Total number of pods with 4 seeds on main stem at pod set [value/plant]—count of the number of pods containing 4 seeds in main stem at pod set, average of three plants per plot.

Total number of seeds per plant at pod set [value/plant]—count of number of seeds in lateral branches and main stem at pod set, average of three plants per plot.

Total number of seeds on lateral branches at pod set [value/plant]—count of total number of seeds on lateral branches at pod set, average of three plants per plot.

Total number of seeds on main stem at pod set [value/plant]—count of total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—calculated in Formula XXIII (above), average of three plants per plot.

Ratio of total number of seeds in main stem to number of seeds on lateral branches—calculated in Formula XX IV, average of three plants per plot.

Total weight of pods per plant at pod set [gr./plant]—weight of all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, World Wide Web (dot) ars-grin (dot) gov/cgi-bin/npgs/html/desclist (dot) pl?51].

Seed quality [ranked 1-5]—measure at harvest; a visual estimate based on several hundred seeds. Parameter is rated according to the following scores considering the amount and degree of wrinkling, defective coat (cracks), greenishness, and moldy or other pigment. Rating is 1—very good, 2—good, 3—fair, 4—poor, 5—very poor.

Lodging [ranked 1-5]—is rated at maturity per plot according to the following scores: i-most plants in a plot are erected; 2-all plants leaning slightly or a few plants down; 3-all plants leaning moderately, or 25%-50% down; 4-all plants leaning considerably, or 50%-80% down; 5-most plants down. It is noted that intermediate scores such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate number of seeds on lateral branches-at pod set and divide by the number of pods with seeds on lateral branches-at pod set.

Average main stem seeds per pod [number]—Calculate total number of seeds on main stem at pod set and divide by the number of pods with seeds on main stem at pod setting.

Main stem average internode length [cm]—Calculate plant height at pod set and divide by the total number of nodes on main stem at pod setting.

Total number of pods with seeds on main stem [number]—count all pods containing seeds on the main stem at pod setting.

Total number of pods with seeds on lateral branches [number]—count all pods containing seeds on the lateral branches at pod setting.

Total number of pods per plant at pod set [number]—count pods on main stem and lateral branches at pod setting.

Data parameters collected are summarized in Table 114, herein below.

TABLE 114

Soybean correlated parameters (vectors)

| Correlated parameter with | Correlation ID |
|---|---|
| 100 percent flowering (days) | 1 |
| 50 percent flowering (days) | 2 |
| Base diameter at pod set (mm) | 3 |
| DW at pod set (gr) | 4 |
| Lodging (score 1-5) | 5 |
| Maturity (days) | 6 |
| Num of lateral branches (number) | 7 |
| Num of pods with 1 seed on main stem at pod set (number) | 8 |
| Num of pods with 2 seed on main stem at pod set (number) | 9 |

TABLE 114-continued

Soybean correlated parameters (vectors)

| Correlated parameter with | Correlation ID |
|---|---|
| Num of pods with 3 seed on main stem at pod set (number) | 10 |
| Num of pods with 4 seed on main stem at pod set (number) | 11 |
| Plant height at harvest (cm) | 12 |
| Plant height at pod set (cm) | 13 |
| Ratio number of pods per node on main stem (ratio) | 14 |
| Ratio num of seeds-main stem to lateral branches (ratio) | 15 |
| Seed quality (score 1-5) | 16 |
| Num of Seeds on lateral branches-at pod set | 18 |
| Total Number of Seeds on main stem at pod set (number) | 19 |
| Num of pods with 1 seed on lateral branch-pod set (number) | 20 |
| Num of pods with 2 seed on lateral branch-pod set (number) | 21 |
| Num pods with 3 seed on lateral branch-at pod set (number) | 22 |
| Num pods with 4 seed on lateral branch-at pod set (number) | 23 |
| Total number of nodes on main stem (number) | 24 |
| Num of nodes with pods on lateral branches-pod set (number) | 25 |
| Total number of seeds per plant (number) | 26 |
| Total weight of lateral branches at pod set (gr) | 27 |
| Weight of pods on lateral branches (gr)-at pod set | 28 |
| Total weight of pods on main stem at pod set (gr) | 29 |
| Total weight of pods per plant (gr/plant) | 30 |
| Total weight of seeds per plant (gr/plant) | 31 |
| fresh weight at pod set (gr) | 32 |
| yield at harvest (bushel/hectare) | 33 |
| Average lateral branch seeds per pod (number) | 34 |
| Average main stem seeds per pod (number) | 35 |
| Main stem average internode length (cm) | 36 |
| Num pods with seeds on lateral branches-at pod set (number) | 37 |
| Total number of pods per plant (number) | 38 |
| Total number of pods with seeds on main stem (number) | 39 |
| corrected Seed size (gr) | 40 |

Table 114. Provided are the soybean correlated parameters (vectors). "gr." = grams; "PS" = pod setting; "num" = number; "mm" = millimeter; "cm" = centimeter.

Experimental Results 29 different Soybean varieties lines were grown and characterized for 40 parameters as specified above. Tissues for expression analysis were sampled from a subset of 12 lines. The correlated parameters are described in Table 114 above. The average for each of the measured parameters was calculated using the JMP software (Tables 115-117) and a subsequent correlation analysis was performed (Table 118). Results were then integrated to the database.

TABLE 115

Measured parameters in Soybean varieties (lines 1-10)

| Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 67.3 | 67.3 | 67.3 | 70 | 68 | 71.7 | 67.3 | 67.7 | 71.7 | 67.3 |
| 2 | 61 | 65.3 | 60.7 | 61 | 54.7 | 68.3 | 66.5 | 65.7 | 62.3 | 67.7 |
| 3 | 8.27 | 8 | 8.33 | 7.16 | 7.78 | 9.54 | 8.13 | 9.68 | 8.41 | 8.11 |
| 4 | 35.8 | 51.7 | 53.7 | 34.7 | 47.5 | 50.3 | 53.5 | 38 | 45.8 | 46.2 |
| 5 | 2 | 2 | 1.67 | 1.67 | 1.17 | 1.83 | 1.67 | 1.17 | 1.83 | 1.67 |
| 6 | 27.7 | 27.7 | 24 | 30.3 | 31.3 | 43.7 | 27 | 30.3 | 35.3 | 30.3 |
| 7 | 5.11 | 8.44 | 9 | 7 | 8.67 | 8.67 | 7.11 | 9.11 | 8.67 | 9.89 |
| 8 | 0.56 | 2.44 | 1.11 | 2.56 | 0.89 | 4.38 | 1.89 | 1.44 | 2.33 | 1.44 |
| 9 | 16.4 | 17.2 | 16.9 | 25.3 | 10.4 | 16.2 | 20 | 13.2 | 22.3 | 16.9 |
| 10 | 19.3 | 23.3 | 29.6 | 23.3 | 30.6 | 1.8 | 23.6 | 19.8 | 25.4 | 22.3 |
| 11 | 0 | 0 | 0 | 0 | 2.222 | 0 | 0 | 0.111 | 0.111 | 0.111 |
| 12 | 69.2 | 85 | 96.7 | 75.8 | 73.3 | 76.7 | 75 | 67.5 | 75 | 75.8 |
| 13 | 66.8 | 79.4 | 86.8 | 64.1 | 68 | 69.6 | 74.1 | 62.4 | 69.7 | 70.9 |
| 14 | 2.34 | 2.67 | 2.87 | 2.87 | 2.51 | 1.38 | 2.65 | 2.13 | 2.77 | 2.26 |
| 15 | 1.28 | 1.13 | 0.89 | 1.35 | 0.86 | 0.9 | 1.43 | 0.87 | 1.38 | 0.89 |
| 16 | 3 | 2.17 | 2.33 | 2.33 | 2.5 | 3.5 | 2.67 | 3 | 2 | 2.17 |
| 18 | 92.8 | 124 | 150.9 | 122.8 | 174.9 | 55.9 | 112.7 | 134 | 171.1 | 160.4 |
| 19 | 91.4 | 106.9 | 123.6 | 123.2 | 122.3 | 43.9 | 112.6 | 87.7 | 123.8 | 102.7 |
| 20 | 0.78 | 0.89 | 1.56 | 0.78 | 1 | 3 | 1.22 | 1.78 | 2.78 | 1.78 |
| 21 | 15.3 | 17.6 | 17 | 23.3 | 18.1 | 18.8 | 21.2 | 26.4 | 34.4 | 32.3 |
| 22 | 20.4 | 29.3 | 38.4 | 25.1 | 43.2 | 2 | 21' | 26.4 | 33 | 31.3 |
| 23 | 0 | 0 | 0 | 0 | 2 | 0 | 0 | 0 | 0.111 | 0 |
| 24 | 15.6 | 16.1 | 16.6 | 17.8 | 17.7 | 16.8 | 17.3 | 16.1 | 18 | 18.1 |
| 25 | 13.9 | 20.9 | 23 | 22.4 | 26.1 | 16 | 21.6 | 23.1 | 26.3 | 33 |
| 26 | 184.2 | 230.9 | 274.4 | 246 | 297.2 | 99.8 | 225.2 | 221.7 | 294.9 | 263.1 |
| 27 | 57.8 | 66.7 | 67.8 | 57 | 73.7 | 63.8 | 64.4 | 64.9 | 80.3 | 74.9 |
| 28 | 23 | 25 | 26 | 18.3 | 23.2 | 14.9 | 27.9 | 20.1 | 23 | 20.1 |
| 29 | 22.6 | 22.2 | 22.1 | 17.9 | 17.9 | 14.3 | 23.8 | 16 | 18 | 15 |
| 30 | 45.6 | 47.2 | 48.1 | 36.2 | 41.1 | 29.2 | 51.7 | 36.1 | 41 | 35.1 |
| 31 | 21.4 | 14.7 | 15.1 | 13.4 | 16.6 | 10.5 | 16 | 17.2 | 14.6 | 16.5 |
| 32 | 158.9 | 185.8 | 170.9 | 146.8 | 172.8 | 198.2 | 166.4 | 152.6 | 175.7 | 163.9 |
| 33 | 55.5 | 50.3 | 47.6 | 46.8 | 55.9 | 43.8 | 51.7 | 50.4 | 52.9 | 56.3 |
| 34 | 2.53 | 2.58 | 2.67 | 2.51 | 2.74 | 1.95 | 2.46 | 2.43 | 2.43 | 2.53 |
| 35 | 2.52 | 2.49 | 2.6 | 2.36 | 2.77 | 1.89 | 4.5 | 2.52 | 2.48 | 2.53 |
| 36 | 4.29 | 4.93 | 5.24 | 3.61 | 3.85 | 4.15 | 4.29 | 3.91 | 3.9 | 3.92 |
| 40 | 89 | 93 | 86 | 71.3 | 88 | 75 | 80.7 | 75.7 | 76.3 | 77.3 |
| 37 | 36.6 | 47.8 | 57 | 49.2 | 64.3 | 28.6 | 45.4 | 54.7 | 70.3 | 65.4 |
| 38 | 72.9 | 90.8 | 104.6 | 100.4 | 108.4 | 51.7 | 90.9 | 89.2 | 120.6 | 106.2 |
| 39 | 36.3 | 43 | 47.6 | 51.2 | 44.1 | 23.1 | 45.4 | 34.6 | 50.2 | 40.8 |

Table 115. Provided are the values of each of the parameters (as described above) measured in soybean accessions (Line). Growth conditions are specified in the experimental procedure section

TABLE 116

Measured parameters in Soybean varieties (lines 11-20)

| Corr. ID | Line-11 | Line-12 | Line-13 | Line-14 | Line-15 | Line-16 | Line-17 | Line-18 | Line-19 | Line-20 |
|---|---|---|---|---|---|---|---|---|---|---|
| 1 | 67 | 69.7 | 60 | 70.7 | 71.7 | 71.7 | 74 | 73 | 72.3 | 73.3 |
| 2 | 61.7 | 64.3 | | | | | | | | |
| 3 | 7.54 | 7.83 | 8.82 | 8.1 | 8.72 | 9.54 | 10.12 | 8.46 | 8.09 | 8.11 |
| 4 | 38.7 | 50.7 | 60.8 | 44.3 | 52.3 | 54.5 | 55.7 | 48 | 52 | 45.2 |
| 5 | 1.17 | 2.67 | 2.67 | 1.5 | 3 | 1.83 | 2.83 | 2.67 | 2.5 | 1.67 |
| 6 | 28 | 41 | 38.3 | 31 | 36 | 38.7 | 40 | 41 | 38.3 | 37 |
| 7 | 5.33 | 5 | 7.67 | 4.78 | 7.78 | 8.78 | 17.56 | 11.67 | 12.11 | 10.44 |
| 8 | 1.67 | 1.67 | 4.56 | 2.67 | 4.14 | 1.89 | 1.67 | 4 | 4.33 | 1.89 |
| 9 | 17 | 19.2 | 27 | 32.9 | 18.7 | 15.1 | 8.1 | 21.3 | 17.7 | 20 |
| 10 | 31.9 | 10 | 11.7 | 27.9 | 31.4 | 41.9 | 22.8 | 11.1 | 28.2 | 27.9 |
| 11 | 0 | 0 | 0 | 0 | 1.714 | 0.444 | 0.444 | 0 | 0.556 | 0.556 |
| 12 | 66.7 | 115.8 | 74.2 | 72.5 | 83.3 | 76.7 | 76.7 | 101.7 | 98.3 | 89.2 |
| 13 | 62.3 | 94.4 | 69.4 | 66.8 | 75.4 | 68.6 | 63.9 | 89.8 | 82.1 | 81.1 |
| 14 | 2.76 | 1.43 | 2.6 | 3.32 | 3.19 | 3.17 | 1.87 | 1.98 | 2.71 | 2.58 |
| 15 | 1.41 | 2.4 | 2.32 | 1.54 | 0.8 | 1.21 | 0.36 | 3.9 | 0.78 | 1.36 |
| 16 | 2 | 3 | 2.83 | 2.17 | 2 | 2.33 | 2 | 3.5 | 2.5 | 2 |
| 18 | 139.7 | 49.4 | 75.4 | 112.3 | 204.7 | 180.8 | 324.6 | 46.9 | 176.2 | 121.6 |
| 19 | 131.3 | 70.1 | 93.6 | 152.1 | 140.1 | 159.6 | 88 | 80 | 126.6 | 127.8 |
| 20 | 0.89 | 0.33 | 5.67 | 1.56 | 5.12 | 0.67 | 5.62 | 2.88 | 3 | 2.33 |
| 21 | 19.9 | 12.6 | 21.6 | 21.2 | 29.6 | 16.7 | 33.5 | 8.5 | 22.8 | 21.9 |
| 22 | 33 | 8 | 8.9 | 22.8 | 40.2 | 48.8 | 82 | 9 | 42.1 | 24.6 |
| 23 | 0 | 0 | 0 | 0 | 0.75 | 0.111 | 1.5 | 0 | 0.333 | 0.444 |
| 24 | 18.3 | 21.6 | 16.8 | 19.1 | 17.3 | 18.8 | 17.1 | 18.8 | 18.9 | 19.4 |
| 25 | 21.3 | 14.4 | 15.2 | 18.6 | 30.4 | 28 | 45.2 | 8.2 | 25.4 | 22.7 |
| 26 | 271 | 119.6 | 169 | 264.4 | 344.8 | 340.3 | 412.5 | 136 | 302.8 | 249.3 |
| 27 | 58.3 | 55.2 | 54 | 52.4 | 105 | 67 | 167.2 | 45.4 | 83.2 | 63.7 |
| 28 | 19.3 | 12 | 21.1 | 15.3 | 23.8 | 20.7 | 30.2 | 4.1 | 20.1 | 14.9 |
| 29 | 19.6 | 15.4 | 33.8 | 21.6 | 16.2 | 26.6 | 9 | 9 | 16 | 14.6 |
| 30 | 39.9 | 27.4 | 54.9 | 36.9 | 40 | 47.2 | 38.9 | 14.2 | 36.1 | 29.5 |
| 31 | 17.1 | 10.5 | 12.1 | 15.8 | 12.6 | 12.6 | 10.2 | 7.3 | 11.4 | 13.9 |
| 32 | 136.6 | 191.7 | 224.7 | 155.3 | 216.2 | 192.1 | 265 | 160.7 | 196.3 | 166.3 |
| 33 | 55.1 | 40.2 | 44 | 52.4 | 46.9 | 48.6 | 40.3 | 34.2 | 44.3 | 46.2 |
| 34 | 2.6 | 2.34 | 2.13 | 2.48 | 2.47 | 2.7 | 2.68 | 2.12 | 2.58 | 2.48 |
| 35 | 2.6 | 2.26 | 2.17 | 2.4 | 2.52 | 2.68 | 2.59 | 2.22 | 2.49 | 2.53 |
| 36 | 3.41 | 4.38 | 4.15 | 3.5 | 4.36 | 3.67 | 3.74 | 4.8 | 4.36 | 4.18 |
| 37 | 53.8 | 20.9 | 36.1 | 45.6 | 83.1 | 66.2 | 122.6 | 20.4 | 68.2 | 49.2 |
| 38 | 104.3 | 51.8 | 79.3 | 109 | 138.9 | 125.6 | 155.6 | 61 | 119 | 99.6 |
| 39 | 50.6 | 30.9 | 43.2 | 63.4 | 55.8 | 59.3 | 33 | 36.4 | 50.8 | 50.3 |

Table 116. Provided are the values of each of the parameters (as described above measured in soybean accessions (Line). Growth conditions are specified in the experimental procedure section.

TABLE 117

Measured parameters in Soybean varieties (lines 21-29)

| Corr. ID | Line-21 | Line-22 | Line-23 | Line-24 | Line-25 | Line-26 | Line-27 | Line-28 | Line-29 |
|---|---|---|---|---|---|---|---|---|---|
| 1 | 67.3 | 68.7 | 69.3 | 73.7 | 68 | 68.7 | 68 | 67 | 70.7 |
| 3 | 7.09 | 8.26 | 7.57 | 7.73 | 8.16 | 8.18 | 6.88 | 7.82 | 7.89 |
| 4 | 57 | 44.2 | 43.3 | 52.7 | 56 | 56.2 | 43.5 | 46 | 47.5 |
| 5 | 2.5 | 1.83 | 2 | 3.5 | 3.33 | 1.83 | 1.5 | 2.33 | 1.5 |
| 6 | 24.7 | 31 | 37.7 | 39 | 27.3 | 27.7 | 27.3 | 36.3 | 32.7 |
| 7 | 8 | 8 | 9 | 9.11 | 6.78 | 7.11 | 4.33 | 9.11 | 10 |
| 8 | 1.78 | 2.11 | 0.44 | 1.89 | 3.44 | 3.22 | 1.67 | 3.33 | 1.22 |
| 9 | 17.4 | 20.3 | 11.2 | 16.1 | 28.1 | 24.7 | 14.7 | 14.3 | 16.6 |
| 10 | 25.1 | 24.1 | 25.2 | 36.4 | 39.7 | 35.8 | 31.7 | 37.6 | 32.3 |
| 11 | 0.444 | 0 | 0.111 | 3.889 | 0 | 0 | 0.778 | 0.778 | 0 |
| 12 | 93.3 | 75.8 | 78.3 | 116.7 | 76.7 | 85 | 78.3 | 79.2 | 71.7 |
| 13 | 85.7 | 70.6 | 70.8 | 101.7 | 79.6 | 77.4 | 73.7 | 73.7 | 67.2 |
| 14 | 2.45 | 2.78 | 2.15 | 2.75 | 3.7 | 3.58 | 3.06 | 3.34 | 2.84 |
| 15 | 0.92 | 1.18 | 0.82 | 1.98 | 1.03 | 1.48 | 1.82 | 1.35 | 0.83 |
| 16 | 2.5 | 2.17 | 2.17 | 2.33 | 2.17 | 2.17 | 2.33 | 2.17 | 2.17 |
| 18 | 151.6 | 143 | 144 | 105.4 | 184.3 | 166.2 | 92.3 | 143.8 | 187.3 |
| 19 | 113.8 | 115.1 | 99 | 159 | 178.7 | 159.9 | 129.1 | 147.8 | 131.3 |

TABLE 117-continued

Measured parameters in Soybean varieties (lines 21-29)

| Corr. ID | Line-21 | Line-22 | Line-23 | Line-24 | Line-25 | Line-26 | Line-27 | Line-28 | Line-29 |
|---|---|---|---|---|---|---|---|---|---|
| 20 | 1.67 | 1.25 | 0.89 | 2.67 | 1.78 | 1 | 0.56 | 2.11 | 3 |
| 21 | 22.9 | 21.8 | 13.2 | 10.7 | 23.8 | 26.8 | 10.2 | 15.9 | 25.7 |
| 22 | 34.1 | 32.8 | 38.9 | 25.7 | 45 | 37.2 | 23.8 | 35.9 | 44.3 |
| 23 | 0.444 | 0 | 0 | 1.111 | 0 | 0 | 0 | 0.556 | 0 |
| 24 | 19.9 | 16.8 | 17 | 21.1 | 19.3 | 17.8 | 15.9 | 16.7 | 20.8 |
| 25 | 23 | 21.9 | 23.8 | 16.3 | 22.6 | 19.9 | 11.8 | 16 | 24.2 |
| 26 | 265.3 | 260.5 | 243 | 264.4 | 363 | 326.1 | 221.4 | 291.6 | 318.7 |
| 27 | 69.7 | 64.3 | 76.2 | 52 | 76.9 | 74.8 | 35.3 | 52.1 | 67 |
| 28 | 24.3 | 17 | 19.2 | 9.2 | 28.1 | 24.2 | 14.3 | 15.1 | 22.6 |
| 29 | 19.8 | 15.9 | 14.7 | 14.6 | 30.4 | 24.2 | 26.4 | 21.4 | 18 |
| 30 | 44.1 | 32.8 | 33.9 | 23.8 | 58.6 | 48.4 | 40.7 | 35.8 | 40.6 |
| 31 | 14.6 | 15.7 | 14.8 | 10.8 | 13 | 16.4 | 16.6 | 15.8 | 15.2 |
| 32 | 171.4 | 155.3 | 175.8 | 178.1 | 204.4 | 205.9 | 144.7 | 176.4 | 164.2 |
| 33 | 49.7 | 53.7 | 52.5 | 42.5 | 43.6 | 51.9 | 52.5 | 46.4 | 52.2 |
| 34 | 2.61 | 2.58 | 2.7 | 2.67 | 2.62 | 2.37 | 2.67 | 2.62 | 2.58 |
| 35 | 2.53 | 2.47 | 2.67 | 2.71 | 2.51 | 2.53 | 2.64 | 2.65 | 2.61 |
| 36 | 4.89 | 4.2 | 4.16 | 4.82 | 4.12 | 4.36 | 4.64 | 4.47 | 3.57 |
| 37 | 59.1 | 55.8 | 53 | 40.1 | 70.6 | 71.7 | 34.6 | 54.4 | 73 |
| 38 | 103.9 | 103.2 | 90 | 98.4 | 141.8 | 135.3 | 83.3 | 110.4 | 123.1 |
| 39 | 44.8 | 46.6 | 37 | 58.3 | 71.2 | 63.7 | 48.8 | 56 | 50.1 |

Table 117. Provided are the values of each of the parameters as described above) measured in soybean accessions (Line). Growth conditions are specified in the experimental procedure section.

TABLE 118

Correlation between the expression level of selected genes of some embodiments of the invention in various tissues and the phenotypic performance under normal conditions across soybean varieties

| Gene Name | R | P value | Exp. set | Corr. Set ID |
|---|---|---|---|---|
| LGD18 | 0.71 | 2.21E−02 | 7 | 27 |
| LGD18 | 0.70 | 1.09E−02 | 11 | 12 |
| LGD18 | 0.87 | 1.10E−03 | 8 | 23 |
| LGD19 | 0.71 | 3.31E−05 | 10 | 39 |
| LGD19 | 0.77 | 9.75E−03 | 7 | 24 |
| LGD19 | 0.77 | 3.21E−03 | 10 | 24 |
| LGD20 | 0.84 | 8.81E−03 | 9 | 33 |
| LGD21 | 0.74 | 6.38E−03 | 1 | 18 |
| LGD21 | 0.73 | 7.44E−03 | 1 | 25 |
| LGD23 | 0.71 | 2.10E−02 | 7 | 8 |
| LGD23 | 0.84 | 2.21E−03 | 8 | 5 |
| LGD23 | 0.77 | 2.50E−02 | 9 | 2 |
| LGD23 | 0.72 | 1.21E−02 | 2 | 32 |
| LGD23 | 0.91 | 2.79E−04 | 10 | 40 |
| LGD23 | 0.74 | 5.62E−03 | 4 | 27 |
| LGD23 | 0.71 | 9.07E−03 | 1 | 20 |
| LGD18 | 0.73 | 7.58E−03 | 11 | 36 |
| LGD19 | 0.80 | 1.78E−03 | 10 | 35 |
| LGD21 | 0.72 | 8.94E−03 | 1 | 37 |
| LGD18 | 0.75 | 1.26E−02 | 7 | 7 |
| LGD18 | 0.74 | 1.53E−02 | 8 | 11 |
| LGD18 | 0.72 | 4.56E−02 | 9 | 8 |
| LGD18 | 0.74 | 6.09E−03 | 10 | 15 |
| LGD19 | 0.76 | 3.99E−03 | 10 | 10 |
| LGD20 | 0.83 | 1.11E−02 | 9 | 31 |
| LGD21 | 0.76 | 4.45E−03 | 1 | 22 |
| LGD21 | 0.71 | 9.89E−03 | 1 | 27 |
| LGD21 | 0.72 | 8.03E−03 | 1 | 26 |
| LGD23 | 0.73 | 1.69E−02 | 8 | 16 |
| LGD23 | 0.84 | 2.51E−03 | 8 | 8 |
| LGD23 | 0.78 | 2.28E−02 | 9 | 1 |
| LGD23 | 0.72 | 1.24E−02 | 2 | 29 |
| LGD23 | 0.75 | 5.25E−03 | 4 | 32 |
| LGD23 | 0.74 | 5.79E−03 | 1 | 32 |
| LGD19 | 0.71 | 2.15E−02 | 11 | 40 |
| LGD19 | 0.73 | 1.73E−02 | 7 | 39 |
| LGD19 | 0.78 | 2.99E−03 | 10 | 34 |
| LGD21 | 0.70 | 1.06E−02 | 1 | 38 |
| LGD19 | 0.77 | 4.13E−02 | 9 | 40 |

Table 118. Provided are the correlations (R) between the genes expression levels in various tissues and the phenotypic performance. "Corr. Set ID"—correlation set ID according to the correlated parameters specified in Table 114. "Exp. Set"—Expression set specified in Table 113. "R" = Pearson correlation coefficient; "P" = p value.

Example 12

Production of *Arabidopsis* Transcriptome and High Throughput Correlation Analysis of Yield, Biomass and/or Vigor Related Parameters Using 44K *Arabidopsis* Full Genome Oligonucleotide Micro-Array To produce a high throughput correlation analysis comparing between plant phenotype and gene expression level, the present inventors utilized an *Arabidopsis thaliana* oligonucleotide micro-array, produced by Agilent Technologies [chem(dot)agilent(dot)com/Scripts/PDS(dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [davidmlane(dot)com/hyperstat/A34739 (dot)html].

Experimental Procedures

The *Arabidopsis* plants were grown in a greenhouse under normal (standard) and controlled growth conditions which included a temperature of 22° C., and a fertilizer [N:P:K fertilizer (20:20:20; weight ratios) of nitrogen (N), phosphorus (P) and potassium (K)].

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described above. Each microarray expression information tissue type has received a Set ID as summarized in Table 119 below.

TABLE 119

Tissues used for *Arabidopsis* transcriptome expression sets

| Expression Set | Set ID |
|---|---|
| Leaf | 1 |
| Root | 2 |
| Seed 5 DAF | 3 |
| Flower at anthesis | 4 |
| Seed 12 DAF | 5 |

Table 119: Provided are the Identification (ID) numbers of each of the *Arabidopsis* (ecotypes set 1) expression set IDs 1-5. "DAF" = days after flowering.

Yield components and vigor related parameters assessment—Nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in vertical grown transparent agar plates (seedling analysis). Most of chosen parameters were analyzed by digital imaging.

Digital Imaging for seedling analysis—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital Imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P43.0 GHz processor) and a public domain program—ImageJ 1.37, Java based image processing program, which was developed at the U.S. National Institutes of Health and is freely available on the internet at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula VI (above).

Vegetative growth rate analysis—was calculated according to Formula VII (above).

The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The vegetative portion above ground was separated from the seeds. The total weight of the vegetative portion above ground and the seed weight of each plot were measured and divided by the number of plants. Dry weight=total weight of the vegetative portion above ground (excluding roots) after drying at 30° C. in a drying chamber; Seed yield per plant=total seed weight per plant (gr.).

Oil yield—The oil yield was calculated using Formula XXIX (above).

Harvest Index (seed)—The harvest index was calculated using Formula XV (above).

Experimental Results

Nine different *Arabidopsis* ecotypes were grown and characterized for 18 parameters (named as vectors). Table 120 describes the *Arabidopsis* correlated parameters. The average for each of the measured parameter was calculated using the JMP software (Table 121) and a subsequent correlation analysis was performed (Table 122). Results were then integrated to the database.

TABLE 120

*Arabidopsis* correlated parameters (vectors)

| Correlated parameter with | Corr. ID |
|---|---|
| 1000 Seed weight [gr.], under Normal growth conditions | 1 |
| Blade circularity [ratio], under Normal growth conditions | 2 |
| Dry matter per plant [gr.], under Normal growth conditions | 3 |
| Fresh weight per plant at bolting stage [gr.], under Normal growth conditions | 4 |
| Harvest index, under Normal growth conditions | 5 |
| Lamina length [cm], under Normal growth conditions | 6 |
| Lamina width [cm], under Normal growth conditions | 7 |
| Leaf width/length [cm/cm], under Normal growth conditions | 8 |
| Oil % per seed [%], under Normal growth conditions | 9 |
| Oil yield per plant [mg], under Normal growth conditions | 10 |
| Relative root length growth day 13 [cm/day], under Normal growth conditions | 11 |
| Root length day 13 [cm], under Normal growth conditions | 12 |
| Root length day 7 [cm], under Normal growth conditions | 13 |
| Seeds per Pod [num], under Normal growth conditions | 14 |
| Seed yield per plant [gr.], under Normal growth conditions | 15 |
| Silique length [cm], under Normal growth conditions | 16 |
| Total leaf area per plant [cm$^2$], under Normal growth conditions | 17 |
| Vegetative growth rate till 8 true leaves [cm$^2$/day], under Normal growth conditions | 18 |

Table 120. Provided are the *Arabidopsis* correlated parameters (correlation ID Nos. 1-18). Abbreviations: "cm" = centimeter(s); "gr". = gram(s); "mg" = milligram(s); "num" = number.

The characterized values are summarized in Table 121 below.

TABLE 121

Measured parameters in *Arabidopsis* ecotypes

| Corr. ID | Line-1 | Line-2 | Line-3 | Line-4 | Line-5 | Line-6 | Line-7 | Line-8 | Line-9 |
|---|---|---|---|---|---|---|---|---|---|
| 1 | 0.0203 | 0.023 | 0.0252 | 0.0344 | 0.0202 | 0.0263 | 0.0205 | 0.0226 | 0.0235 |
| 2 | 0.509 | 0.481 | 0.45 | 0.37 | 0.501 | 0.376 | 0.394 | 0.491 | 0.409 |
| 3 | 0.64 | 1.27 | 1.05 | 1.28 | 1.69 | 1.34 | 0.81 | 1.21 | 1.35 |
| 4 | 1.51 | 3.61 | 1.94 | 2.08 | 3.56 | 4.34 | 3.47 | 3.48 | 3.71 |
| 5 | 0.53 | 0.35 | 0.56 | 0.33 | 0.37 | 0.32 | 0.45 | 0.51 | 0.41 |
| 6 | 2.77 | 3.54 | 3.27 | 3.78 | 3.69 | 4.6 | 3.88 | 3.72 | 4.15 |
| 7 | 1.38 | 1.7 | 1.46 | 1.37 | 1.83 | 1.65 | 1.51 | 1.82 | 1.67 |
| 8 | 0.353 | 0.288 | 0.316 | 0.258 | 0.356 | 0.273 | 0.305 | 0.335 | 0.307 |
| 9 | 34.4 | 31.2 | 38 | 27.8 | 35.5 | 32.9 | 31.6 | 30.8 | 34 |
| 10 | 118.6 | 138.7 | 224.1 | 116.3 | 218.3 | 142.1 | 114.2 | 190.1 | 187.6 |
| 11 | 0.631 | 0.664 | 1.176 | 1.089 | 0.907 | 0.774 | 0.606 | 0.701 | 0.782 |
| 12 | 4.42 | 8.53 | 5.62 | 4.83 | 5.96 | 6.37 | 5.65 | 7.06 | 7.04 |
| 13 | 0.94 | 1.76 | 0.7 | 0.73 | 0.99 | 1.16 | 1.28 | 1.41 | 1.25 |
| 15 | 0.34 | 0.44 | 0.59 | 0.42 | 0.61 | 0.43 | 0.36 | 0.62 | 0.55 |
| 14 | 45.4 | 53.5 | 58.5 | 35.3 | 48.6 | 37 | 39.4 | 40.5 | 25.5 |
| 16 | 1.06 | 1.26 | 1.31 | 1.47 | 1.24 | 1.09 | 1.18 | 1.18 | 1 |
| 17 | 46.9 | 109.9 | 58.4 | 56.8 | 114.7 | 110.8 | 88.5 | 121.8 | 93 |
| 18 | 0.313 | 0.378 | 0.484 | 0.474 | 0.425 | 0.645 | 0.43 | 0.384 | 0.471 |

Table 121: Provided are the values of each of the parameters (as described above) measured in *arabidopsis* accessions (line). Growth conditions are specified in the experimental procedure section.

TABLE 122

Correlation between the expression level of selected genes of some embodiments of the invention in various tissues and the phenotypic performance under normal conditions across *Arabidopsis* accessions

| Gene Name | R | P value | Exp. set | Corr. Set ID |
|---|---|---|---|---|
| LGD6 | 0.71 | 5.01E−02 | 1 | 7 |

Table 122. Provided are the correlations (R) between the genes expression levels in various tissues and the phenotypic performance. "Corr. Set ID"—correlation set ID according to the correlated parameters specified in Table 120. "Exp. Set"—Expression set specified in Table 119. "R" = Pearson correlation coefficient; "P" = p value.

Example 13

Production of Bean Transcriptome and High Throughput Correlation Analysis with Yield Parameters Using 60 K Bean (*Phaseolus Vulgaris* L.) Oligonucleotide Micro-Arrays In order to produce a high throughput correlation analysis, the present inventors utilized a Bean oligonucleotide microarray, produced by Agilent Technologies chem(dot)agilent (dot)com/Scripts/PDS(dot)asp?1Page=50879]. The array oligonucleotide represents about 60,000 Bean genes and transcripts. In order to define correlations between the levels of RNA expression with yield components or plant architecture related parameters or plant vigor related parameters, various plant characteristics of 40 different commercialized bean varieties were analyzed and further used for RNA expression analysis. The correlation between the RNA levels and the characterized parameters was analyzed using Pearson correlation test. [davidmlane(dot)com/hyperstat/A34739(dot)html].

Experimental Procedures

Normal (Standard) growth conditions of Bean plants included 524 m³ water per dunam (1000 square meters) per entire growth period and fertilization of 16 units nitrogen per dunam per entire growth period (normal conditions). The nitrogen can be obtained using URAN® 21% (Nitrogen Fertilizer Solution; PCS Sales, Northbrook, Ill., USA).

Analyzed Bean tissues

Six tissues [leaf, Stem, lateral stem, lateral branch flower bud, lateral branch pod with seeds and meristem] growing under normal conditions were sampled at the flowering stage, pod setting stage, and vegetative stage and RNA was extracted as described above.

For convenience, each micro-array expression information tissue type has received a Set ID as summarized in Table 123 below.

TABLE 123

Bean transcriptome expression sets

| Expression Set | Set ID |
|---|---|
| Lateral branch flower bud at Flowering stage, under Normal growth conditions | 1 |
| Lateral branch pod with seeds at pod setting stage, under Normal growth conditions | 2 |
| Lateral stem at pod setting stage, under Normal growth conditions | 3 |
| Lateral stem at Flowering stage, under Normal growth conditions | 4 |
| Leaf at pod setting stage, under Normal growth conditions | 5 |
| Leaf at Flowering stage, under Normal growth conditions | 6 |
| Leaf at vegetative growth stage, under Normal growth conditions | 7 |
| Meristem at vegetative growth stage, under Normal growth conditions | 8 |
| Stem at vegetative growth stage, under Normal growth conditions | 9 |

Table 123: Provided are the bean transcriptome expression sets. "Lateral branch flower bud" = flower bud from vegetative branch; "Lateral branch pod with seeds" = pod with seeds from vegetative branch; "Lateral stem" = stem from vegetative branch.

Bean Yield Components and Vigor Related Parameters Assessment

40 Bean varieties were grown in five repetitive plots, in field. Briefly, the growing protocol was as follows: Bean seeds were sown in soil and grown under normal conditions until harvest. Plants were continuously phenotyped during the growth period and at harvest (Table 124). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The collected data parameters were as follows:

% Canopy coverage—percent Canopy coverage at grain filling stage, R1 flowering stage and at vegetative stage. The % Canopy coverage is calculated using Formula XXXII above.

1000 seed weight [gr]—was calculated based on Formula XIV above.

Days till 50% flowering [days]—number of days till 50% flowering for each plot.

Avr shoot DW—At the end of the experiment, the shoot material was collected, measured and divided by the number of plants.

Big pods FW per plant (PS) [gr]—1 meter big pods fresh weight at pod setting divided by the number of plants.

Big pods num per plant (PS)—number of pods at development stage of R3-4 period above 4 cm per plant at pod setting.

Small pods FW per plant (PS) [gr]—1 meter small pods fresh weight at pod setting divided by the number of plants.

Small pods num per plant (PS)—number of pods at development stage of R3-4 period below 4 cm per plant at pod setting.

Pod Area [cm²]—At development stage of R3-4 period pods of three plants were weighted, photographed and images were processed using the below described image processing system. The pod area above 4 cm and below 4 cm was measured from those images and was divided by the number of pods.

Pod Length and Pod width [cm]—At development stage of R3-4 period pods of three plants were weighted, photographed and images were processed using the below described image processing system. The sum of pod lengths/or width (longest axis) was measured from those images and was divided by the number of pods.

Num of lateral branches per plant [value/plant]—number of lateral branches per plant at vegetative stage (average of two plants per plot) and at harvest (average of three plants per plot).

Relative growth rate [cm/day]: the relative growth rate (RGR) of Plant Height is calculated using Formula III.

Leaf area per plant (PS) [cm²]=Total leaf area of 3 plants in a plot at pod setting. Measurement was performed using a Leaf area-meter.

Specific leaf area (PS) [cm²/gr]—was calculated based on Formula XXXVII above.

Leaf form—Leaf length (cm)/leaf width (cm). average of two plants per plot.

Leaf number per plant (PS)—Plants were characterized for leaf number during pod setting stage. plants were measured for their leaf number by counting all the leaves of 3 selected plants per plot.

Plant height [cm]—Plants were characterized for height during growing period at 3 time points. In each measure, plants were measured for their height using a measuring tape. Height of main stem was measured from first node above ground to last node before apex.

Seed yield per area (H) [gr.]—1 meter seeds weight at harvest.

Seed yield per plant (H) [gr.]—Average seeds weight per plant at harvest in 1 meter plot.

Seeds num per area (H)—1 meter plot seeds number at harvest.

Total seeds per plant (H)—Seeds number on lateral branch per plant+Seeds number on main branch per plant at harvest. average of three plants per plot.

Total seeds weight per plant (PS) [gr.]—Seeds weight on lateral branch+Seeds weight on main branch at pod set per plant. average of three plants per plot.

Small pods FW per plant (PS)—Average small pods (below 4 cm) fresh weight per plant at pod setting per meter.

Small pods num per plant (PS)—Number of Pods below 4 cm per plant at pod setting. average of two plants per plot.

SPAD—Plants were characterized for SPAD rate during growing period at grain filling stage and vegetative stage. Chlorophyll content was determined using a Minolta SPAD 502 chlorophyll meter and measurement was performed 64 days post sowing. SPAD meter readings were done on young fully developed leaf. Three measurements per leaf were taken per plot.

Stem width (R2F) [m]—width of the stem of the first node at R2 flowering stage. average of two plants per plot.

Total pods num per plant (H), (PS)—Pods number on lateral branch per plant+Pods number on main branch per plant at pod setting and at harvest, average of three plants per plot.

Total pods DW per plant (H) [gr]—Pods dry weight on main branch per plant+Pods dry weight on lateral branch per plant at harvest, average of three plants per plot.

Total pods FW per plant (PS) [gr]—Average pods fresh weight on lateral branch+Pods weight on main branch at pod setting.

Pods weight per plant (RP) (H) [gr]—Average pods weight per plant at harvest in 1 meter.

Total seeds per plant (H), (PS)—Seeds number on lateral branch per plant+Seeds number on main branch per plant at pod setting and at harvest, average of three plants per plot.

Total seeds num per pod (H), (PS)—Total seeds num per plant divided in total pods num per plant. average of three plants per plot.

Vegetative FW and DW per plant (PS) [gr/plant]—total weight of the vegetative portion above ground (excluding roots and pods) before and after drying at 70° C. in oven for 48 hours at pod set, average of three plants per plot.

Vigor till flowering [g/day]—Relative growth rate (RGR) of shoot DW=Regression coefficient of shoot DW along time course (two measurements at vegetative stage and one measurement at flowering stage).

Vigor post flowering [g/day]—Relative growth rate (RGR) of shoot DW=Regression coefficient of shoot DW measurements along time course (one measurement at flowering stage and two measurements at grain filling stage).

Experimental Results 40 different bean varieties lines 1-40 were grown and characterized for 36 parameters as specified below. Among the 40 varieties, 16 varieties were selected for expression analysis. The average for each of the measured parameters was calculated using the JMP software and values are summarized in Tables 125-126 below. Subsequent correlation analysis between the various transcriptome sets and the average parameters was conducted (Table 127). Follow, results were integrated to the database.

TABLE 124

Bean correlated parameters (vectors)

| Correlated parameter with | Correlation ID |
|---|---|
| Avr. shoot DW [gr.], under normal growth conditions | 1 |
| Big pods FW per plant (PS) [gr.], under normal growth conditions | 2 |
| Big pods num per plant (PS) [num], under normal growth conditions | 3 |
| % Canopy coverage [%], under normal growth conditions | 4 |
| Days till 50% flowering [days], under normal growth conditions | 5 |
| Leaf area per plant (PS) [cm²], under normal growth conditions | 6 |
| Leaf form, under normal growth conditions | 7 |
| Leaf number per plant (PS) [num], under normal growth conditions | 8 |
| Num of lateral branches per plant [value/plant], under normal growth conditions | 9 |
| Plant height (GF) [cm], under normal growth conditions | 10 |
| Plant height (V2-V3) [cm], under normal growth conditions | 11 |
| Plant height(V4-V5) [cm], under normal growth conditions | 12 |
| Pod Area [cm2], under normal growth conditions | 13 |
| Pod Length [cm], under normal growth conditions | 14 |
| Pods weight per plant (RP) (H) [gr.], under normal growth conditions | 15 |
| Pod width [cm], under normal growth conditions | 16 |
| Seeds num per area (H) [num/cm²], under normal growth conditions | 17 |
| Seed yield per area (H) [gr.], under normal growth conditions | 18 |
| Seed yield per plant (H) [gr.], under normal growth conditions | 19 |
| Small pods FW per plant (PS) [gr.], under normal growth conditions | 20 |
| Small pods num per plant (PS) [num], under normal growth conditions | 21 |
| SPAD (GF) [SPAD unit], under normal growth conditions | 22 |
| SPAD (V) [SPAD unit], under normal growth conditions | 23 |
| Specific leaf area (PS) [cm²/gr.], under normal growth conditions | 24 |
| Stem width (R2F)[mm], under normal growth conditions | 25 |
| Total pods DW per plant (H) [gr.], under normal growth conditions | 26 |
| Total pods FW per plant (PS) [gr.], under normal growth conditions | 27 |
| Total pods num per plant (H), (PS) [num], under normal growth conditions | 28 |
| Total seeds num per pod (H) [num], under normal growth conditions | 29 |
| Total seeds num per pod (PS) [num], under normal growth conditions | 30 |
| Total seeds per plant (H) [num], under normal growth conditions | 31 |
| Total seeds weight per plant (PS) [gr.], under normal growth conditions | 32 |
| Vegetative DW per plant (PS) [gr./plant], under normal growth conditions | 33 |
| Vegetative FW per plant (PS) [gr./plant], under normal growth conditions | 34 |
| Vigor post flowering [gr./day], under normal growth conditions | 35 |
| Vigor till flowering [gr./day], under normal growth conditions | 36 |

Table 124. Provided are the Bean correlated parameters (vectors). "Avr." = average; "gr." = grams; "SPAD" = chlorophyll levels; "PAR" = Photosynthetically active radiation; "FW" = Plant Fresh weight; "normal" = standard growth conditions; "H" = harvest; "PS" = pod setting; "V" = vegetative stage; "H" = harvest stage; "GF" = grain filling stage; "PS" = pod setting; "num" = number.

TABLE 125

Measured parameters in bean varieties (lines 1-8)

| Corr. ID | Line-1 | Line-2 | Line-3 | Line-4 | Line-5 | Line-6 | Line-7 | Line-8 |
|---|---|---|---|---|---|---|---|---|
| 4 | 89.6 | 82.8 | 66.4 | 78.9 | 79.3 | 72.3 | 82.8 | 90.5 |
| 1 | 16.2 | 28.6 | 14 | 18.7 | 23.2 | 19.3 | 18.4 | 27.8 |
| 2 | NA | NA | NA | 67.4 | NA | 38.2 | NA | 76.4 |
| 3 | 24.2 | 36 | 25.2 | 35.2 | 19.5 | 65 | 28.5 | 26.5 |
| 5 | 55 | 55 | 55 | 55 | 48 | 55 | 55 | 48 |
| 6 | 211.7 | 242.1 | 183 | 307.1 | 306.5 | 133.1 | 253.1 | 308.1 |
| 7 | 1.64 | 1.59 | 1.53 | 1.32 | 1.59 | 1.58 | 1.47 | 1.56 |
| 8 | 4.73 | 4.67 | 4.67 | 6.07 | 5 | 4.73 | 5 | 6.17 |
| 9 | 7.93 | 6.06 | 7 | 6.2 | 7.27 | 7.93 | 6.93 | 7 |
| 10 | 36.8 | 32 | 30.8 | 34.8 | 34.4 | 31.5 | 51.7 | 37.7 |
| 11 | 4.39 | 5.81 | 4.53 | 4.8 | 5.19 | 3.67 | 6.41 | 5.75 |
| 12 | 11.4 | 10.6 | 8.3 | 11.2 | 14.8 | 7.6 | 17.5 | 16.6 |
| 13 | 6.53 | 7.6 | 9.59 | 4.29 | 5.83 | 3.69 | 8.53 | 8.04 |
| 14 | 11 | 10.5 | 13.4 | 7.7 | 9.6 | 8.3 | 13.1 | 11.3 |
| 16 | 0.714 | 0.75 | 0.872 | 0.593 | 0.579 | 0.48 | 0.732 | 0.825 |
| 15 | 11.7 | 20.3 | 15.1 | 15.2 | 20.2 | 16 | 14.4 | 23.1 |
| 22 | 40.2 | 38.4 | 34.5 | 36.2 | 38.6 | 37.7 | 40.5 | NA |
| 23 | 36 | 40 | 30.8 | 39.4 | 33.7 | 31.4 | 35.4 | 40.1 |
| 18 | 342.4 | 243.2 | 284.4 | 457.2 | 493.7 | 196.7 | 457.7 | 430.6 |
| 19 | 6.31 | 4.73 | 8.7 | 8.29 | 9.28 | 4.53 | 8.4 | 9.2 |
| 17 | 3635.2 | 1588.7 | 1958.3 | 3879.6 | 3207.6 | 2875.2 | 3218.2 | 3485.8 |
| 20 | 0.62 | 2.16 | 1.52 | 2.06 | 0.72 | 1.15 | 0.87 | 0.6 |
| 21 | 0.5 | 3.75 | 0.25 | 6 | 4.75 | 9.5 | 1.75 | 1.5 |
| 24 | 226.3 | 226.1 | 211.4 | 222.3 | 207.3 | 213 | 201 | 207.3 |
| 25 | 5.79 | 5.65 | 6.14 | 5.84 | 6.01 | 5.39 | 6.1 | 5.83 |
| 26 | 12.8 | 15.6 | 15.4 | 20.7 | 16.5 | 13.9 | 19.2 | 30.4 |
| 27 | 33 | 122.7 | 60.4 | 105 | 40.2 | 61.1 | 50.4 | 33.1 |
| 28 | 27.1 | 19.4 | 17.6 | 24.7 | 17.9 | 46.1 | 18.5 | 38.3 |
| 29 | 3.32 | 3.32 | 3.92 | 4.68 | 3.94 | 2.81 | 4.46 | 3.93 |
| 30 | 2.64 | 2.22 | 3.94 | 2.35 | 4.13 | 1.02 | 3.66 | 0.63 |
| 31 | 90.5 | 64.2 | 70.2 | 111 3 | 67.7 | 128.6 | 81 | 151.8 |
| 32 | 87.6 | 51.9 | 117.2 | 79 | 68.9 | 29.4 | 92.6 | 9.2 |
| 33 | 16.3 | NA | 14.8 | 13.5 | 11.4 | 18.8 | 16.4 | 12.6 |
| 34 | 91.6 | 62.4 | 81.5 | 65.6 | 64.5 | 61.8 | 85.8 | 71.1 |
| 35 | 0.92 | 1.26 | 1.04 | 2.03 | 1.97 | 1.67 | 0.87 | 0.84 |
| 36 | 0.444 | 0.607 | 0.268 | 0.456 | 0.52 | 0.352 | 1.098 | 1.183 |

Table 125. Provided are the values of each of the parameters (as described above) measured in Bean accessions (Line). Growth conditions are specified in the experimental procedure section.

TABLE 126

Measured parameters in bean varieties (lines 9-16)

| Corr. ID | Line-9 | Line-10 | Line-11 | Line-12 | Line-13 | Line-14 | Line-15 | Line-16 |
|---|---|---|---|---|---|---|---|---|
| 4 | 76.9 | 76.7 | 85.9 | 82.1 | 77.8 | 73.8 | 76.4 | 71.7 |
| 1 | 15.8 | 31.4 | 26.4 | 24.7 | 20.1 | 14.4 | 18 | 22.6 |
| 2 | NA | NA | NA | NA | NA | 49.4 | 43.7 | 71.5 |
| 3 | 39.2 | 33.2 | 31 | 28.2 | 35.2 | 38.8 | 35.5 | 28 |
| 5 | 55 | 48 | 55 | 55 | 55 | 55 | 55 | 55 |
| 6 | 161.6 | 193.3 | 145.6 | 204.9 | 194.5 | 157.5 | 155 | 194.4 |
| 7 | 1.46 | 1.4 | 1.55 | 1.51 | 1.45 | 1.53 | 1.52 | 1.58 |
| 8 | 3.21 | 4.47 | 4 | 4.2 | 4.73 | 5 | 5.42 | 4.11 |
| 9 | 7.6 | 7.6 | 5.73 | 6.47 | 6.87 | 9.67 | 7.53 | 7.58 |
| 10 | 43.7 | 34.6 | 32.9 | 38.3 | 37.6 | 28.9 | 39.8 | 33 |
| 11 | 6.25 | 7.1 | 5.16 | 5.95 | 5.94 | 3.92 | 4.5 | 5.85 |
| 12 | 14.1 | 14.4 | 10.4 | 13.2 | 12.1 | 8.4 | 9.7 | 11.2 |
| 13 | 6.95 | 6.62 | 8.59 | 7.34 | 7.29 | 5.73 | 5.7 | 10.09 |
| 14 | 10.1 | 10 | 11.6 | 10.7 | 10.5 | 11 | 9.1 | 11.8 |
| 16 | 0.723 | 0.627 | 0.835 | 0.728 | 0.775 | 0.619 | 0.679 | 0.871 |
| 15 | 14.9 | 17.8 | 13.5 | 11.9 | 14.5 | 17.1 | 15.1 | 20.4 |
| 22 | 43.6 | NA | 40.8 | 41.6 | 44.5 | 39.4 | NA | NA |
| 23 | 30.4 | 38.6 | 37.5 | 36.3 | 35.1 | 35.8 | 35 | 35.7 |
| 18 | 528.8 | 449.3 | 403.1 | 381.9 | 521.6 | 198.1 | 371.1 | 260 |
| 19 | 9.46 | 10.86 | 8.19 | 6.86 | 8.72 | 4.02 | 6.55 | 6.99 |
| 17 | 3534 | 2342.2 | 3232.8 | 2522.4 | 3492.6 | 3012.2 | 3953.8 | 1768.2 |
| 20 | 1.57 | 0 | 1.22 | 1.68 | 1.76 | 0.8 | 1.27 | 1.79 |
| 21 | 6 | 6 | 1.5 | 1.75 | 4.5 | 1 | 5 | 3.5 |

TABLE 126-continued

Measured parameters in bean varieties (lines 9-16)

| Corr. ID | Line-9 | Line-10 | Line-11 | Line-12 | Line-13 | Line-14 | Line-15 | Line-16 |
|---|---|---|---|---|---|---|---|---|
| 24 | 218.9 | 205.6 | 187.8 | 243 | 169.3 | 257.8 | 238.2 | 208.4 |
| 25 | 5.69 | 5.99 | 5.67 | 5.5 | 5.26 | 4.91 | 6 | 6.04 |
| 26 | 19.1 | 29.8 | 24.1 | 15.1 | 13.1 | 15.3 | 10.8 | 26 |
| 27 | 92.9 | 3.3 | 66.4 | 97.9 | 105.6 | 41.2 | 81.8 | 67.2 |
| 28 | 22.5 | 24.5 | 22.3 | 18.4 | 15.8 | 38.3 | 18.9 | 24.2 |
| 29 | 3.54 | 3.85 | 5.33 | 4 | 3.91 | 3.09 | 3.77 | 3.78 |
| 30 | 3.58 | 1.45 | 4.82 | 3.54 | 3.5 | 1.61 | 0.81 | 0.74 |
| 31 | 77.4 | 95.9 | 120.8 | 72.5 | 60.4 | 138.2 | 70.5 | 92.2 |
| 32 | 79.8 | 29.2 | 96.7 | 88.4 | 87.9 | 77.9 | 20 | 14 |
| 33 | 13.7 | NA | 18.3 | 14.8 | 14.5 | 17 | 10 | 7.1 |
| 34 | 74.9 | 57.6 | 87.5 | 74.5 | 68.2 | 77.5 | 56.8 | 70 |
| 35 | 0.95 | 1.31 | 2.16 | 1.46 | 1.04 | 1.35 | NA | NA |
| 36 | 0.51 | 0.506 | 0.633 | 0.516 | 0.544 | 0.38 | 0.39 | 1.157 |

Table 126. Provided are the values of each of the parameters (as described above) measured in bean accessions (Line). Growth conditions are specified in the experimental procedure section.

TABLE 127

Correlation between the expression level of selected genes of some embodiments of the invention in various tissues and the phenotypic performance under normal conditions across "fine" and "extra fine" bean varieties

| Gene Name | R | P value | Exp. set | Corr. Set ID | Gene Name | R | P value | Exp. set | Corr. Set ID |
|---|---|---|---|---|---|---|---|---|---|
| LGD3 | 0.73 | 2.35E−04 | 4 | 24 | LGD9 | 0.71 | 2.42E−04 | 7 | 19 |
| LGD9 | 0.75 | 6.56E−05 | 7 | 18 | | | | | |

Table 127. Provided are the correlations (R) between the genes expression levels in various tissues and the phenotypic performance.
"Corr. Set ID"—correlation set ID according to the correlated parameters specified in Table 167.
"Exp. Set"—Expression set specified in Table 166.
"R" = Pearson correlation coefficient;
"P" = p value.

Example 14

Production of Foxtail Millet Transcriptome and High Throughput Correlation Analysis Using 60 K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [chem(dot)agilent(dot)com/Scripts/PDS(dot)asp?1Page=50879]. The array oligonucleotide represents about 60K foxtail millet genes and transcripts. In order to define correlations between the levels of RNA expression and yield or vigor related parameters, various plant characteristics of 14 different foxtail millet accessions were analyzed. Among them, 11 accessions encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

Fourteen Foxtail millet accessions in 5 repetitive plots, in the field. Foxtail millet seeds were sown in soil and grown under normal condition [15 units of Nitrogen (kg nitrogen per dunam)], reduced nitrogen fertilization (2.5-3.0 units of Nitrogen in the soil (based on soil measurements) and reduced stands in the field [i.e., 8 plants per meter per row as compared to "standard" stands of 17 plants per meter row].

Analyzed Foxtail millet tissues—seven tissues [leaf, flower, head, root, stem node, stem and vein] at different developmental stages, representing different plant characteristics, were sampled and RNA was extracted as described above. Each micro-array expression information tissue type has received a Set ID as summarized in Tables 128-129 below.

TABLE 128

Foxtail millet transcriptome expression sets under normal conditions

| Expression Set | Set ID |
|---|---|
| Flag leaf at grain filling stage, under normal growth conditions | 1 |
| Flag leaf at heading stage, under normal growth conditions | 2 |
| Flower at heading stage, under normal growth conditions | 3 |
| Head at grain filling stage, under normal growth conditions | 4 |
| Leaf at seedling stage, under normal growth conditions | 5 |
| Low stem at heading stage, under normal growth conditions | 6 |
| Mature leaf at grain filling stage, under normal growth conditions | 7 |
| Root at seedling stage, under normal growth conditions | 8 |
| Stem at seedling stage, under normal growth conditions | 9 |
| Stem node at grain filling stage, under normal growth conditions | 10 |
| Up stem at grainfilling stage, under normal growth conditions | 11 |
| Up stem at heading stage, under normal growth conditions | 12 |
| Vein at grain filling stage, under normal growth conditions | 13 |

Table 128. Provided are the foxtail millet transcriptome expression sets under normal conditions.

TABLE 129

Foxtail millet transcriptome expression sets under low N conditions

| Expression Set | Set ID |
|---|---|
| Flag leaf at grainfilling stage, under low nitrogen growth conditions | 1 |
| Flag leaf at heading stage, under low nitrogen growth conditions | 2 |
| Flower at heading stage, under low nitrogen growth conditions | 3 |
| Head at grainfilling stage, under low nitrogen growth conditions | 4 |
| Low stem at heading stage, under low nitrogen growth conditions | 5 |
| Mature leaf at grainfilling stage, under low nitrogen growth conditions | 6 |
| Stem node at grainfilling stage, under low nitrogen growth conditions | 7 |
| Up stem at grainfilling stage, under low nitrogen growth conditions | 8 |
| Up stem at heading stage, under low nitrogen growth conditions | 9 |
| Vein at grainfilling stage, under low nitrogen growth conditions | 10 |

Table 129. Provided are the foxtail millet transcriptome expression sets under low N conditions Foxtail millet yield components and vigor related parameters assessment—Plants were continuously phenotyped during the growth period and at harvest (Tables 130-131, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the plant 'Head' and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length and width (cm)—A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area ($cm^2$)—The 'Head' area was measured from those images and was divided by the number of 'Heads'.

(ii) Head Average Length (mm)—The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot (SP) or by measuring the parameter across all the plants within the plot (RP).

Total Grain Weight (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Head weight and head number—At the end of the experiment, heads were harvested from each plot and were counted and weighted (kg.).

Biomass at harvest—At the end of the experiment the vegetative material from plots was weighted.

Dry weight—total weight of the vegetative portion above ground (excluding roots) after drying at 70° C. in oven for 48 hours at harvest.

Total dry mater per plot—Calculated as Vegetative portion above ground plus all the heads dry weight per plot.

Num days to anthesis—Calculated as the number of days from sowing till 50% of the plot arrives anthesis.

Total No. of tillers—all tillers were counted per plot at two time points at the Vegetative growth (30 days after sowing) and at harvest.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—one plant per plot (5 repeated plots) were selected for measurement of root weight, root length and for counting the number of lateral roots formed.

Shoot FW (fresh weight)—weight of one plant per plot were recorded at different time-points.

Grain N (H)—% N content of dry matter in the grain at harvest.

Head N (GF)—% N content of dry matter in the head at grain filling.

Total shoot N—calculated as the % N (Nitrogen) content multiplied by the weight of plant shoot Total grain N—calculated as the % N (Nitrogen) content multiplied by the weight of plant grain yield.

NUE [kg/kg]—was calculated based on Formula LI.
NUpE [kg/kg]—was calculated based on Formula LII.
Grain NUtE—was calculated based on Formula LV.
Total NUtE was calculated based on Formula LIII.
Stem volume—was calculated based on Formula L above.
Stem density—was calculated based on Formula LIV.

Maintenance of performance under low N conditions—Represent ratio for the specified parameter of low N condition results divided by Normal conditions results (maintenance of phenotype under low N in comparison to normal conditions).

Data parameters collected are summarized in Tables 130-131 herein below

TABLE 130

Foxtail millet correlated parameters under normal and low N conditions (vectors) - set 1

| Correlated parameter with | Correlation ID |
|---|---|
| Average Grain Area [$cm^2$] | 1 |
| Average Grain Length [cm] | 2 |
| Head number (SP) [num], | 3 |
| Head weight (RP) [kg] | 4 |

TABLE 130-continued

Foxtail millet correlated parameters under normal and low N conditions (vectors) - set 1

| Correlated parameter with | Correlation ID |
|---|---|
| Head weight (SP) [kg] | 5 |
| No. of lateral roots [num] | 6 |
| Root length [cm] | 7 |
| SPAD [SPAD unit] | 8 |

Table 130. Provided are the foxtail millet collected parameters under normal and low N conditions.
"num" = number
"cm" = centimeter;
"SPAD" = chlorophyll levels;
"SP" = selected plants;
"RP" = rest of the plot;
"kg" = kilogram."

TABLE 131

Foxtail millet additional correlated parameters under normal and low N conditions (vectors) - set 2

| Correlated parameter with | Correlation ID |
|---|---|
| Grain N (H) [%] | 1 |
| Grain NUtE [Float value] | 2 |

TABLE 131-continued

Foxtail millet additional correlated parameters under normal and low N conditions (vectors) - set 2

| Correlated parameter with | Correlation ID |
|---|---|
| NUE [kg/kg] | 3 |
| NUpE [kg/kg] | 4 |
| Total grain N [mg] | 5 |
| Total NUtE [Float value] | 6 |
| Total shoot N [mg] | 7 |

Table 131. Provided are the foxtail millet collected parameters under normal and low N conditions.
"N" = nitrogen;
"NutE" = Nitrogen utilization efficiency;
"NUE" = Nitrogen use efficiency;
"NupE" = Nitrogen uptake efficiency;
"mg" = milligram.

Experimental Results

Fourteen different foxtail millet accessions were grown and characterized for different parameters as described above. The average for each of the measured parameters was calculated using the JMP software and values are summarized in Tables 132-139 below. Subsequent correlation analysis between the various transcriptome sets and the average parameters was conducted (Tables 140-143). Follow, results were integrated to the database.

TABLE 132

Measured parameters of correlation IDs in foxtail millet accessions under normal conditions (set 1 parameters)

| Corr. ID | Line-1 | Line-2 | Line-3 | Line-4 | Line-5 | Line-6 | Line-7 |
|---|---|---|---|---|---|---|---|
| 1 | 0.0357 | 0.0295 | 0.0308 | 0.0315 | 0.0341 | 0.0339 | 0.0243 |
| 2 | 0.245 | 0.256 | 0.256 | 0.251 | 0.268 | 0.274 | 0.197 |
| 3 | 7.2 | 94 | 87.6 | 295.4 | 114 | 122.4 | 29.8 |
| 4 | 1.306 | 0.865 | 0.888 | 1.069 | 1.022 | 0.984 | 1.103 |
| 5 | 0.181 | 0.104 | 0.117 | 0.245 | 0.213 | 0.227 | 0.222 |
| 6 | NA | NA | NA | NA | NA | NA | NA |
| 7 | NA | NA | NA | NA | NA | NA | NA |
| 8 | 60.8 | NA | NA | 54.7 | 49.9 | 57.5 | 58.6 |

Table 132: Provided are the values of each of the parameters (as described above) measured in Foxtail millet accessions (Line). Growth conditions are specified in the experimental procedure section.
"NA" = not available

TABLE 133

Measured parameters of correlation IDs in additional foxtail millet accessions under normal conditions (set 1 parameters)

| Corr. ID | Line-8 | Line-9 | Line-10 | Line-11 | Line-12 | Line-13 | Line-14 |
|---|---|---|---|---|---|---|---|
| 1 | 0.0295 | 0.0319 | 0.0263 | 0.0262 | 0.0338 | 0.0303 | 0.0372 |
| 2 | 0.242 | 0.23 | 0.212 | 0.221 | 0.259 | 0.241 | 0.272 |
| 1 | 129.2 | 11 | 13.2 | 53.6 | 32.8 | 60.6 | 323.2 |
| 4 | 0.984 | 1.286 | 1.035 | 0.421 | 0.999 | 0.99 | 1.023 |
| 5 | 0.244 | 0.296 | 0.178 | 0.101 | 0.224 | 0.244 | 0.231 |
| 6 | NA | NA | NA | NA | NA | NA | NA |
| 7 | NA | NA | NA | NA | NA | NA | NA |
| 8 | 55.4 | 55 | NA | NA | NA | NA | 55.9 |

Table 133: Provided are the values of each of the parameters (as described above) measured in Foxtail millet accessions (Line). Growth conditions are specified in the experimental procedure section.
"NA" = not available

TABLE 134

Additional measured parameters of correlation IDs in foxtail millet accessions under normal conditions (Set 2 parameters)

| Corr. ID | Line-1 | Line-2 | Line-3 | Line-4 | Line-5 | Line-6 | Line-7 |
|---|---|---|---|---|---|---|---|
| 1 | 1.77 | 2.36 | NA | 1.98 | 2.07 | 2.13 | 2.13 |
| 2 | 0.556 | 0.286 | NA | 0.677 | 0.595 | 0.673 | 0.673 |
| 3 | 1.83 | 1.21 | 1.31 | 1.64 | 1.4 | 1.49 | 1.84 |
| 4 | 35.5 | 32.9 | NA | 34.7 | 31.4 | 33.9 | 41.8 |
| 6 | 0.1008 | 0.1214 | NA | 0.0862 | 0.0824 | 0.0805 | 0.0841 |
| 5 | 612.8 | 543.7 | NA | 613.7 | 551.8 | 602 | 742.8 |

Table 134: Provided are the values of each of the parameters (as described above) measured in Foxtail millet accessions (Line). Growth conditions are specified in the experimental procedure section.
"NA" = not available

TABLE 135

Additional measured parameters of correlation IDs in additional foxtail millet accessions under normal conditions (set 2 parameters)

| Corr. ID | Line-8 | Line-9 | Line-10 | Line-11 | Line-12 | Line-13 | Line-14 |
|---|---|---|---|---|---|---|---|
| 1 | NA | 1.79 | 3.05 | NA | 1.85 | NA | 1.97 |
| 2 | NA | 0.755 | 0.251 | NA | 0.5 | NA | 0.328 |
| 3 | 1.39 | 2.54 | 1.18 | 0.49 | 1.66 | 1.58 | 1.58 |
| 4 | NA | 48.9 | 40.6 | 0 | 34 | NA | 35.9 |
| 6 | NA | 0.0972 | 0.1245 | NA | 0.1283 | NA | 0.0953 |
| 5 | NA | 865 | 682.1 | NA | 583.6 | NA | 590.9 |

Table 135: Provided are the values of each of the parameters (as described above) measured in Foxtail millet accessions (Line). Growth conditions are specified in the experimental procedure section.
"NA" = not available

TABLE 136

Measured parameters of correlation IDs in foxtail millet accessions under low N conditions (set 1 parameters)

| Corr. ID | Line-1 | Line-2 | Line-3 | Line-4 | Line-5 | Line-6 | Line-7 |
|---|---|---|---|---|---|---|---|
| 1 | 0.0356 | 0.0299 | 0.0311 | 0.0324 | 0.0339 | 0.0343 | 0.024 |
| 2 | 0.245 | 0.256 | 0.261 | 0.253 | 0.266 | 0.275 | 0.195 |
| 1 | 8.2 | 57 | 64.6 | 214 | 69.2 | 117.8 | 31.8 |
| 4 | 1.178 | 0.807 | 1.168 | 1.065 | 0.879 | 0.768 | 0.761 |
| 5 | 0.18 | 0.157 | 0.184 | 0.229 | 0.168 | 0.187 | 0.143 |
| 6 | NA | NA | NA | NA | NA | NA | NA |
| 7 | NA | NA | NA | NA | NA | NA | NA |

Table 136: Provided are the values of each of the parameters (as described above measured in Foxtail millet accessions (Line). Growth conditions are specified in the experimental procedure section.
"NA" = not available.

TABLE 137

Measured parameters of correlation IDs in additional .foxtail millet accessions under low N conditions (set 1 parameters)

| Corr. ID | Line-8 | Line-9 | Line-10 | Line-11 | Line-12 | Line-13 | Line-14 |
|---|---|---|---|---|---|---|---|
| 1 | 0.0303 | 0.0325 | 0.0257 | 0.0277 | 0.0353 | 0.0321 | 0.0373 |
| 2 | 0.246 | 0.228 | 0.212 | 0.227 | 0.26 | 0.249 | 0.276 |
| 3 | 99.2 | 7 | 14.6 | 30.8 | 28.8 | 68.2 | 215.2 |
| 4 | 0.781 | 1.144 | 1.067 | 0.805 | 1.013 | 1.087 | 0.824 |

TABLE 137-continued

Measured parameters of correlation IDs in additional foxtail millet accessions under low N conditions (set 1 parameters)

| Corr. ID | Line-8 | Line-9 | Line-10 | Line-11 | Line-12 | Line-13 | Line-14 |
|---|---|---|---|---|---|---|---|
| 5 | 0.177 | 0.242 | 0.207 | 0.121 | 0.241 | 0.263 | 0.169 |
| 6 | NA | NA | NA | NA | NA | NA | NA |
| 7 | NA | NA | NA | NA | NA | NA | NA |

Table 137: Provided are the values of each of the parameters (as described above) measured in Foxtail millet accessions (Line). Growth conditions are specified in the experimental procedure section.
"NA" = not available.

TABLE 138

Measured parameters of correlation IDs in foxtail millet accessions under low N conditions (set 2 parameters)

| Corr. ID | Line-1 | Line-2 | Line-3 | Line-4 | Line-5 | Line-6 | Line-7 |
|---|---|---|---|---|---|---|---|
| 1 | NA | 2.03 | 1.86 | 1.6 | 1.59 | 1.97 | NA |
| 2 | NA | 0.414 | 0.729 | 0.737 | 0.853 | 0.739 | NA |
| 3 | 29.9 | 20.5 | 34.4 | 29.7 | 22.3 | 23 | 22.6 |
| 4 | NA | 464.8 | 688.2 | 516.1 | 380 | 484.9 | NA |
| 6 | NA | 0.1213 | 0.1036 | 0.0996 | 0.0996 | 0.0874 | NA |
| 5 | NA | 415.3 | 641 | 475.7 | 353.9 | 453.8 | NA |
| 7 | NA | 49.5 | 47.2 | 40.4 | 26.2 | 31.1 | NA |

Table 138: Provided are the values of each of the parameters (as described above) measured in Foxtail millet accessions (Line). Growth conditions are specified in the experimental procedure section.
"NA" = not available.

TABLE 139

Measured parameters of correlation IDs in additional foxtail millet accessions under low N conditions (set 2 parameters)

| Corr. ID | Line-8 | Line-9 | Line-10 | Line-11 | Line-12 | Line-13 | Line-14 |
|---|---|---|---|---|---|---|---|
| 1 | 2.26 | 1.43 | 1.76 | NA | 1.81 | NA | 1.94 |
| 2 | 0.775 | 0.866 | 0.355 | NA | 0.718 | NA | 0.465 |
| 3 | 20.7 | 37.1 | 25.4 | 21 | 34 | 34.8 | 26.2 |
| 4 | 493.5 | 572.8 | 517.9 | 0 | 661.9 | NA | 565.2 |
| 6 | 0.073 | 0.1155 | 0.164 | NA | 0.1196 | NA | 0.0972 |
| 5 | 466.8 | 529.9 | 446.5 | NA | 614.6 | NA | 508.8 |
| 7 | 26.7 | 42.8 | 71.5 | NA | 47.3 | NA | 56.4 |

Table 139: Provided are the values of each of the parameters (as described above) measured in Foxtail millet accessions (Line). Growth conditions are specified in the experimental procedure section.
"NA" = not available.

TABLE 140

Correlation between the expression level of selected genes of some embodiments of the invention in various tissues and the phenotypic performance under normal conditions (set 1 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LGB2 | 0.73 | 1.66E−02 | 12 | 3 | LGB4 | 0.83 | 2.70E−03 | 3 | 3 |
| LGB4 | 0.78 | 7.37E−03 | 11 | 3 | LGB4 | 0.75 | 1.20E−02 | 1 | 5 |

Table 140. Provided are the correlations (R) between the genes expression levels in various tissues and the phenotypic performance.
"Corr. Set ID"—correlation set ID according to the correlated parameters specified in Table 130.
"Exp. Set"—Expression set specified in Table 128.
"R" = Pearson correlation coefficient;
"P" = p value

TABLE 141

Correlation between the expression level of selected genes of some embodiments of the invention in various tissues and the phenotypic performance under normal conditions (set 2 parameters) across Foxtail millet varieties

| Gene Name | R | P value | Exp. set | Corr. Set ID | Gene Name | R | P value | Exp set | Corr. Set ID |
|---|---|---|---|---|---|---|---|---|---|
| LGB2 | 0.75 | 1.93E−02 | 4 | 1 | LGB2 | 0.93 | 2.21E−03 | 2 | 6 |
| LGB2 | 0.84 | 9.67E−03 | 11 | 1 | LGB2 | 0.76 | 2.72E−02 | 11 | 6 |
| LGB5 | 0.72 | 4.35E−02 | 5 | 1 | LGB5 | 0.72 | 4.34E−02 | 11 | 1 |
| LGB5 | 0.72 | 4.21E−02 | 9 | 1 | | | | | |

Table 141 Provided are the correlations (R) between the genes expression levels in various tissues and the phenotypic performance.
"Corr. Set ID"—correlation set ID according to the correlated parameters specified in Table 131.
"Exp. Set"—Expression set specified in Table 128.
"R" = Pearson correlation coefficient;
"P" = p value.

TABLE 142

Correlation between the expression level of selected genes of some embodiments of the invention in various tissues and the phenotypic performance under low N conditions (set 2 parameters) across Foxtail millet varieties

| Gene Name | R | P value | Exp. set | Corr. Set ID |
|---|---|---|---|---|
| LGB5 | 0.74 | 1.54E−02 | 4 | 7 |

Table 162. Provided are the correlations (R) between the genes expression levels in various tissues and the phenotypic performance.
"Corr. Set ID"—correlation set ID according to the correlated parameters specified in Table 131.
"Exp. Set"—Expression set specified in Table 129.
"R" = Pearson correlation coefficient;
"P" = p value.

TABLE 143

Correlation between the expression level of selected genes of some embodiments of the invention in various tissues and the phenotypic performance under low N conditions (set 1 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LGB4 | 0.85 | 1.67E−03 | 9 | 3 | LGB4 | 0.80 | 5.19E−03 | 2 | 3 |

Table 143. Provided are the correlations (R) between the genes expression levels in various tissues and the phenotypic performance.
"Corr Set ID"—correlation set ID according to the correlated parameters specified in Table 130 and expression sets of Table 129;
"P" = p value.

Example 15

Production of Cotton Transcriptome and High Throughput Correlation Analysis with Yield and Abst Related Parameters Using 60 K Cotton Oligonucleotide Micro-Arrays In order to produce a high throughput correlation analysis between plant phenotype and gene expression level, the present inventors utilized a cotton oligonucleotide micro-array, produced by Agilent Technologies [chem(dot)agilent(dot)com/Scripts/PDS(dot)asp?1Page=50879]. The array oligonucleotide represents about 60,000 cotton genes and transcripts. In order to define correlations between the levels of RNA expression with ABST and yield and components or vigor related parameters, various plant characteristics of 13 different cotton ecotypes were analyzed and further used for RNA expression analysis. The correlation between the RNA levels and the characterized parameters was analyzed using Pearson correlation test [davidmlane(dot)com/hyperstat/A34739(dot)html].

Correlation of Cotton Varieties Across Ecotypes Grown Under Regular and Drought Growth Conditions Experimental Procedures 13 Cotton ecotypes were grown in 5-11 repetitive plots, in field. Briefly, the growing protocol was as follows:

Regular growth conditions: Cotton plants were grown in the field using commercial fertilization and irrigation protocols [623 $m^3$ water per dunam (1000 square meters) per entire growth period, fertilization of 24 units of 12% nitrogen, 12 units of 6% phosphorous and 12 units of 6% potassium per entire growth periods. Plot size of 5 meter long, two rows, 8 plants per meter].

Drought growth conditions: Cotton seeds were sown in soil and grown under normal condition until first squares were visible (40 days from sowing), drought treatment was employed by irrigating with 75% water in comparison to the normal treatment [472 $m^3$ water per dunam (1000 square meters) per entire growth period].

Analyzed Cotton tissues—Eight tissues [mature leaf, lower and upper main stem, flower, main mature boll, fruit, ovule with fiber (Day) and ovule with fiber (Night)] from plants growing under normal conditions were sampled and RNA was extracted as described above.

Eight tissues [mature lead (Day), mature leaf (Night), lower main stem, upper main stem, main flower, main mature boll, ovule and fiber (Day) and ovule with fiber (night)] from plants growing under drought conditions were sampled and RNA was extracted as described above.

Each micro-array expression information tissue type has received a Set ID as summarized in Tables 144-145 below.

TABLE 144

Cotton transcriptome expression sets under normal conditions (normal expression set 1)

| Expression Set | Set ID |
| --- | --- |
| Fruit at 10 DPA at reproductive stage under normal growth conditions | 1 |
| Lower main stem at reproductive stage under normal growth conditions | 2 |
| Main flower at reproductive stage under normal growth conditions | 3 |
| Main mature boll at reproductive stage under normal growth conditions | 4 |
| Mature leaf (day) at reproductive stage under normal conditions | 5 |
| Mature leaf (night) at reproductive stage under normal conditions | 6 |
| Ovule and fiber (day) at reproductive stage under normal conditions | 7 |
| Ovule and fiber (night) at reproductive stage under normal conditions | 8 |
| Upper main stem at reproductive stage under normal growth conditions | 9 |

Table 144: Provided are the cotton transcriptome expression sets. All tissues were collected during day light, except Mature leaf and ovule that were collected also during night.
Lower main stem = the main stem adjacent to main mature boll;
Upper main stem = the main stem adjacent to the main flower;
Main flower = reproductive organ on the third position on the main stem(position 3);
Fruit at 10DPA = reproductive organ ten days after anthesis on the main stem (position 2);
Main mature boll = reproductive organ on the first position on the main stem (position 1).

TABLE 145

Cotton transcriptome expression sets under drought conditions (drought expression set 1)

| Expression Set | Set ID |
| --- | --- |
| Lower main stem reproductive stage under drought growth conditions | 1 |
| Main flower at reproductive stage under drought growth conditions | 2 |
| Main mature boll at reproductive stage under drought growth conditions | 3 |
| Mature leaf during night at reproductive stage under drought growth conditions | 4 |
| Ovule with fiber at reproductive stage during day under drought growth conditions | 5 |
| Ovule with fiber at reproductive stage during night under drought growth conditions | 6 |
| Upper main stem at reproductive stage under drought growth conditions | 7 |

Table 145: Provided are the cotton transcriptome expression sets.
Lower main stem = the main stem adjacent to main mature boll,
Upper main stem = the main stem adjacent to the main flower,
Main flower = reproductive organ on the third position on the main stem (position 3),
Fruit at 10DPA = reproductive organ ten days after anthesis on the main stem (position 2),
Main mature boll = reproductive organ on the first position on the main stem (position 1),
Ovule and fiber were sampled either at day or night hours.

Cotton yield components and vigor related parameters assessment—13 Cotton ecotypes in 5-11 repetitive plots, each plot containing approximately 80 plants were grown in field. Plants were regularly fertilized and watered during plant growth until harvesting (as recommended for commercial growth). Plants were continuously phenotyped during the growth period and at harvest (Tables 198-199). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were measured and collected:

Total Bolls yield (RP) [gr]—Total boll weight (including fiber) per plot.

Total bolls yield per plant (RP) [gr]—Total boll weight (including fiber) per plot divided by the number of plants.

Fiber yield (RP) [gr]—Total fiber weight per plot.

Fiber yield per plant (RP) [gr]—Total fiber weight in plot divided by the number of plants.

Fiber yield per boll (RP) [gr]—Total fiber weight in plot divided by the number of bolls.

Estimated Avr Fiber yield (MB) po. 1 (H) [gr]—Weight of the fiber on the main branch in position 1 at harvest.

Estimated Avr Fiber yield (MB) po. 3 (H) [gr]—Weight of the fiber on the main branch in position 3 at harvest.

Estimated Avr Bolls FW (MB) po. 1 (H) [gr]—Weight of the fiber on the main branch in position 1 at harvest.

Estimated Avr Bolls FW (MB) po. 3 (H) [gr]—Weight of the fiber on the main branch in position 3 at harvest.

Fiber Length (RP)—Measure Fiber Length in inch from the rest of the plot.

Fiber Length Position 1 (SP)—Fiber length at position 1 from the selected plants. Measure Fiber Length in inch.

Fiber Length Position 3 (SP)—Fiber length at position 3 from the selected plants. Measure Fiber Length in inch.

Fiber Strength (RP)—Fiber Strength from the rest of the plot. Measured in grams per denier.

Fiber Strength Position 3 (SP)—Fiber strength at position 3 from the selected plants. Measured in grams per denier.

Micronaire (RP)—fiber fineness and maturity from the rest of the plot. The scale that was used was 3.7-4.2-for Premium; 4.3-4.9-Base Range; above 5-Discount Range.

Micronaire Position 1 (SP)—fiber fineness and maturity from position 1 from the selected plants. The scale that was used was 3.7-4.2-for Premium; 4.3-4.9-Base Range; above 5-Discount Range.

Micronaire Position 3 (SP)—fiber fineness and maturity from position 3 from the selected plants. The scale that was used was 3.74.2-for Premium; 4.34.9-Base Range; above 5-Discount Range.

Short Fiber Content (RP (%)—short fiber content from the rest of the plot

Uniformity (RP) (%)—fiber uniformity from the rest of the plot

Carbon isotope discrimination—(%)—isotopic ratio of 13C to 12C in plant tissue was compared to the isotopic ratio of 13C to 12C in the atmosphere.

Leaf temp (V) (° Celsius)—leaf temperature was measured at vegetative stage using Fluke IR thermometer 568 device. Measurements were done on 4 plants per plot.

Leaf temp (10 DPA) (° Celsius)—Leaf temperature was measured 10 days post anthesis using Fluke IR thermometer 568 device. Measurements were done on 4 plants per plot.

Stomatal conductance (10 DPA)—(mmol $m^{-2}$ $s^{-1}$)—plants were evaluated for their stomata conductance using SC-1 Leaf Porometer (Decagon devices) 10 days post anthesis. Stomata conductance readings were done on fully developed leaf, for 2 leaves and 2 plants per plot.

Stomatal conductance (17 DPA)—(mmol $m^{-2}$ $s^{-1}$)—plants were evaluated for their stomata conductance using SC-1 Leaf Porometer (Decagon devices) 17 days post anthesis. Stomata conductance readings were done on fully developed leaf, for 2 leaves and 2 plants per plot.

% Canopy coverage (10 DPA) (F)—percent Canopy coverage 10 days post anthesis and at flowering stage. The % Canopy coverage is calculated using Formula XXXII above.

Leaf area (10 DPA) ($cm^2$)—Total green leaves area 10 days post anthesis.

PAR LAI (10 DPA)—Photosynthetically active radiation 10 days post anthesis.

SPAD (17 DPA) [SPAD unit]—Plants were characterized for SPAD rate 17 days post anthesis. Chlorophyll content was determined using a Minolta SPAD 502 chlorophyll meter. Four measurements per leaf were taken per plot.

SPAD (pre F)—Plants were characterized for SPAD rate during pre-flowering stage. Chlorophyll content was determined using a Minolta SPAD 502 chlorophyll meter. Four measurements per leaf were taken per plot.

SPAD rate—the relative growth rate (RGR) of SPAD (Formula IV) as described above.

Leaf mass fraction (10 DPA) [$cm^2$/gr.]—leaf mass fraction 10 days post anthesis.

The leaf mass fraction is calculated using Formula XXXIII above.

Lower Stem width (II) [mm]—This parameter was measured at harvest. Lower internodes from 8 plants per plot were separated from the plant and the diameter was measured using a caliber. The average internode width per plant was calculated by dividing the total stem width by the number of plants.

Upper Stem width (II) [mm]—This parameter was measured at harvest. Upper internodes from 8 plants per plot were separated from the plant and the diameter was measured using a caliber. The average internode width per plant was calculated by dividing the total stem width by the number of plants.

Plant height (H) [cm]—plants were measured for their height at harvest using a measuring tape. Height of main stem was measured from ground to apical mersitem base. Average of eight plants per plot was calculated.

Plant height growth [cm/day]—the relative growth rate (RGR) of Plant Height (Formula III above) as described above.

Shoot DW (V) [gr.]—Shoot dry weight at vegetative stage after drying at 70° C. in oven for 48 hours. Total weight of 3 plants in a plot.

Shoot DW (10 DPA) [gr]—Shoot dry weight at 10 days post anthesis, after drying at 70° C. in oven for 48 hours. Total weight of 3 plants in a plot.

Bolls num per plant (RP) [num]—Average bolls number per plant from the rest of the plot.

Reproductive period duration [num]—number of days from flowering to harvest for each plot.

Closed Bolls num per plant (RP) [num]—Average closed bolls number per plant from the rest of the plot.

Closed Bolls num per plant (SP) [num]—Average closed bolls number per plant from selected plants.

Open Bolls num per plant (SP) [num]—Average open bolls number per plant from selected plants. average of eight plants per plot.

Num of lateral branches with open bolls (H) [num]—count of number of lateral branches with open bolls at harvest, average of eight plants per plot.

Num of nodes with open bolls (MS) (H) [num]—count of number of nodes with open bolls on main stem at harvest, average of eight plants per plot.

Seeds yield per plant (RP) [gr]—Total weight of seeds in plot divided in plants number.

Estimated Avr Seeds yield (MB) po. 1 (H) [gr]—Total weight of seeds in position one per plot divided by plants number.

Estimated Avr Seeds yield (MB) po. 3 (H) [gr]—Total weight of seeds in position three per plot divided by plants number.

Estimated Avr Seeds num (MB) po. 1 (H) [num]—Total number of seeds in position one per plot divided by plants number.

Estimated Avr Seeds num (MB) po. 3 (H) [num]—Total number of seeds in position three per plot divided by plants number.

1000 seeds weight (RP) [gr.]—was calculated based on Formula XIV.

Experimental Results 13 different cotton varieties were grown and characterized for different parameters (Tables 146-147). The average for each of the measured parameter was calculated using the JMP software (Tables 148-151) and a subsequent correlation analysis between the various transcriptome sets (Tables 144-145) and the average parameters, was conducted (Tables 152-153). Results were then integrated to the database.

TABLE 146

Cotton correlated parameters under normal growth conditions (vectors)
(parameters set 1)

| Correlated parameter with | Corr. ID |
|---|---|
| 1000 seeds weight (RP) [gr.], under Normal growth conditions | 1 |
| Closed Bolls num per plant (RP) [num], under Normal growth conditions | 2 |
| Closed Bolls num per plant (SP) [num], under Normal growth conditions | 3 |
| Estimated Avr. Bolls FW (MB) po. 1 (H) [gr.], under Normal growth conditions | 4 |
| Estimated Avr. Bolls FW (MB) po. 3 (H) [gr.], under Normal growth conditions | 5 |
| Estimated Avr. Fiber yield (MB) po. 1 (H) [gr.], under Normal growth conditions | 6 |
| Estimated Avr. Fiber yield (MB) po. 3 (H) [gr.], under Normal growth conditions | 7 |
| Estimated Avr. Seeds num (MB) po. 1 (H) [num], under Normal growth conditions | 8 |
| Estimated Avr. Seeds num (MB) po. 3 (H) [num], under Normal growth conditions | 9 |
| Estimated Avr. Seeds yield (MB) po. 1 (H) [gr.], under Normal growth conditions | 10 |
| Estimated Avr. Seeds yield (MB) po. 3 (H) [gr.], under Normal growth conditions | 11 |
| Fiber yield per boll (RP) [gr.], under Normal growth conditions | 12 |
| Fiber yield per plant (RP) [gr.], under Normal growth conditions | 13 |
| Leaf mass fraction (10DPA) [$cm^2$/gr.], under Normal growth conditions | 14 |
| Lower Stem width (H) [mm], under Normal growth conditions | 15 |
| Num of lateral branches with open bolls (H) [number], under Normal growth conditions | 16 |
| Num of nodes with open bolls (MS) (H) [number], under Normal growth conditions | 17 |
| Open Bolls num per plant (SP) [number], under Normal growth conditions | 18 |
| Plant height growth [cm/day], under Normal growth conditions | 19 |
| Plant height (H) [cm], under Normal growth conditions | 20 |
| Reproductive period duration [number], under Normal growth conditions | 21 |
| Seeds yield per plant (RP) [gr.], under Normal growth conditions | 22 |
| Shoot DW (10DPA) [gr.], under Normal growth conditions | 23 |
| Shoot DW (V) [gr.], under Normal growth conditions | 24 |
| SPAD (17DPA) [SPAD unit], under Normal growth conditions | 25 |
| Total Bolls yield (RP) [gr.], under Normal growth conditions | 26 |
| Upper Stem width (H) [mm], under Normal growth conditions | 27 |

Table 146. Provided are the Cotton correlated parameters (vectors).
"RP"—Rest of plot;
"SP" = selected plants;
"gr." = grams;
"H" = Harvest;
"in"—inch;
"SP"—Selected plants;
"SPAD" = chlorophyll levels;
"FW" = Plant Fresh weight;
"DPA"—Days post anthesis;
"mm"—millimeter;
"cm"—centimeter;
"num"—number;
"Avr." = average;
"DPA" = days post anthesis;
"v" = vegetative stage;
"H" = harvest stage;
"po. 1" = position 1 of the boll/fiber on the main branch closest to the main stem (basal boll);
"po.3" = position 3 of the boll/fiber on the main branch (distal boll)
"MB" = main branch;
"MS" = main stem.

TABLE 147

Cotton correlated parameters under drought growth conditions (vectors)
(parameters set 1)

| Correlated parameter with | Corr. ID |
|---|---|
| 1000 seeds weight (RP) [gr.], under Drought growth conditions | 1 |
| Bolls num per plant (RP) [number], under Drought growth conditions | 2 |
| Closed Bolls num per plant (RP) [number], under Drought growth conditions | 3 |
| Closed Bolls num per plant (SP) [number], under Drought growth conditions | 4 |

TABLE 147-continued

Cotton correlated parameters under drought growth conditions (vectors)
(parameters set 1)

| Correlated parameter with | Corr. ID |
|---|---|
| Estimated Avr. Bolls FW (MB) po. 1 (H) [gr.], under Drought growth conditions | 5 |
| Estimated Avr. Bolls FW (MB) po. 3 (H) [gr.], under Drought growth conditions | 6 |
| Estimated Avr. Fiber yield (MB) po. 1 (H) [gr.], under Drought growth conditions | 7 |
| Estimated Avr. Fiber yield (MB) po. 3 (H) [gr.], under Drought growth conditions | 8 |
| Estimated Avr. Seeds num (MB) po. 1 (H) [num], under Drought growth conditions | 9 |
| Estimated Avr. Seeds num (MB) po. 3 (H) [num], under Drought growth conditions | 10 |
| Estimated Avr. Seeds yield (MB) po. 1 (H) [gr.], under Drought growth conditions | 11 |
| Estimated Avr. Seeds yield (MB) po. 3 (H) [gr.], under Drought growth conditions | 12 |
| Fiber yield per boll (RP) [gr.], under Drought growth conditions | 13 |
| Fiber yield per plant (RP) [gr.], under Drought growth conditions | 14 |
| Fiber yield (RP) [gr.], under Drought growth conditions | 15 |
| Leaf mass fraction (10DPA) [cm$^2$/gr.], under Drought growth conditions | 16 |
| Lower Stem width (H) [mm], under Drought growth conditions | 17 |
| Num of lateral branches with open bolls (H) [number], under Drought growth conditions | 18 |
| Num of nodes with open bolls (MS) (H) [number], under Drought growth conditions | 19 |
| Open Bolls num per plant (SP) [number], under Drought growth conditions | 20 |
| Plant height growth [cm/day], under Drought growth conditions | 21 |
| Plant height (H) [cm], under Drought growth conditions | 22 |
| Reproductive period duration [number], under Drought growth conditions | 23 |
| Seeds yield per plant (RP) [gr.], under Drought growth conditions | 24 |
| Shoot DW (10DPA) [gr.], under Drought growth conditions | 25 |
| Shoot DW (V) [gr.], under Drought growth conditions | 26 |
| SPAD (17DPA) [SPAD unit], Drought | 77 |
| Total bolls yield per plant (RP) [gr.], under Drought growth conditions | 28 |
| Total Bolls yield (RP) [gr.], under Drought growth conditions | 29 |
| Upper Stem width (H) [mm], under Drought growth conditions | 30 |

Table 147. Provided are the Cotton correlated parameters (vectors).
"RP"—Rest of plot;
"SP" = selected plants;
"gr." = grams;
"H" = Harvest;
"in"—inch;
"SP"—Selected plants;
"SPAD" = chlorophyll levels;
"FW" = Plant Fresh weight;
"DPA"—Days post anthesis;
"mm"—millimeter;
"cm"—centimeter;
"num"—number;
"Avr." = average;
"DPA" = days post anthesis;
"v" = vegetative stage;
"H" = harvest stage;
"po. 1" = position 1 of the boll/fiber on the main branch closest to the main stem (basal boll);
"po.3" = position 3 of the boll/fiber on the main branch (distal boll);
"MB" = main branch;
"MS" = main stem.

TABLE 148

Measured parameters in Cotton accessions (1-7) under normal conditions (parameters set 1)

| Corr. ID | Line-1 | Line-2 | Line-3 | Line-4 | Line-5 | Line-6 | Line-7 |
|---|---|---|---|---|---|---|---|
| 1 | 105.2 | 113.6 | 98.5 | 84.7 | 111.7 | 82.5 | 91.6 |
| 2 | 4.23 | NA | NA | NA | NA | NA | 4.56 |
| 3 | 5.55 | 2.08 | 3.39 | 2.09 | 3.07 | 2.41 | 5.89 |
| 4 | 6.62 | 4.88 | 7.08 | 5.34 | 4.08 | 3.58 | 5.66 |
| 5 | 6.42 | 2.93 | 5.95 | 4.16 | 2.72 | 2.73 | 5.13 |
| 6 | 2.53 | 1.88 | 2.69 | 2.02 | 1.5 | 0.38 | 2.04 |
| 7 | 2.46 | 1.13 | 2.34 | 1.69 | 1.06 | 0.5 | 1.87 |
| 8 | 31.6 | 24.2 | 36 | 31.3 | 20.9 | 32.6 | 30.8 |
| 9 | 31.2 | 15.5 | 33.3 | 26.1 | 14.9 | 31.3 | 32.6 |
| 10 | 3.33 | 2.7 | 3.83 | 2.99 | 2.43 | 3.02 | 3.03 |

TABLE 148-continued

Measured parameters in Cotton accessions (1-7) under normal conditions (parameters set 1)

| Corr. ID | Line-1 | Line-2 | Line-3 | Line-4 | Line-5 | Line-6 | Line-7 |
|---|---|---|---|---|---|---|---|
| 11 | 3.29 | 1.58 | 3.06 | 2.19 | 1.64 | 2.29 | 2.76 |
| 12 | 2.3 | 1.37 | 2.22 | 1.81 | 1.12 | 0.4 | 1.8 |
| 13 | 25.2 | 26 | 25.4 | 27.9 | 25.4 | 4.7 | 24 |
| 14 | 41.1 | 36.5 | 34 | 48 | 44.6 | 54.7 | 28.1 |
| 15 | 12.8 | 13.7 | 11.8 | 12.4 | 13 | 10.9 | 13 |
| 16 | 1.021 | 1.458 | 0.812 | 0.958 | 1.208 | 1.688 | 1.292 |
| 17 | 8.15 | 10.9 | 9 | 11.04 | 10.14 | 7.85 | 8.48 |
| 18 | 12 | 22.6 | 11.8 | 18.8 | 27.7 | 16.4 | 15 |
| 20 | 112.8 | 110.8 | 100.6 | 115.4 | 103.3 | 98.5 | 121.9 |
| 19 | 1.86 | 2 | 1.73 | 1.72 | 1.66 | 1.72 | 2.09 |
| 21 | 121.3 | 108.1 | 108 | 103.8 | 102.9 | 108 | 126 |
| 25 | 34.3 | 33.5 | 31.4 | 29.7 | 37.1 | 27.4 | 33.4 |
| 22 | 32.5 | 34.9 | 32.5 | 35.1 | 36.3 | 26.7 | 33.1 |
| 23 | 169.2 | 183.6 | 171.1 | 172.7 | 190 | 149 | 193.1 |
| 24 | 39.2 | 64.7 | 44.8 | 38.1 | 46.2 | 36.7 | 48.2 |
| 26 | 505.4 | 564.2 | 544.2 | 585.5 | 536.5 | 317.2 | 488.3 |
| 27 | 3.02 | 3.64 | 3.32 | 3.13 | 3.23 | 2.73 | 2.8 |

Table 148. Provided are the values of each of the parameters (as described above measured in cotton accessions (Line). Growth conditions are specified in the experimental procedure section.

TABLE 149

Measured parameters in additional Cotton accessions (8-13) under normal conditions (parameters set 1)

| Corr. ID | Line-8 | Line-9 | Line-10 | Line-11 | Line-12 | Line-13 |
|---|---|---|---|---|---|---|
| 1 | 116.7 | 99.6 | 99.5 | 97.7 | 102.7 | 109.9 |
| 2 | NA | NA | 3.16 | 1.11 | NA | NA |
| 3 | 2.34 | 3.75 | 3.31 | 1.84 | 2.74 | 3.09 |
| 4 | 3.13 | 6.37 | 6.14 | NA | 4.95 | 6.95 |
| 5 | 3.31 | 4.71 | 5.44 | 4.14 | 4.6 | 6.25 |
| 6 | 1.14 | 2.47 | 2.29 | NA | 1.77 | 2.92 |
| 7 | 1.19 | 1.91 | 2.02 | 1.12 | 1.65 | 2.65 |
| 8 | 15.5 | 31.5 | 29.3 | NA | 25.6 | 34.6 |
| 9 | 18.2 | 25.1 | 29 | 29.1 | 25.9 | 32.7 |
| 10 | 1.87 | 3.21 | 3 | NA | 2.82 | 3.87 |
| 11 | 2.06 | 2.25 | 2.65 | 2.73 | 2.55 | 3.56 |
| 12 | 1.24 | 2.23 | 1.99 | 1.18 | 1.74 | 2.39 |
| 13 | 26.6 | 30.8 | 23.1 | 20.5 | 26 | 29.1 |
| 14 | 45.4 | 28.1 | 33.5 | 47.9 | 45.9 | 44 |
| 15 | 13.1 | 14.3 | 11.8 | 14.5 | 12.6 | 14 |
| 16 | 1.125 | 0.795 | 0.583 | 0.125 | 0.146 | 0.708 |
| 17 | 11.29 | 10.83 | 8.73 | 12.33 | 9.19 | 10.65 |
| 18 | 30.3 | 17.9 | 12.4 | 19.6 | 14.7 | 15.7 |
| 20 | 102.2 | 127.3 | 105.8 | 151.3 | 117.6 | 119.2 |
| 19 | 1.63 | 2.07 | 1.86 | 1.57 | 1.87 | 1.94 |
| 21 | 102.7 | 104.4 | 126 | 145.2 | 109.5 | 106.2 |
| 25 | 33.8 | 31.9 | 32.9 | 22.1 | 28.1 | 31.1 |
| 22 | 39.5 | 39.7 | 30.2 | 47.6 | 37.8 | 35.9 |
| 23 | 196.4 | 199.8 | 179.4 | 134.3 | 198.5 | 165,5 |
| 24 | 50.8 | 51.7 | 39.7 | 35.3 | 42.1 | 42.1 |
| 26 | 620.5 | 715.1 | 421.3 | 531.8 | 405.3 | 715.7 |
| 27 | 2.99 | 3.45 | 2.88 | 3.4 | 3.28 | 3.29 |

Table 149. Provided are the values of each of the parameters as described above) measured in cotton accessions (Line). Growth conditions are specified in the experimental procedure section.

TABLE 150

Measured parameters in Cotton accessions (1-7) under drought conditions (parameters set 1)

| Corr. ID | Line-1 | Line-2 | Line-3 | Line-4 | Line-5 | Line-6 | Line-7 |
|---|---|---|---|---|---|---|---|
| 1 | 99.1 | 105.4 | 94.2 | 80.7 | 109 | 80.4 | 92.9 |
| 2 | 9.3 | 14.5 | 9.8 | 12.5 | 19.9 | 8 | 10.6 |
| 3 | NA | NA | NA | NA | NA | NA | 4.237 |
| 4 | 3.77 | 3.7 | 3.63 | 2.92 | 2.5 | 3.2 | 4.76 |
| 5 | 6.76 | 3.05 | 6.51 | NA | NA | NA | NA |
| 6 | 6.15 | 4.25 | 5.9 | NA | NA | 3.51 | 4.18 |
| 7 | 2.63 | 1.2 | 2.53 | NA | NA | NA | NA |
| 8 | 2.34 | 1.57 | 2.32 | NA | NA | 0.47 | 1.44 |
| 9 | 32.6 | 15.6 | 33.5 | NA | NA | NA | NA |
| 10 | 33.4 | 21.8 | 34.6 | NA | NA | 32.1 | 27.5 |
| 11 | 3.45 | 1.66 | 3.55 | NA | NA | NA | NA |
| 12 | 3.3 | 2.3 | 3.16 | NA | NA | 2.56 | 2.16 |
| 15 | 622 | 554.2 | 659.3 | 683.3 | 494.7 | 76 | 467.3 |
| 13 | 2.06 | 1.08 | 2 | 1.82 | 0.84 | 0.27 | 1.43 |
| 14 | 19.2 | 17.5 | 19.4 | 20.5 | 16.7 | 2.2 | 16 |
| 16 | 28.9 | 37.4 | 33.1 | 41 | 39.8 | 33.4 | 27 |
| 17 | 11.4 | 11.7 | 10.8 | 10.8 | 11 | 9.9 | 11.3 |
| 18 | 1.041 | 0.875 | 1.167 | 1.083 | 1.384 | 1.05 | 1.229 |
| 19 | 6.98 | 7.23 | 7.17 | 7.42 | 8.23 | 5.97 | 7.6 |
| 20 | 9.8 | 14.1 | 10.6 | 12.2 | 23.2 | 10.3 | 11.9 |
| 22 | 92.9 | 87.2 | 79.8 | 85.6 | 71.3 | 77.2 | 99.4 |
| 21 | 0.988 | 0.956 | 0.993 | 0.985 | 0.975 | 0.966 | 0.996 |
| 23 | 100.2 | 99.8 | 99.3 | 96.2 | 92.9 | 99.4 | 127 |
| 27 | 47.4 | 46.8 | 48.5 | 49.3 | 53.5 | 46.4 | 48.6 |
| 24 | 24.9 | 24 | 25.5 | 27.1 | 27.5 | 16.5 | 24 |
| 25 | 140.2 | 140.8 | 184.7 | 147.4 | 149.5 | 116.5 | 161.3 |
| 26 | 37.2 | 51.2 | 46.9 | 45.6 | 40 | 28.2 | 41.4 |
| 29 | 1573 | 1378.9 | 1634.8 | 1597.2 | 1358.9 | 745 | 1246 |
| 28 | 48.7 | 43.5 | 48.2 | 52.2 | 45.9 | 19.4 | 42.6 |
| 30 | 2.89 | 3.09 | 3.08 | 3.17 | 3.25 | 2.84 | 2.6 |

Table 150. Provided are the values of each of the parameters (as described above) measured in Barley accessions (Line). Growth conditions are specified in the experimental procedure section

TABLE 151

Measured parameters in additional Cotton accessions (8-13) under drought conditions (parameters set 1)

| Corr. ID | Line-8 | Line-9 | Line-10 | Line-11 | Line-12 | Line-13 |
|---|---|---|---|---|---|---|
| 1 | 108.7 | 95.5 | 98.7 | 99 | 97.2 | 109.6 |
| 2 | 19.6 | 11.4 | 9.1 | 14 | 10.2 | 11 |
| 3 | NA | NA | 3.977 | NA | NA | NA |
| 4 | 1.62 | 3.62 | 4.67 | 2.3 | 3.21 | 3.57 |
| 5 | 3.58 | 5.5 | NA | 4.2 | 4.88 | 5.9 |
| 6 | 2.43 | 5.17 | 5.14 | 3.36 | 4.45 | 5.03 |
| 7 | 1.31 | 2.11 | NA | 1.13 | 1.75 | 2.15 |
| 8 | 0.86 | 1.95 | 1.82 | 0.97 | 1.64 | 1.86 |
| 9 | 18.7 | 29.5 | NA | 31.2 | 27.3 | 29 |
| 10 | 13.9 | 29.2 | 28.1 | 24.8 | 27.8 | 26 |
| 11 | 2.15 | 2.82 | NA | 3.18 | 2.74 | 3.2 |
| 12 | 1.38 | 2.64 | 2.51 | 2.31 | 2.53 | 2.65 |
| 15 | 592.6 | 598.8 | 558 | 428 | 563.7 | 614.7 |
| 13 | 1 | 1.82 | 2.02 | 1.01 | 1.59 | 2.02 |
| 14 | 19.6 | 18.9 | 18.3 | 14.1 | 16.1 | 20.2 |
| 16 | 41.9 | 30.6 | 30.1 | 46 | 39.5 | 34.2 |
| 17 | 11.9 | 12.5 | 10.6 | 11.8 | 11.3 | 12 |
| 18 | 0.893 | 0.963 | 0.875 | 0.208 | 0.367 | 0.875 |
| 19 | 9.39 | 7.68 | 7.06 | 10.31 | 7.55 | 8.19 |
| 20 | 22.8 | 12.7 | 9.9 | 14.5 | 11.7 | 12.8 |
| 22 | 74.8 | 97.7 | 85.5 | 104.4 | 93 | 93.4 |
| 21 | 0.992 | 0.993 | 0.985 | 0.991 | 0.986 | 0.984 |
| 23 | 92.9 | 97.7 | 127 | 98.8 | 98.5 | 98.8 |
| 27 | 48.8 | 51.2 | 52.1 | 43.8 | 45.8 | 49 |
| 24 | 30.4 | 25.9 | 23.3 | 31.7 | 23.9 | 30.6 |
| 25 | 162.8 | 159.8 | 123.2 | 192.8 | 156.6 | 163.7 |

TABLE 151-continued

Measured parameters in additional Cotton accessions (8-13) under drought conditions (parameters set 1)

| Corr. ID | Line-8 | Line-9 | Line-10 | Line-11 | Line-12 | Line-13 |
|---|---|---|---|---|---|---|
| 26 | 49.8 | 44.3 | 36.5 | 43.2 | 38 | 37.8 |
| 29 | 1583.1 | 1552.1 | 1419.2 | 1533.2 | 1489.2 | 1606.4 |
| 28 | 52.4 | 49.1 | 46 | 50.7 | 42.4 | 57.1 |
| 30 | 3.17 | 3.37 | 2.91 | 3.46 | 3.5 | 3.22 |

Table 151. Provided are the values of each of the parameters (as described above) measured in Barley accessions (Line). Growth conditions are specified in the experimental procedure section

TABLE 152

Correlation between the expression level of selected genes of some embodiments of the invention in various tissues and the phenotypic performance under normal conditions (set 1) across Cotton accessions

| Gene Name | R | P value | Exp. set | Corr. Set ID | Gene Name | R | P value | Exp. set | Corr. Set ID |
|---|---|---|---|---|---|---|---|---|---|
| LGA6 | 0.72 | 1.10E−01 | 8 | 16 | LGA6 | 0.84 | 3.60E−02 | 6 | 11 |
| LGA6 | 0.74 | 9.15E−02 | 6 | 7 | LGA6 | 0.90 | 1.45E−02 | 6 | 20 |
| LGA6 | 0.95 | 4.19E−03 | 6 | 1 | LGA6 | 0.95 | 3.22E−03 | 6 | 5 |
| LGA6 | 0.76 | 1.02E−02 | 1 | 20 | LGA6 | 0.90 | 4.37E−04 | 1 | 21 |
| LGB1 | 0.91 | 3.52E−05 | 3 | 18 | LGB1 | 0.74 | 5.86E−02 | 2 | 11 |
| LGB1 | 0.78 | 3.96E−02 | 2 | 27 | LGB1 | 0.97 | 1.26E−03 | 6 | 18 |
| LGB1 | 0.83 | 3.88E−02 | 6 | 25 | LGB1 | 0.79 | 6.27E−02 | 6 | 1 |
| LGB1 | 0.81 | 5.21E−02 | 6 | 23 | | | | | |

Table 152. Provided are the correlations (R) between the genes expression levels in various tissues and the phenotypic performance.
"Corr. Set ID"—correlation set ID according to the correlated parameters specified in Table 146.
"Exp. Set"—Expression set specified in Table 144.
"R" = Pearson correlation coefficient;
"P" = p value

TABLE 153

Correlation between the expression level of selected genes of some embodiments of the invention in various tissues and the phenotypic performance under drought conditions (drought expression set 1) across Cotton accessions

| Gene Name | R | P value | Exp. set | Corr. Set ID | Gene Name | R | P value | Exp. set | Corr. Set ID |
|---|---|---|---|---|---|---|---|---|---|
| LGA6 | 0.78 | 1.73E−02 | 7 | 2 | LGA6 | 0.86 | 3.00E−03 | 7 | 20 |
| LGA6 | 0.97 | 2.70E−06 | 3 | 2 | LGA6 | 0.90 | 3.59E−04 | 3 | 20 |
| LGA6 | 0.93 | 2.67E−03 | 1 | 16 | LGA6 | 0.80 | 2.92E−02 | 1 | 30 |
| LGB1 | 0.77 | 6.00E−03 | 4 | 2 | LGB1 | 0.83 | 1.67E−03 | 4 | 20 |
| LGB1 | 0.79 | 1.06E−02 | 7 | 29 | LGB1 | 0.78 | 1.23E−02 | 7 | 14 |
| LGB1 | 0.93 | 2.40E−03 | 7 | 12 | LGB1 | 0.81 | 8.72E−03 | 7 | 15 |
| LGB1 | 0.85 | 1.65E−02 | 7 | 10 | LGB1 | 0.76 | 1.86E−02 | 7 | 28 |
| LGB1 | 0.79 | 3.62E−02 | 7 | 8 | LGB1 | 0.77 | 1.55E−02 | 7 | 30 |
| LGB1 | 0.96 | 6.03E−04 | 7 | 6 | LGB1 | 0.87 | 9.95E−04 | 3 | 2 |
| LGB1 | 0.85 | 1.94E−03 | 3 | 20 | LGB1 | 0.80 | 1.68E−02 | 3 | 12 |
| LGB1 | 0.71 | 7.67E−02 | 1 | 1 | LGB1 | 0.86 | 1.37E−02 | 1 | 23 |
| LGB1 | 0.77 | 4.27E−02 | 1 | 4 | | | | | |

Table 153. Provided are the correlations (R) between the genes expression levels in various tissues and the phenotypic performance.
"Corr. ID"—correlation set ID according to the correlated parameters specified in Table 147.
"Exp. Set"—Expression set specified in Table 145.
"R" = Pearson correlation coefficient;
"P" = p value

Example 16

Production of *Sorghum* Transcriptome and High Throughput Correlation Analysis with Yield and Drought Related Parameters Measured in Fields Using 65K *Sorghum* Oligonucleotide Micro-Arrays In order to produce a high throughput correlation analysis between plant phenotype and gene expression level, the present inventors utilized a sorghum oligonucleotide micro-array, produced by Agilent Technologies [chem(dot)agilent(dot)com/Scripts/PDS(dot)asp?1Page=50879]. The array oligonucleotide represents about 65,000 sorghum genes and transcripts. In order to define correlations between the levels of RNA expression with ABST, drought and yield components or vigor related parameters, various plant characteristics of 12 different sorghum hybrids were analyzed. Among them, 8 hybrids encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

12 *Sorghum* varieties were grown in 6 repetitive plots, in field. Briefly, the growing protocol was as follows:

1. Regular growth conditions: *Sorghum* plants were grown in the field using commercial fertilization and irrigation protocols (normal growth conditions), which include 452 m$^3$ water per dunam (1000 square meters) per entire growth period and fertilization of 14 units of URAN® 21% (Nitrogen Fertilizer Solution; PCS Sales, Northbrook, Ill., USA).

2. Drought conditions: *Sorghum* seeds were sown in soil and grown under normal condition until flowering stage (59 days from sowing), and then drought treatment was imposed by irrigating plants with 50% water relative to the normal treatment from this stage [309 m$^3$ water per dunam (1000 square meters) per entire growth period].

Analyzed *Sorghum* tissues—All 12 selected *Sorghum* hybrids were sample per each treatment. Tissues [Basal and distal head, flag leaf and upper stem] representing different plant characteristics, from plants growing under normal conditions and drought stress conditions were sampled and RNA was extracted as described above. Each micro-array expression information tissue type has received a Set ID as summarized in Tables 154-155 below.

TABLE 154

*Sorghum* transcriptome expression sets in field experiment under normal conditions

| Expression Set | Set ID |
|---|---|
| Basal head at grain filling stage, under normal growth conditions | 1 |
| Distal head at grain filling stage, under normal growth conditions | 2 |
| Leaf at flowering stage, under normal growth conditions | 3 |
| Leaf at grain filling stage, under normal growth conditions | 4 |
| Up stem at flowering stage, under normal growth conditions | 5 |
| Up stem at grain filling stage, under normal growth conditions | 6 |

Table 154: Provided are the *sorghum* transcriptome expression sets under normal conditions.

TABLE 155

*Sorghum* transcriptome expression sets in field experiment under drought conditions

| Expression Set | Set ID |
|---|---|
| Basal head at grain filling stage, under drought growth conditions | 1 |
| Distal head at grain filling stage, under drought growth conditions | 2 |
| Leaf at flowering stage, under drought growth conditions | 3 |
| Leaf at grain filling stage, under drought growth conditions | 4 |
| Up stem at flowering stage, under drought growth conditions | 5 |
| Up stem at grain filling stage, under drought growth conditions | 6 |

Table 155: Provided are the *sorghum* transcriptome expression sets under drought conditions.

*Sorghum* yield components and vigor related parameters assessment—Plants were phenotyped as shown in Table 156 below. Some of the following parameters were collected using digital imaging system:

Grains yield per plant (gr.)—At the end of the growing period heads were collected (harvest stage). Selected heads were separately threshed and grains were weighted. The average grain weight per plant was calculated by dividing the total grain weight by the number of selected plants.

Heads weight per plant (RP) (kg)—At the end of the growing period heads of selected plants were collected (harvest stage) from the rest of the plants in the plot. Heads were weighted after oven dry (dry weight), and average head weight per plant was calculated.

Grains num (SP) (number)—was calculated by dividing seed yield from selected plants by a single seed weight.

1000 grain weight (gr)—was calculated based on Formula XIV.

Grain area (cm$^2$)—At the end of the growing period the grains were separated from the Plant 'Head'. A sample of ~200 grains were weighted, photographed and images were processed using the below described image processing system. The grain area was measured from those images and was divided by the number of grains.

Grain Circularity—The circularity of the grains was calculated based on Formula XIX.

Main Head Area (cm$^2$)—At the end of the growing period selected "Main Heads" were photographed and images were processed using the below described image processing system. The "Main Head" area was measured from those images and was divided by the number of "Main Heads".

Main Head length (cm)—At the end of the growing period selected "Main Heads" were photographed and images were processed using the below described image processing system. The "Main Head" length (longest axis) was measured from those images and was divided by the number of "Main Heads".

Main Head Width (cm)—At the end of the growing period selected "Main Heads" were photographed and images were processed using the below described image processing system. The "Main Head" width (longest axis) was measured from those images and was divided by the number of "Main Heads".

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling selected plants in a plot or by measuring the parameter across all the plants within the plot.

All Heads Area ($cm^2$)—At the end of the growing period (harvest) selected plants main and secondary heads were photographed and images were processed using the above described image processing system. All heads area was measured from those images and was divided by the number of plants.

All Heads length (cm)—At the end of the growing period (harvest) selected plants main and secondary heads were photographed and images were processed using the above described image processing system. All heads length (longest axis) was measured from those images and was divided by the number of plants.

All Heads Width (cm)—At the end of the growing period main and secondary heads were photographed and images were processed using the above described image processing system. All heads width (longest axis) was measured from those images and was divided by the number of plants.

Head weight per plant (RP)water until maturity (gr/lit)—At the end of the growing period heads were collected (harvest stage) from the rest of the plants in the plot. Heads were weighted after oven dry (dry weight), and average head weight per plant was calculated. Head weight per plant was then divided by the average water volume used for irrigation until maturity.

Harvest index (SP)—was calculated based on Formula XVI above.

Heads index (RP)—was calculated based on Formula XXXXVI above.

Head dry weight (GF) (gr.)—selected heads per plot were collected at the grain filling stage (R2-R3) and weighted after oven dry (dry weight).

Heads per plant (RP) (num)—At the end of the growing period total number of rest of plot heads were counted and divided by the total number of rest of plot plants.

Leaves temperature 2 (° C.)—leaf temperature was measured using Fluke IR thermometer 568 device. Measurements were done on opened leaves at grain filling stage.

Leaves temperature 6 (° C.)—leaf temperature was measured using Fluke IR thermometer 568 device. Measurements were done on opened leaves at late grain filling stage.

Stomatal conductance (F) (mmol $m^{-2}$ $s^{-1}$)—plants were evaluated for their stomata conductance using SC-1 Leaf Porometer (Decagon devices) at flowering (F) stage. Stomata conductance readings were done on fully developed leaf, for 2 leaves and 2 plants per plot.

Stomatal conductance (GF) (mmol $m^{-2}$ $s^{-1}$)—plants were evaluated for their stomata conductance using SC-1 Leaf Porometer (Decagon devices) at grain filling (GF) stage. Stomata conductance readings were done on fully developed leaf, for 2 leaves and 2 plants per plot.

Relative water content 2 (RWC, %)—was calculated based on Formula I at grain filling.

Specific leaf area (SLA) (GF)—was calculated based on Formula XXXVII above.

Waxy leaf blade—was defined by view of leaf blades % of Normal and % of grayish (powdered coating/frosted appearance). Plants were scored for their waxiness according to the scale 0=normal, 1=intermediate, 2=grayish.

SPAD 2 (SPAD unit)—Chlorophyll content was determined using a Minolta SPAD 502 chlorophyll meter and measurement was performed at flowering. SPAD meter readings were done on fully developed leaf. Three measurements per leaf were taken per plant.

SPAD 3 (SPAD unit)—Chlorophyll content was determined using a Minolta SPAD 502 chlorophyll meter and measurement was performed at grain filling. SPAD meter readings were done on fully developed leaf. Three measurements per leaf were taken per plant.

% yellow leaves number (F) (percentage)—At flowering stage, leaves of selected plants were collected. Yellow and green leaves were separately counted. Percent of yellow leaves at flowering was calculated for each plant by dividing yellow leaves number per plant by the overall number of leaves per plant and multiplying by 100.

% yellow leaves number (H) (percentage)—At harvest stage, leaves of selected plants were collected. Yellow and green leaves were separately counted. Percent of yellow leaves at flowering was calculated for each plant by dividing yellow leaves number per plant by the overall number of leaves per plant and multiplying by 100.

% Canopy coverage (GF)—was calculated based on Formula XXXII above.

LAI LP-80 (GF)—Leaf area index values were determined using an AccuPAR Centrometer Model LP-80 and measurements were performed at grain filling stage with three measurements per plot.

Leaves area per plant (GF) ($cm^2$)—total leaf area of selected plants in a plot. This parameter was measured using a Leaf area-meter at the grain filling period (GF).

Plant height (H) (cm)—Plants were characterized for height at harvest. Plants were measured for their height using a measuring tape. Height was measured from ground level to top of the longest leaf.

Relative growth rate of Plant height (cm/day)—was calculated based on Formula III above.

Num days to Heading (number)—Calculated as the number of days from sowing till 50% of the plot arrives to heading.

Num days to Maturity (number)—Calculated as the number of days from sowing till 50% of the plot arrives to seed maturation.

Vegetative DW per plant (gr.)—At the end of the growing period all vegetative material (excluding roots) from plots were collected and weighted after oven dry (dry weight). The biomass per plant was calculated by dividing total biomass by the number of plants.

Lower Stem dry density (F) ($gr/cm^3$)—measured at flowering. Lower internodes from selected plants per plot were separated from the plants and weighted (dry weight). To obtain stem density, internode dry weight was divided by the internode volume.

Lower Stem dry density (H) ($gr/cm^3$)—measured at harvest. Lower internodes from selected plants per plot were separated from the plant and weighted (dry weight). To obtain stem density, internode dry weight was divided by the internode volume.

Lower Stem fresh density (F) ($gr/cm^3$)—measured at flowering. Lower internodes from selected plants per plot were separated from the plants and weighted (fresh weight). To obtain stem density, internodes fresh weight was divided by the stem volume.

Lower Stem fresh density (H) ($gr/cm^3$)—measured at harvest. Lower internodes from selected plants per plot were separated from the plants and weighted (fresh weight). To obtain stem density, internodes fresh weight was divided by the stem volume.

Lower Stem length (F) (cm)—Lower internodes from selected plants per plot were separated from the plants at flowering (F). Internodes were measured for their length using a ruler.

Lower Stem length (H) (cm)—Lower internodes from selected plants per plot were separated from the plant at harvest (H). Internodes were measured for their length using a ruler.

Lower Stem width (F) (cm)—Lower internodes from selected plants per plot were separated from the plant at flowering (F). Internodes were measured for their width using a caliber.

Lower Stem width (GF) (cm)—Lower internodes from selected plants per plot were separated from the plant at grain filling (GF). Internodes were measured for their width using a caliber.

Lower Stem width (H) (cm)—Lower internodes from selected plants per plot were separated from the plant at harvest (H). Internodes were measured for their width using a caliber.

Upper Stem dry density (19 (gr/cm$^3$)—measured at flowering (F). Upper internodes from selected plants per plot were separated from the plant and weighted (dry weight). To obtain stem density, stem dry weight was divided by the stem volume.

Upper Stem dry density (H) (gr/cm$^3$)—measured at harvest (H). Upper stems from selected plants per plot were separated from the plant and weighted (dry weight). To obtain stem density, stem dry weight was divided by the stem volume.

Upper Stem fresh density (19 (gr/cm$^3$)—measured at flowering (F). Upper stems from selected plants per plot were separated from the plant and weighted (fresh weight). To obtain stem density, stem fresh weight was divided by the stem volume.

Upper Stem fresh density (H) (gr/cm$^3$)—measured at harvest (H). Upper stems from selected plants per plot were separated from the plant and weighted (fresh weight). To obtain stem density, stem fresh weight was divided by the stem volume.

Upper Stem length (19 (cm)—Upper stems from selected plants per plot were separated from the plant at flowering (F). Stems were measured for their length using a ruler.

Upper Stem length (H) (cm)—Upper stems from selected plants per plot were separated from the plant at harvest (H). Stems were measured for their length using a ruler.

Upper Stem width (F) (cm)—Upper stems from selected plants per plot were separated from the plant at flowering (F). Stems were measured for their width using a caliber.

Upper Stem width (H) (cm)—Upper stems from selected plants per plot were separated from the plant at harvest (H). Stems were measured for their width using a caliber.

Upper Stem volume (H)—was calculated based on Formula L above.

Data parameters collected are summarized in Table 156, herein below.

TABLE 156

*Sorghum* correlated parameters under normal and drought growth conditions (vectors)

| Correlated parameter with | Corr. ID |
|---|---|
| 1000 grain weight [gr.] | 1 |
| All Heads Area [cm$^2$] | 2 |
| All Heads length [cm] | 3 |
| All Heads Width [cm] | 4 |
| % Canopy coverage (GF) [%] | 5 |
| Grain area [cm$^2$] | 6 |
| Grain Circularity | 7 |
| Grains num (SP) [num] | 8 |
| Grains yield per plant [gr.] | 9 |
| Harvest index (SP) | 10 |
| Head dry weight (GF) [gr.] | 11 |
| Heads index (RP) | 12 |
| Heads per plant (RP) [num] | 13 |
| Heads weight per plant (RP) [kg] | 14 |
| Head weight per plant (RP)/water until maturity [gr./lit] | 15 |
| LAI LP-80 (GF) | 16 |
| Leaves area per plant (GF) [cm$^2$] | 17 |
| Leaves temperature 2 [CA°] | 18 |
| Leaves temperature 6 [CA°] | 19 |
| Lower Stem dry density (F) [gr/cm$^3$] | 20 |
| Lower Stem dry density (H) [gr/cm$^3$] | 21 |
| Lower Stem fresh density (F) [gr/cm$^3$] | 22 |
| Lower Stem fresh density (H) [gr/cm$^3$] | 23 |
| Lower Stem length (F) [cm] | 24 |
| Lower Stem length (H) [cm] | 25 |
| Lower Stem width (F) [cm] | 26 |
| Lower Stem width (GF) [cm] | 27 |
| Lower Stem width (H) [cm] | 28 |
| Main Head Area [cm$^2$] | 29 |
| Main Head length [cm] | 30 |
| Main Head Width [cm] | 31 |
| Num days to Heading [num] | 32 |
| Num days to Maturity [num] | 33 |
| Plant height (H) [cm] | 34 |
| Relative growth rate of Plant height [cm/day] | 35 |
| Relative water content 2 [%] | 36 |
| SPAD 2 [SPAD unit] | 37 |
| SPAD 3 [SPAD unit] | 38 |
| Specific leaf area (SLA) (GF) | 39 |
| Stomatal conductance (F) [mmol m$^{-2}$ s$^{-1}$] | 40 |
| Stomatal conductance (GF) [mmol m$^{-2}$ s$^{-1}$] | 41 |
| Upper Stem dry density (F) [gr./cm$^3$] | 42 |
| Upper Stem dry density (H) [gr./cm$^3$] | 43 |
| Upper Stem fresh density (F) [gr./cm$^3$] | 44 |
| Upper Stem fresh density (H) [gr./cm$^3$] | 45 |
| Upper Stem length (F) [cm] | 46 |
| Upper Stein length (H) (cm) | 47 |
| Upper Stem volume (H) [cm$^3$] | 48 |
| Upper Stem width (F) [cm] | 49 |
| Upper Stein width (H) [cm] | 50 |
| Vegetative DW per plant [gr.] | 51 |
| Waxy leaf blade | 52 |
| % yellow leaves number (F) [%] | 53 |
| % yellow leaves number (H) [%] | 54 |

Table 156. Provided are the *Sorghum* correlated parameters vectors).
"gr." = grams;
"kg" = kilograms";
"RP" = Rest of plot;
"SP" = Selected plants;
"num" = Number;
"lit" = Liter;
"SPAD" = chlorophyll levels;
"FW" = Plant Fresh weight;
"DW" = Plant Dry weight;
"GF" = Grain filling growth stage;
"F" = Flowering stage;
"H" = Harvest stage;
"cm" = Centimeter;
"mmol" = millimole.

Experimental Results

Twelve different *sorghum* hybrids were grown and characterized for different parameters (Table 156). The average for each of the measured parameter was calculated using the JMP software (Tables 157-160) and a subsequent correlation analysis was performed (Tables 161-162). Results were then integrated to the database.

TABLE 157

Measured parameters in *Sorghum* accessions under normal conditions

| Corr. ID | Line-1 | Line-2 | Line-3 | Line-4 | Line-5 | Line-6 | Line-7 |
|---|---|---|---|---|---|---|---|
| 5 | 3 | 95 | 69.2 | 97.5 | 83.6 | 92.8 | 84.3 |
| 53 | 3 | 0.611 | 0.853 | 0.548 | 0.314 | 0.713 | 0.573 |
| 54 | 3 | 0.406 | 0.111 | 0.37 | 0.126 | 0.485 | 0.149 |
| 1 | 3 | 27.6 | 22.8 | 14.9 | 18.5 | 28.5 | 27.1 |
| 2 | 3 | 114.5 | 79.7 | 77.9 | 79.7 | 219 | 100.1 |
| 4 | 3 | 5.54 | 4.93 | 6.2 | 4.56 | 9.99 | 6.55 |
| 3 | 3 | 27.7 | 21.4 | 17.8 | 23.7 | 32.2 | 19.4 |
| 7 | 3 | 0.87 | 0.87 | 0.87 | 0.88 | 0.87 | 0.89 |
| 6 | 3 | 0.154 | 0.119 | 0.098 | 0.122 | 0.154 | 0.149 |
| 8 | 3 | 12730.1 | 6281.9 | 4599.5 | 15182.6 | 12628.1 | 17505 |
| 9 | 3 | 43.9 | 18 | 8.5 | 33.2 | 44.3 | 60.2 |
| 10 | 3 | 0.218 | 0.185 | 0.054 | 0.253 | 0.261 | 0.375 |
| 11 | 3 | 29.3 | 12.9 | 27.9 | 41.3 | 38.9 | 15.2 |
| 15 | 3 | 0.248 | 0.163 | 0.136 | 0.197 | 0.178 | 0.285 |
| 12 | 3 | 0.343 | 0.402 | 0.241 | 0.338 | 0.361 | 0.532 |
| 13 | 3 | NA | 1.42 | 1.74 | 1.3 | 0.97 | 1.73 |
| 14 | 3 | 0.057 | 0.037 | 0.031 | 0.045 | 0.041 | 0.066 |
| 16 | 3 | 6.27 | NA | 6.11 | 5.42 | 5.43 | NA |
| 17 | 3 | 2825.8 | 1911.2 | 2030 | 2866.8 | 1554.7 | 2342.6 |
| 20 | 3 | 1.57 | 1.37 | 2.81 | 2.17 | 2.35 | 1.4 |
| 21 | 3 | 1_83 | 2.03 | 3.48 | 2.53 | 3.05 | 1.8 |
| 22 | 3 | 10.47 | 10.64 | 8.55 | 10.85 | 11.32 | 10.04 |
| 23 | 3 | 9.79 | 10.38 | 10.52 | 10.49 | 11.28 | 7.29 |
| 24 | 3 | 7.79 | 3.5 | 14.9 | 3.41 | 11.12 | 8.16 |
| 25 | 3 | 7.99 | 4.83 | 12.87 | 3.12 | 10.76 | 8.3 |
| 26 | 3 | 19.5 | 16.7 | 14.7 | 17.9 | 14.8 | 16 |
| 27 | 3 | 20 | 20.9 | 14.7 | 18.8 | 15.3 | 15.9 |
| 28 | 3 | 19.1 | 15.5 | 14.4 | 20.3 | 15.2 | 15.1 |
| 29 | 3 | 114.5 | 80.8 | 77.9 | 79.7 | 219 | 112.1 |
| 31 | 3 | 5.54 | 4.99 | 6.2 | 4.56 | 9.99 | 7.19 |
| 30 | 3 | 27.7 | 21.6 | 17.8 | 23.7 | 32.2 | 20.7 |
| 32 | 3 | 89.4 | 65.7 | 88.2 | 74 | 84 | 71.5 |
| 33 | 3 | 126 | 107 | 115 | 107 | 107 | 92 |
| 34 | 3 | 182.1 | 104.6 | 143.8 | 99 | 173.6 | 170.1 |
| 35 | 3 | 2.87 | 1.85 | 2.55 | 1.65 | 3.12 | 2.73 |
| 36 | 3 | 72.1 | 91.7 | 79.5 | 86.7 | 74 | 90.6 |
| 37 | 3 | 47.8 | 49.3 | 44.7 | 49.1 | 41.7 | 47.2 |
| 38 | 3 | 47.7 | 35.4 | 45.8 | 42.1 | 41.4 | 33.4 |
| 39 | 3 | 80.2 | 170.3 | 54.3 | 76.9 | 51.4 | 163.1 |
| 40 | 3 | 670.4 | 1017.6 | 584.4 | 640.6 | 350 | 553.5 |
| 41 | 3 | 382.9 | 809.4 | 468.7 | 486.9 | 421.5 | 633.1 |
| 42 | 3 | NA | 1.24 | NA | NA | 2.11 | 1.23 |
| 43 | 3 | 2.05 | 1.77 | 2.36 | 1.83 | 1.73 | 1.86 |
| 44 | 3 | NA | 9.79 | NA | NA | 10.44 | 9.38 |
| 45 | 3 | 6.61 | 8.92 | 6.43 | 8.25 | 7.24 | 4.64 |
| 46 | 3 | NA | 42.6 | NA | NA | NA | 9.2 |
| 47 | 3 | 38.8 | 45 | 24.5 | 52.5 | 38.4 | 34 |
| 48 | 3 | 8.74 | 7.46 | 6.99 | 7.68 | 7.83 | 10.07 |
| 49 | 3 | 2352.5 | 2169.1 | 968.8 | 2452.6 | 1997.7 | 2767.5 |
| 50 | 3 | 8.23 | 8.98 | 7.11 | 7.13 | 6.81 | 10.42 |
| 51 | 3 | 0.125 | 0.05 | 0.122 | 0.076 | 0.097 | 0.062 |
| 52 | 3 | NA | 2 | NA | NA | NA | 1.062 |

Table 157: Provided are the values of each of the parameters (as describe( above) measured in *Sorghum* accessions (Line) under normal conditions. Growth conditions are specified in the experimental procedure section. "NA" = not available.

TABLE 158

Measured parameters in additional *Sorghum* accessions under normal growth conditions

| Corr. ID | Line-8 | Line-9 | Line-10 | Line-11 | Line-12 | Line-13 |
|---|---|---|---|---|---|---|
| 5 | 80.6 | 75.7 | 80.2 | 79.7 | 65.9 | 89.6 |
| 53 | 0.584 | 0.544 | 0.208 | 0.484 | 0.351 | 0.574 |
| 54 | 0.076 | 0.022 | 0.018 | 0.129 | 0.096 | 0.424 |
| 1 | 18.5 | 18.5 | 23.5 | 25.9 | 24.3 | 20.4 |
| 2 | 85.4 | 139 | 70 | 78.6 | 152 | 145.2 |
| 4 | 5.45 | 6.37 | 4.48 | 4.57 | 7.41 | 6.32 |
| 3 | 21.3 | 30.9 | 19.2 | 21 | 27.8 | 30 |
| 7 | 0.89 | 0.88 | 0.89 | 0.9 | 0.89 | 0.9 |
| 6 | 0.117 | 0.121 | 0.122 | 0.129 | 0.123 | 0.125 |
| 8 | 13887.9 | 21509.8 | 13138.7 | 16910 | 18205.2 | 24801.2 |
| 9 | 32.1 | 49.6 | 39 | 54.8 | 55.3 | 64.7 |
| 10 | 0.309 | 0.409 | 0.343 | 0.36 | 0.314 | 0.318 |
| 11 | 10.2 | 27.6 | 31.6 | 25.8 | 21.3 | 74.5 |
| 15 | 0.249 | 0.271 | 0.284 | 0.315 | 0.216 | 0.325 |
| 12 | 0.477 | 0.554 | 0.538 | 0.502 | 0.471 | 0.478 |
| 13 | 1.37 | 1.08 | 2.2 | 1.52 | 1.17 | 1.01 |
| 14 | 0.057 | 0.062 | 0.065 | 0.072 | 0.049 | 0.075 |
| 16 | NA | NA | NA | NA | NA | 5.79 |
| 17 | 2008.9 | 2212 | 1495.5 | 1997.8 | 2692.1 | 2647.7 |
| 20 | 1.97 | 2.05 | 2.29 | 1.87 | 1.71 | 2.14 |
| 21 | 2.93 | 2.47 | 2.56 | 2.48 | 2.74 | 1.64 |
| 22 | 10.71 | 10.82 | 10.84 | 10.84 | 10.7 | 10.55 |
| 23 | 10.09 | 10.85 | 11 | 11.2 | 7.36 | 8.62 |
| 24 | 2.83 | 3.22 | 4.02 | 4.88 | 2.82 | 8.79 |
| 25 | 2.97 | 3.72 | 5.9 | 5.07 | 3.78 | 9.98 |
| 26 | 17.8 | 18.7 | 13.5 | 15 | 14.7 | 16.4 |
| 27 | 21.5 | 21 | 19.5 | 16.5 | 19.9 | 19.4 |
| 28 | 17.4 | 16.3 | 13.3 | 15 | 16.4 | 18.7 |
| 29 | 85.4 | 139 | 98.9 | 114.7 | 154.7 | 147.9 |
| 31 | 5.45 | 6.37 | 5.9 | 6.27 | 7.5 | 6.4 |
| 30 | 21.3 | 30.9 | 22.5 | 24.7 | 28.3 | 30.5 |
| 32 | 67.7 | 63.7 | 56 | 59 | 56 | 75.3 |
| 33 | 107 | 92 | 107 | 107 | 107 | 107 |
| 34 | 54.9 | 94.8 | 101.6 | 113 | 88.3 | 163.8 |
| 35 | 0.88 | 1.57 | 1.73 | 1.91 | 1.59 | 2.87 |
| 36 | 88.8 | 90.2 | 90.8 | 88.5 | 86.7 | 82 |
| 37 | 52.1 | 53.7 | 52.6 | 53.9 | 51.8 | 44.1 |
| 38 | 50.2 | 41.9 | 46.8 | 46.8 | 48.6 | 40.1 |
| 39 | 194.1 | 213.7 | 212 | 214.6 | 157.4 | 67.7 |
| 40 | 473.8 | 796.9 | 879 | 810.3 | 889 | 607.2 |
| 41 | 485.7 | 886 | 730.6 | 886.6 | 785 | 384.5 |
| 42 | 1.26 | 1.5 | 1.94 | 1.92 | 1.96 | NA |
| 43 | 1.76 | 1.75 | 1.79 | 1.66 | 1.87 | 1.67 |
| 44 | 10.22 | 9.69 | 9.98 | 10.74 | 10.33 | NA |
| 45 | 7.23 | 7.31 | 7.92 | 7.06 | 5.4 | 4.82 |
| 46 | 26.6 | 60.4 | 53.6 | 55 | 44.6 | NA |
| 47 | 28.8 | 59.7 | 52 | 54.8 | 45.5 | 48.5 |
| 48 | 8.42 | 8.61 | 8.51 | 9.19 | 9.14 | 9.31 |
| 49 | 1607.7 | 3510.7 | 2907.8 | 3639.5 | 3045.6 | 3301.8 |
| 50 | 9.43 | 9.54 | 8.04 | 8.85 | 7.91 | 8.07 |
| 51 | 0.045 | 0.045 | 0.046 | 0.063 | 0.086 | 0.099 |
| 52 | 1.125 | 1.438 | 1 | 1.75 | 1 | NA |

Table 158: Provided are the values of each of the parameters (as described above) measured in *Sorghum* accessions (Seed ID) under normal conditions. Growth conditions are specified in the experimental procedure section. "NA" = not available.

TABLE 159

Measured parameters in *Sorghum* accessions under drought growth conditions

| Corr. ID | Line-1 | Line-2 | Line-3 | Line-4 | Line-5 | Line-6 | Line-7 |
|---|---|---|---|---|---|---|---|
| 5 | 1 | 86.9 | 61.3 | 75 | 77.8 | 75.5 | 80.4 |
| 53 | 3 | 0.371 | 0.728 | 0.407 | 0.695 | 0.425 | 0.878 |
| 54 | 3 | 0.286 | 0.424 | 0.256 | 0.478 | 0.366 | 0.394 |
| 1 | 3 | 24.2 | 19.8 | 14.2 | 14.6 | 25.5 | 20.8 |
| 2 | 3 | 72.4 | 93.8 | 30.8 | 55.3 | 131.2 | 76.5 |
| 4 | 3 | 4.27 | 5.39 | 3.51 | 3.72 | 7 | 5.27 |
| 3 | 3 | 22.3 | 24.4 | 12.2 | 19.9 | 27.6 | 18.2 |
| 7 | 3 | 0.87 | 0.87 | 0.86 | 0.88 | 0.87 | 0.89 |
| 6 | 3 | 0.142 | 0.114 | 0.095 | 0.112 | 0.144 | 0.131 |
| 8 | 3 | 6967.7 | 5451.7 | 3960.3 | 9838.5 | 6481.7 | 12402.5 |
| 9 | 3 | 23.8 | 13.7 | 7 | 18.2 | 20.7 | 34.4 |

TABLE 159-continued

Measured parameters in Sorghum accessions under drought growth conditions

| Corr. ID | Line-1 | Line-2 | Line-3 | Line-4 | Line-5 | Line-6 | Line-7 |
|---|---|---|---|---|---|---|---|
| 10 | 3 | 0.135 | 0.158 | 0.065 | 0.187 | 0.255 | 0.291 |
| 11 | 3 | NA | 12.1 | 24.8 | 37 | 23.3 | 11.7 |
| 15 | 1 | 0.11 | 0.094 | 0.03 | 0.094 | 0.056 | 0.116 |
| 12 | 3 | 0.157 | 0.359 | 0.071 | 0.244 | 0.056 | 0.511 |
| 13 | 3 | NA | 2.02 | 1 | 1.04 | NA | 1.06 |
| 14 | 3 | 0.023 | 0.019 | 0.006 | 0.019 | 0.012 | 0.024 |
| 16 | 3 | 3.58 | NA | 2.64 | 3.43 | 2.81 | NA |
| 17 | 3 | 3308.1 | 1206 | 2464.6 | 1142.9 | 2116.3 | 1550 |
| 20 | 3 | 1.76 | 1.46 | 2.27 | 2.78 | 2.39 | 1.28 |
| 21 | 3 | 1.96 | 1.6 | 2.27 | 2.49 | 3.56 | 1.25 |
| 22 | 3 | 9.62 | 10.46 | 7.49 | 10.79 | 10.25 | 9.66 |
| 23 | 3 | 9.68 | 8.31 | 7.38 | 10.11 | 10.72 | 5.51 |
| 24 | 3 | 7.79 | 4.03 | 16.46 | 3.29 | 10.83 | 10.82 |
| 25 | 3 | 7.06 | 4.51 | 16.23 | 3.31 | 9.88 | 10.5 |
| 26 | 3 | 19.2 | 16.6 | 14.9 | 18.4 | 15.8 | 14 |
| 27 | 3 | 19 | 18.4 | 16 | 19.1 | 15.5 | 14.3 |
| 28 | 3 | 20.1 | 16.1 | 14.4 | 18.5 | 15.5 | 14.1 |
| 29 | 3 | 72.4 | 96.6 | 32.8 | 55.3 | 131.2 | 85.9 |
| 31 | 3 | 4.27 | 5.53 | 3.7 | 3.72 | 7 | 5.81 |
| 30 | 3 | 22.3 | 24.8 | 12.4 | 19.9 | 27.6 | 19.4 |
| 32 | 3 | 91.5 | 66.3 | 88 | 74.7 | 90 | 71 |
| 33 | 3 | 115 | 92 | 115 | 107 | 107 | 107 |
| 34 | 3 | 104.6 | 83.2 | 113 | 69 | 104.2 | 133.5 |
| 35 | 3 | 1.59 | 1.56 | 1.83 | 1.28 | 1.8 | 2.02 |
| 36 | 3 | 65.6 | 78.5 | 83,8 | 54.9 | 69.7 | 74.5 |
| 37 | 3 | 45.8 | 47 | 38.8 | 38.2 | 35.9 | 43.4 |
| 38 | 3 | 43.5 | 27 | 36 | 34.1 | 27.3 | 25.8 |
| 39 | 3 | 75.9 | 143.3 | 62.9 | 44.4 | 61.4 | 106.1 |
| 40 | 3 | 30.4 | 774.8 | 61.8 | 68.3 | 31.2 | 330.5 |
| 41 | 3 | 135.1 | 561.2 | 94.4 | 276.2 | 64.1 | 217.2 |
| 42 | 1 | NA | 1.44 | NA | NA | NA | 1.38 |
| 43 | 3 | 2.33 | 1.43 | 2.17 | 1.92 | 1.85 | 1.66 |
| 44 | 3 | 0.86 | 9.89 | NA | NA | NA | 8.1 |
| 45 | 3 | 9.45 | 5.72 | 7.26 | 8.6 | 6.53 | 3.6 |
| 46 | 3 | 25 | 40 | NA | NA | NA | 15.9 |
| 47 | 3 | 26.6 | 39.6 | 15.5 | 31.1 | 31.1 | 20.7 |
| 48 | 3 | 7.79 | 8.92 | 5.87 | 6.63 | 7.45 | 10.2 |
| 49 | 3 | 1288.2 | 2524.3 | 468.4 | 1128,6 | 1370.3 | 1724.9 |
| 50 | 3 | 10.08 | 9.42 | 6.42 | 6.77 | 7.81. | 9.7 |
| 51 | 3 | 0.082 | 0.039 | 0.086 | 0.062 | 0.017 | 0.048 |
| 52 | 3 | NA | 2 | NA | NA | NA | 1 |

Table 159: Provided are the values of each of the parameters as described above) measured in Sorghum accessions (Seed ID) under drought conditions. Growth conditions are specified in the experimental procedure section.

TABLE 160

Measured parameters in additional Sorghum accessions under drought growth conditions

| Corr. ID | Line-8 | Line-9 | Line-10 | Line-11 | Line-12 | Line-13 |
|---|---|---|---|---|---|---|
| 5 | 64.2 | 70.8 | 64.1 | 75.7 | 72.1 | 87.2 |
| 53 | 0.678 | 0.807 | 0.788 | 0.731 | 0.741 | 0.831 |
| 54 | 0.326 | 0.329 | 0.364 | 0.377 | 0.469 | 0.625 |
| 1 | 15.4 | 13.3 | 17.9 | 20.2 | 18.7 | 18 |
| 2 | 67.5 | 112.6 | 82.8 | 100.5 | 122.9 | 86.3 |
| 4 | 4.57 | 4.96 | 4.99 | 5.56 | 7.29 | 4.72 |
| 3 | 19.6 | 30.8 | 21 | 24 | 24.8 | 24.4 |
| 7 | 0.89 | 0.88 | 0.9 | 0.9 | 0.9 | 0.89 |
| 6 | 0.109 | 0.102 | 0.107 | 0.116 | 0.111 | 0.12 |
| 8 | 9979.9 | 17494.2 | 14526.2 | 15729 | 10949.1 | 13808.5 |
| 9 | 19.1 | 29.2 | 31.7 | 40.2 | 25.2 | 29.5 |
| 10 | 0.235 | 0.325 | 0.335 | 0.342 | 0.222 | 0.223 |
| 11 | 9.3 | 19.3 | 33.1 | 27.3 | 24.7 | 50.4 |
| 15 | 0.127 | 0.171 | 0.203 | 0.244 | 0.16 | 0.151 |
| 12 | 0.445 | 0.48 | 0.544 | 0.524 | 0.462 | 0.348 |
| 13 | 1.14 | 1 | 1.18 | 1.11 | 1.29 | 0.85 |
| 14 | 0.026 | 0.035 | 0.042 | 0.05 | 0.033 | 0.031 |
| 16 | NA | NA | NA | NA | NA | 3.94 |
| 17 | 1476.2 | 1773.1 | 1052.7 | 1408.5 | 417.2 | 1247.1 |
| 20 | 1.75 | 1.69 | 2.37 | 1.61 | 1.52 | 2.03 |
| 21 | 2.38 | 1.71 | 1.66 | 1.64 | 2.36 | 1.6 |
| 22 | 10.87 | 10.36 | 11.28 | 10.7 | 10.71 | 9.68 |
| 23 | 7.51 | 7.54 | 8.75 | 8.34 | 4.52 | 7.76 |
| 24 | 2.82 | 4.04 | 4.75 | 4.72 | 3.29 | 7.66 |
| 25 | 3.11 | 4.12 | 4.31 | 5.74 | 3.53 | 5.9 |
| 26 | 17.2 | 14.9 | 13.3 | 14.5 | 13.8 | 17.3 |
| 27 | 17.2 | 20 | 16 | 16.9 | 17 | 19.6 |
| 28 | 17 | 16.4 | 13.7 | 14.7 | 14 | 19.5 |
| 29 | 68.7 | 114.6 | 94.2 | 104.2 | 125.8 | 87.4 |
| 31 | 4.62 | 5.02 | 5.57 | 5.7 | 7.39 | 4.77 |
| 30 | 19.9 | 31.1 | 22.2 | 24.4 | 25.3 | 24.8 |
| 32 | 68.3 | 63 | 56 | 59.7 | 56 | 76.7 |
| 33 | 92 | 92 | 92 | 92 | 92 | 107 |
| 34 | 47.8 | 80.9 | 93.4 | 104.1 | 75.8 | 105.6 |
| 35 | 0.92 | 1.44 | 1.6 | 1.87 | 1.33 | 1.9 |
| 36 | 71.7 | 66.9 | 68.6 | 68.2 | 70.7 | 76.3 |
| 37 | 47.6 | 44.7 | 51.9 | 48.8 | 40 | 37.6 |
| 38 | 42.9 | 30.9 | 43.7 | 37.8 | 38.4 | 32.5 |
| 39 | 128.7 | 132.9 | 138.5 | 133.3 | 78.3 | 47.3 |
| 40 | 387.7 | 582.1 | 985.6 | 835 | 753.4 | 54.2 |
| 41 | 81.2 | 129.8 | 241.6 | 322.9 | 257 | 127.2 |
| 42 | 1.47 | 1.81 | 2.12 | 1.79 | 2.07 | NA |
| 43 | 1.55 | 1.65 | 1.62 | 1.63 | 1.71 | 1.76 |
| 44 | 10.69 | 10.12 | 10.49 | 10.01 | 10.56 | NA |
| 45 | 4.61 | 5.18 | 5.39 | 5.4 | 2.98 | 5.53 |
| 46 | 25.8 | 50.1 | 46.8 | 46.9 | 44.2 | NA |
| 47 | 24.1 | 48.6 | 48.8 | 48.7 | 38.2 | 26.1 |
| 48 | 8.88 | 8.6 | 8.59 | 8.73 | 8.13 | 7.85 |
| 49 | 1507.8 | 2865.3 | 2857.9 | 2956 | 1964.3 | 1288.5 |
| 50 | 9.07 | 7.92 | 8.17 | 8.54 | 7.67 | 7.36 |
| 51 | 0.038 | 0.033 | 0.033 | 0.044 | 0.061 | 0.076 |
| 52 | 1.25 | 1.69 | 1.12 | 1.75 | 1.38 | NA |

Table 160: Provided are the values of each of the parameters (as described above) measured in Sorghum accessions (Seed ID) under drought conditions. Growth conditions are specified in the experimental procedure section.

TABLE 161

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGA17 | 0.80 | 3.15E−02 | 2 | 50 | LGA17 | 0.83 | 2.04E−02 | 2 | 26 |
| LGA17 | 0.76 | 6.15E−03 | 5 | 38 | LGA17 | 0.73 | 6.40E−02 | 5 | 44 |
| LGA17 | 0.72 | 1.31E−02 | 3 | 37 | LGA17 | 0.79 | 6.22E−02 | 3 | 46 |
| LGA17 | 0.78 | 4.36E−03 | 3 | 39 | LGA17 | 0.85 | 8.60E−04 | 3 | 41 |
| LGA17 | 0.79 | 3.48E−02 | 1 | 40 | LGA17 | 0.81 | 2.62E−02 | 1 | 45 |
| LGB14 | 0.77 | 4.32E−02 | 2 | 5 | LGB14 | 0.81 | 2.65E−02 | 2 | 35 |

TABLE 161-continued

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGB14 | 0.74 | 5.69E−02 | 2 | 6 | LGB14 | 0.72 | 6.97E−02 | 2 | 25 |
| LGB14 | 0.71 | 7.36E−02 | 2 | 43 | LGB14 | 0.88 | 8.41E−03 | 2 | 34 |
| LGB14 | 0.79 | 3.52E−02 | 2 | 32 | LGB14 | 0.77 | 4.13E−02 | 2 | 51 |
| LGB14 | 0.98 | 6.13E−04 | 5 | 46 | LGB14 | 0.71 | 1.50E−02 | 5 | 20 |
| LGB14 | 0.71 | 2.08E−02 | 6 | 35 | LGB14 | 0.73 | 1.72E−02 | 6 | 25 |
| LGB14 | 0.85 | 1.63E−03 | 6 | 11 | LGB14 | 0.74 | 1.36E−02 | 6 | 54 |
| LGB14 | 0.72 | 1.82E−02 | 6 | 51 | LGB14 | 0.84 | 1.81E−02 | 4 | 44 |
| LGB14 | 0.80 | 5.65E−03 | 4 | 11 | LGB14 | 0.70 | 1.54E−02 | 3 | 5 |
| LGB14 | 0.77 | 5.67E−03 | 3 | 43 | LGB14 | 0.74 | 8.66E−03 | 3 | 20 |
| LGB14 | 0.81 | 2.82E−02 | 1 | 6 | LGB14 | 0.78 | 3.72E−02 | 1 | 17 |
| LGB14 | 0.90 | 6.28E−03 | 1 | 26 | LGB14 | 0.87 | 1.01E−02 | 1 | 43 |
| LGB14 | 0.70 | 7.99E−02 | 1 | 34 | LGB15 | 0.73 | 6.03E−02 | 2 | 5 |
| LGB15 | 0.75 | 5.39E−02 | 2 | 8 | LGB15 | 0.71 | 7.15E−02 | 2 | 7 |
| LGB15 | 0.77 | 4.43E−02 | 2 | 25 | LGB15 | 0.93 | 2.75E−03 | 2 | 11 |
| LGB15 | 0.86 | 1.21E−02 | 2 | 54 | LGB15 | 0.75 | 5.16E−02 | 2 | 51 |
| LGB15 | 0.72 | 1.19E−02 | 5 | 47 | LGB15 | 0.79 | 6.36E−02 | 5 | 46 |
| LGB15 | 0.72 | 1.80E−02 | 4 | 26 | LGB15 | 0.91 | 4.40E−03 | 1 | 28 |
| LGB15 | 0.93 | 2.02E−03 | 1 | 17 | LGB15 | 0.90 | 5.54E−03 | 1 | 26 |
| LGB15 | 0.79 | 3.28E−02 | 1 | 11 | LGB15 | 0.74 | 5.76E−02 | 1 | 20 |
| LGB16 | 0.85 | 1.59E−02 | 2 | 35 | LGB16 | 0.72 | 6.54E−02 | 2 | 1 |
| LGB16 | 0.72 | 7.05E−02 | 2 | 6 | LGB16 | 0.71 | 7.63E−02 | 2 | 25 |
| LGB16 | 0.72 | 6.53E−02 | 2 | 9 | LGB16 | 0.87 | 1.05E−02 | 2 | 34 |
| LGB16 | 0.77 | 5.10E−03 | 3 | 47 | LGB16 | 0.75 | 7.65E−03 | 3 | 40 |
| LGB16 | 0.73 | 1.05E−02 | 3 | 41 | LGB16 | 0.79 | 3.67E−03 | 3 | 49 |
| LGM11 | 0.90 | 5.63E−03 | 2 | 17 | LGM11 | 0.75 | 5.42E−02 | 2 | 43 |
| LGM11 | 0.72 | 1.22E−02 | 5 | 28 | LGM11 | 0.75 | 8.72E−02 | 5 | 52 |
| LGM11 | 0.87 | 2.41E−03 | 6 | 13 | LGM11 | 0.81 | 4.18E−03 | 6 | 43 |
| LGM11 | 0.75 | 1.31E−02 | 4 | 35 | LGM11 | 0.71 | 2.11E−02 | 4 | 2 |
| LGM11 | 0.83 | 3.07E−03 | 4 | 31 | LGM11 | 0.76 | 1.12E−02 | 4 | 6 |
| LGM11 | 0.78 | 7.69E−03 | 4 | 4 | LGM11 | 0.71 | 2.12E−02 | 4 | 25 |
| LGM11 | 0.76 | 1.01E−02 | 4 | 29 | LGM11 | 0.81 | 4.27E−03 | 4 | 24 |
| LGM11 | 0.81 | 2.54E−03 | 3 | 31 | LGM11 | 0.80 | 3.26E−03 | 3 | 4 |
| LGM11 | 0.71 | 7.36E−02 | 1 | 6 | LGM11 | 0.72 | 6.66E−02 | 1 | 33 |
| LGM11 | 0.78 | 4.05E−02 | 1 | 26 | LGM11 | 0.89 | 6.84E−03 | 1 | 43 |
| LGM11 | 0.73 | 6.51E−02 | 1 | 51 | LGM12 | 0.84 | 1.91E−02 | 2 | 6 |
| LGM12 | 0.72 | 6.70E−02 | 2 | 43 | LGM12 | 0.75 | 5.28E−02 | 2 | 53 |
| LGM12 | 0.84 | 1.38E−03 | 5 | 8 | LGM12 | 0.89 | 7.18E−03 | 5 | 42 |
| LGM12 | 0.72 | 1.26E−02 | 5 | 22 | LGM12 | 0.81 | 2.72E−03 | 5 | 49 |
| LGM12 | 0.83 | 1.49E−03 | 5 | 9 | LGM12 | 0.76 | 6.27E−03 | 5 | 14 |
| LGM12 | 0.86 | 1.39E−03 | 5 | 44 | LGM12 | 0.76 | 6.27E−03 | 5 | 15 |
| LGM12 | 0.78 | 6.80E−02 | 6 | 46 | LGM12 | 0.72 | 6.99E−02 | 6 | 42 |
| LGM12 | 0.78 | 6.75E−02 | 6 | 52 | LGM12 | 0.71 | 7.21E−02 | 6 | 44 |
| LGM12 | 0.85 | 2.05E−03 | 6 | 11 | LGM12 | 0.74 | 1.50E−02 | 4 | 48 |
| LGM12 | 0.98 | 5.29E−04 | 4 | 52 | LGM12 | 0.75 | 1.26E−02 | 4 | 2 |
| LGM12 | 0.72 | 1..85E−02 | 4 | 30 | LGM12 | 0.70 | 2.41E−02 | 4 | 25 |
| LGM12 | 0.73 | 1.56E−02 | 4 | 14 | LGM12 | 0.74 | 1.50E−02 | 4 | 29 |
| LGM12 | 0.70 | 2.32E−02 | 4 | 11 | LGM12 | 0.77 | 8.85E−03 | 4 | 54 |
| LGM12 | 0.73 | 1.56E−02 | 4 | 15 | LGM12 | 0.84 | 1.1.9E−03 | 3 | 12 |
| LGM12 | 0.78 | 4.76E−03 | 3 | 50 | LGM12 | 0.79 | 3.75E−03 | 3 | 10 |
| LGM12 | 0.84 | 1.20E−03 | 3 | 39 | LGM12 | 0.70 | 1.61E−02 | 3 | 41 |
| LGM12 | 0.82 | 2.34E−02 | 1 | 5 | LGM12 | 0.85 | 1.62E−02 | 1 | 3 |
| LGM12 | 0.80 | 3.03E−02 | 1 | 30 | LGM12 | 0.75 | 5.13E−02 | 1 | 43 |
| LGM12 | 0.84 | 1.81E−02 | 1 | 54 | LGM12 | 0.83 | 2.05E−02 | 1 | 32 |
| LGM12 | 0.87 | 1.01E−02 | 1 | 51 | LGM15 | 0.70 | 1.62E−02 | 5 | 25 |
| LGM15 | 0.84 | 1.30E−03 | 5 | 11 | LGM15 | 0.71 | 2.13E−02 | 4 | 48 |
| LGM15 | 0.87 | 5.09E−04 | 3 | 11 | LGM17 | 0.75 | 7.57E−03 | 5 | 48 |
| LGM17 | 0.81 | 2.25E−03 | 3 | 40 | LGM17 | 0.71 | 7.60E−02 | 1 | 1 |
| LGM17 | 0.71 | 7.43E−02 | 1 | 45 | LGM2 | 0.75 | 7.39E−03 | 5 | 47 |
| LGM2 | 0.73 | 9.93E−02 | 5 | 46 | LGM2 | 0.74 | 5.76E−02 | 1 | 50 |
| LGM23 | 0.92 | 3.56E−03 | 2 | 43 | LGM23 | 0.73 | 1.02E−01 | 5 | 52 |
| LGM23 | 0.74 | 8.69E−03 | 3 | 40 | LGM23 | 0.77 | 5.13E−03 | 5 | 41 |
| LGM23 | 0.83 | 3.99E−02 | 4 | 52 | LGM23 | 0.83 | 3.07E−03 | 4 | 6 |
| LGM23 | 0.72 | 1.94E−02 | 4 | 32 | LGM23 | 0.82 | 2.09E−03 | 3 | 1 |
| LGM23 | 0.77 | 5.88E−03 | 3 | 6 | LGM23 | 0.74 | 5.71E−02 | 1 | 6 |
| LGM23 | 0.78 | 4.03E−02 | 1 | 26 | LGM23 | 0.85 | 1.57E−02 | 1 | 43 |

Table 161. Provided are the correlations (R) between the genes expression levels in various tissues and the phenotypic performance.
"Corr. ID"—correlation set ID according to the correlated parameters specified in Table 156.
"Exp. Set"—Expression set specified in Table 154.
"R" = Pearson correlation coefficient;
"P" = p value

TABLE 162

Correlation between the expression level of selected genes of some embodiments of the invention in various tissues and the phenotypic performance under drought conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LGA17 | 0.71 | 4.94E−02 | 1 | 27 | LGA17 | 0.78 | 4.32E−03 | 3 | 15 |
| LGA17 | 0.76 | 6.63E−03 | 3 | 37 | LGA17 | 0.78 | 4.34E−03 | 3 | 47 |
| LGA17 | 0.75 | 5.20E−02 | 3 | 46 | LGA17 | 0.84 | 1.25E−03 | 3 | 40 |
| LGA17 | 0.78 | 4.58E−03 | 3 | 49 | LGA17 | 0.78 | 5.05E−03 | 3 | 39 |
| LGA17 | 0.78 | 4.32E−03 | 3 | 14 | LGA17 | 0.98 | 7.24E−04 | 3 | 42 |
| LGA17 | 0.81 | 1.48E−02 | 2 | 50 | LGB14 | 0.81 | 7.87E−03 | 6 | 12 |
| LGB14 | 0.81 | 8.35E−03 | 6 | 10 | LGB14 | 0.72 | 2.98E−02 | 6 | 22 |
| LGB14 | 0.73 | 2.50E−02 | 6 | 31 | LGB14 | 0.72 | 2.76E−02 | 6 | 49 |
| LGB14 | 0.81 | 7.91E−03 | 6 | 39 | LGB14 | 0.79 | 3.57E−02 | 6 | 44 |
| LGB14 | 0.76 | 8.22E−02 | 4 | 52 | LGB14 | 0.80 | 2.94E−03 | 4 | 36 |
| LGB14 | 0.79 | 3.75E−03 | 3 | 12 | LGB14 | 0.76 | 6.76E−03 | 3 | 37 |
| LGB14 | 0.91 | 9.94E−05 | 3 | 40 | LGB14 | 0.70 | 1.61E−02 | 3 | 48 |
| LGB14 | 0.85 | 8.53E−04 | 3 | 49 | LGB14 | 0.92 | 5.47E−05 | 3 | 39 |
| LGB14 | 0.93 | 2.47E−03 | 3 | 44 | LGB14 | 0.71 | 4.87E−02 | 2 | 32 |
| LGB14 | 0.71 | 4.95E−02 | 2 | 17 | LGB15 | 0.74 | 3.45E−02 | 1 | 47 |
| LGB15 | 0.80 | 3.12E−02 | 1 | 46 | LGB15 | 0.70 | 5.21E−02 | 1 | 43 |
| LGB15 | 0.78 | 2.14E−02 | 1 | 45 | LGB15 | 0.79 | 1.89E−02 | 1 | 51 |
| LGB15 | 0.81 | 5.14E−02 | 1 | 42 | LGB15 | 0.75 | 2.11E−02 | 6 | 17 |
| LGB15 | 0.71 | 3.05E−02 | 6 | 45 | LGB15 | 0.70 | 1.63E−02 | 4 | 45 |
| LGB15 | 0.73 | 1.03E−02 | 4 | 33 | LGB15 | 0.81 | 2.28E−03 | 4 | 20 |
| LGB15 | 0.83 | 4.29E−02 | 4 | 42 | LGB15 | 0.78 | 3.81E−02 | 3 | 46 |
| LGB15 | 0.92 | 8.83E−03 | 3 | 52 | LGB15 | 0.72 | 1.21E−02 | 3 | 21 |
| LGB15 | 0.72 | 4.47E−02 | 2 | 6 | LGB15 | 0.71 | 4.96E−02 | 2 | 32 |
| LGB15 | 0.78 | 2.19E−02 | 2 | 17 | LGB15 | 0.94 | 5.86E−03 | 2 | 13 |
| LGB15 | 0.72 | 4.48E−02 | 2 | 48 | LGB15 | 0.78 | 2.35E−02 | 2 | 1 |
| LGB15 | 0.78 | 2.30E−02 | 2 | 23 | LGB15 | 0.81 | 1.48E−02 | 2 | 21 |
| LGB16 | 0.73 | 3.88E−02 | 1 | 35 | LGB16 | 0.83 | 5.99E−03 | 6 | 6 |
| LGB16 | 0.82 | 6.72E−03 | 6 | 1 | LGB16 | 0.85 | 9.22E−04 | 4 | 37 |
| LGB16 | 0.70 | 7.89E−02 | 4 | 46 | LGB16 | 0.70 | 1.59E−02 | 4 | 38 |
| LGB16 | 0.72 | 1.26E−02 | 4 | 39 | LGB16 | 0.89 | 1.85E−02 | 4 | 42 |
| LGB16 | 0.71 | 1.39E−02 | 3 | 34 | LGB16 | 0.76 | 2.95E−02 | 2 | 15 |
| LGB16 | 0.81 | 1.51E−02 | 2 | 41 | LGB16 | 0.83 | 1.07E−02 | 2 | 9 |
| LGB16 | 0.76 | 2.95E−02 | 2 | 14 | LGM11 | 0.77 | 1.52E−02 | 6 | 36 |
| LGM11 | 0.81 | 2.36E−03 | 5 | 40 | LGM11 | 0.71 | 1.42E−02 | 5 | 39 |
| LGM11 | 0.79 | 6.31E−02 | 4 | 42 | LGM11 | 0.78 | 5.08E−03 | 3 | 12 |
| LGM11 | 0.77 | 5.83E−03 | 3 | 37 | LGM11 | 0.79 | 3.71E−03 | 3 | 40 |
| LGM11 | 0.79 | 3.84E−03 | 3 | 48 | LGM11. | 0.85 | 8.41E−04 | 3 | 39 |
| LGM11 | 0.74 | 5.47E−03 | 3 | 44 | LGM11 | 0.74 | 9.42E−02 | 2 | 13 |
| LGM12 | 0.77 | 2.62E−02 | 1 | 32 | LGM12 | 0.88 | 3.55E−03 | 1 | 17 |
| LGM12 | 0.90 | 2.36E−03 | 1 | 43 | LGM12 | 0.72 | 4.42E−02 | 1 | 45 |
| LGM12 | 0.82 | 1.23E−02 | 1 | 33 | LGM12 | 0.70 | 5.25E−02 | 1 | 5 |
| LGM12 | 0.80 | 1.69E−02 | 1 | 51 | LGM12 | 0.78 | 1.30E−02 | 6 | 12 |
| LGM12 | 0.70 | 3.43E−02 | 6 | 2 | LGM12 | 0.83 | 5.81E−03 | 6 | 22 |
| LGM12 | 0.80 | 1.00E−02 | 6 | 31 | LGM12 | 0.84 | 4.75E−03 | 6 | 48 |
| LGM12 | 0.81 | 8.22E−03 | 6 | 54 | LGM12 | 0.70 | 3.43E−02 | 6 | 49 |
| LGM12 | 0.89 | 1.25E−03 | 6 | 4 | LGM12 | 0.72 | 3.03E−02 | 6 | 39 |
| LGM12 | 0.72 | 2.98E−02 | 6 | 29 | LGM12 | 0.70 | 1.62E−02 | 5 | 22 |
| LGM12 | 0.75 | 7.27E−03 | 5 | 54 | LGM12 | 0.74 | 9.72E−03 | 4 | 6 |
| LGM12 | 0.79 | 3.54E−03 | 4 | 3 | LGM12 | 0.83 | 1.41E−03 | 4 | 47 |
| LGM12 | 0.83 | 2.12E−02 | 4 | 46 | LGM12 | 0.77 | 5.43E−03 | 4 | 49 |
| LGM12 | 0.80 | 2.89E−03 | 4 | 30 | LGM12 | 0.70 | 1.54E−02 | 4 | 8 |
| LGM12 | 0.73 | 1.11E−02 | 3 | 7 | LGM12 | 0.77 | 5.89E−03 | 3 | 12 |
| LGM12 | 0.73 | 1.07E−02 | 3 | 15 | LGM12 | 0.78 | 4.70E−03 | 3 | 28 |
| LGM12 | 0.73 | 1.07E−02 | 3 | 14 | LGM12 | 0.71 | 1.42E−02 | 3 | 8 |
| LGM12 | 0.71 | 1.45E−02 | 3 | 26 | LGM12 | 0.73 | 1.10E−02 | 3 | 53 |
| LGM12 | 0.85 | 7.17E−03 | 2 | 6 | LGM12 | 0.81 | 1.49E−02 | 2 | 31 |
| LGM12 | 0.72 | 4.36E−02 | 2 | 1 | LGM12 | 0.84 | 8.99E−03 | 2 | 4 |
| LGM12 | 0.77 | 2.45E−02 | 2 | 21 | LGM15 | 0.77 | 8.74E−03 | 5 | 11 |
| LGM15 | 0.76 | 6.59E−03 | 4 | 48 | LGM15 | 0.72 | 1.30E−02 | 3 | 54 |
| LGM15 | 0.81 | 1.54E−02 | 2 | 31 | LGM15 | 0.79 | 2.04E−02 | 2 | 4 |
| LGM15 | 0.71 | 4.87E−02 | 2 | 21 | LGM17 | 0.78 | 3.69E−02 | 1 | 11 |
| LGM17 | 0.79 | 6.22E−02 | 1 | 42 | LGM17 | 0.74 | 2.31E−02 | 6 | 8 |
| LGM17 | 0.86 | 2.84E−03 | 1 | 53 | LGM17 | 0.84 | 1.80E−02 | 6 | 44 |
| LGM17 | 0.72 | 1.05E−01 | 5 | 42 | LGM17 | 0.85 | 1.02E−03 | 3 | 21 |
| LGM12 | 0.82 | 1.26E−02 | 1 | 17 | LGM2 | 0.88 | 3.76E−03 | 1 | 43 |
| LGM2 | 0.76 | 2.99E−02 | 1 | 45 | LGM2 | 0.82 | 1.22E−02 | 1 | 33 |
| LGM2 | 0.76 | 2.75E−02 | 1 | 5 | LGM2 | 0.87 | 4.73E−03 | 1 | 51 |
| LGM2 | 0.79 | 5.92E−02 | 6 | 52 | LGM2 | 0.82 | 2.14E−03 | 5 | 54 |
| LGM2 | 0.77 | 2.59E−02 | 2 | 17 | LGM2 | 0.84 | 9.64E−03 | 2 | 43 |

TABLE 162-continued

Correlation between the expression level of selected genes of some embodiments of the invention in various tissues and the phenotypic performance under drought conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LGM2 | 0.72 | 4.41E−02 | 2 | 45 | LGM23 | 0.72 | 2.95E−02 | 6 | 41 |
| LGM23 | 0.83 | 1.08E−02 | 6 | 13 | LGM23 | 0.83 | 6.12E−03 | 6 | 50 |
| LGM23 | 0.75 | 3.14E−02 | 2 | 6 | LGM23 | 0.72 | 4.25E−02 | 2 | 1 |

Table 162. Provided are the correlations (R) between the genes expression levels in various tissues and the phenotypic performance.
"Corr. ID"—correlation set ID according to the correlated parameters specified in Table 156.
"Exp. Set"—Expression set specified in Table 155.
"R" = Pearson correlation coefficient;
"P" = p value.

Example 17

Production of *Sorghum* Transcriptome and High Throughput Correlation Analysis with Yield, Drought and Lown Related Parameters Measured in Fields Using 65K *Sorghum* Oligonucleotide Micro-Arrays In order to produce a high throughput correlation analysis between plant phenotype and gene expression level, the present inventors utilized a sorghum oligonucleotide micro-array, produced by Agilent Technologies [chem(dot)agilent(dot)com/Scripts/PDS(dot)asp?1Page=50879]. The array oligonucleotide represents about 65,000 sorghum genes and transcripts. In order to define correlations between the levels of RNA expression with ABST, drought, low N and yield components or vigor related parameters, various plant characteristics of 36 different sorghum inbreds and hybrids were analyzed under normal (regular) conditions, 35 sorghum lines were analyzed under drought conditions and 34 sorghum lines were analyzed under low N (nitrogen) conditions. All the lines were sent for RNA expression analysis. The correlation between the RNA levels and the characterized parameters was analyzed using Pearson correlation test [davidmlane(dot)com/hyperstat/A34739(dot)html].

Experimental Procedures

36 *Sorghum* varieties were grown in 5 repetitive plots, in field. Briefly, the growing protocol was as follows:

1. Regular growth conditions: *Sorghum* plants were grown in the field using commercial fertilization and irrigation protocols (normal growth conditions), which include 549 m³ water per dunam (1000 square meters) per entire growth period and fertilization of 16 units of URAN® 21% (Nitrogen Fertilizer Solution; PCS Sales, Northbrook, Ill., USA).

2. Drought conditions: *Sorghum* seeds were sown in soil and grown under normal condition until vegetative stage (49 days from sowing), and then drought treatment was imposed by irrigating plants with approximately 60% of the water applied for the normal treatment [315 m³ water per dunam (1000 square meters) per entire growth period].

3. Low Nitrogen fertilization conditions: *Sorghum* plants were sown in soil and irrigated with water as in the normal conditions [549 m³ water per dunam (1000 square meters) per entire growth period], yet no fertilization of nitrogen was applied, whereas other elements were fertilized as in the normal conditions (Magnesium—405 gr. per dunam for three weeks).

Analyzed *Sorghum* tissues—All 36 *Sorghum* inbreds and hybrids were sample per each of the treatments. Tissues [Flag leaf and root] representing different plant characteristics, were sampled and RNA was extracted as described above. Each micro-array expression information tissue type has received a Set ID as summarized in Table 163-164 below.

TABLE 163

*Sorghum* transcriptome expression sets in field experiment under normal conditions

| Expression Set | Set ID |
|---|---|
| Flag leaf at Grain filling stage, under Normal growth conditions | 1 |
| Peduncle at Grain filling stage, under normal growth conditions | 2 |
| Root at Seedling stage, under normal growth conditions | 3 |

Table 163: Provided are the *sorghum* transcriptome expression sets.
Flag leaf = the leaf below the flower.

TABLE 164

*Sorghum* transcriptome expression sets in field experiment under low N conditions

| Expression Set | Set ID |
|---|---|
| Flag leaf at Grain filling stage under low N gowth conditions | 1 |

Table 164: Provided are the *sorghum* transcriptome expression sets.
Flag leaf = the leaf below the flower.

*Sorghum* yield components and vigor related parameters assessment—Plants were phenotyped as shown in Table 165 below. Some of the following parameters were collected using digital imaging system:

Grains yield per dunam (kg)—At the end of the growing period all heads were collected (harvest). Heads were separately threshed and grains were weighted (grain yield). Grains yield per dunam was calculated by multiplying grain yield per m² by 1000 (dunam is 1000 m²).

Grains yield per plant (plot) (gr.)—At the end of the growing period all heads were collected (harvest). Heads were separately threshed and grains were weighted (grain yield). The average grain weight per plant was calculated by dividing the grain yield by the number of plants per plot.

Grains yield per head (gr.)—At the end of the growing period all heads were collected (harvest). Heads were separately threshed and grains were weighted (grain yield. Grains yield per head was calculated by dividing the grain yield by the number of heads.

Main head grains yield per plant (gr.)—At the end of the growing period all plants were collected (harvest). Main heads were threshed and grains were weighted. Main head grains yield per plant was calculated by dividing the grain yield of the main heads by the number of plants.

Secondary heads grains yield per plant (gr.)—At the end of the growing period all plants were collected (harvest). Secondary heads were threshed and grains were weighted. Secondary heads grain yield per plant was calculated by dividing the grain yield of the secondary heads by the number of plants.

Heads dry weight per dunam (kg)—At the end of the growing period heads of all plants were collected (harvest). Heads were weighted after oven dry (dry weight). Heads dry weight per dunam was calculated by multiplying grain yield per $m^2$ by 1000 (dunam is 1000 $m^2$).

Average heads weight per plant at flowering (gr.)—At flowering stage heads of 4 plants per plot were collected. Heads were weighted after oven dry (dry weight), and divided by the number of plants.

Leaf carbon Isotope discrimination at harvest (%)—isotopic ratio of $^{13}C$ to $^{12}C$ in plant tissue was compared to the isotopic ratio of $^{13}C$ to $^{12}C$ in the atmosphere Yield per dunam/water until maturity (kg/lit)—was calculated according to Formula XXXXII (above).

Vegetative dry weight per plant/water until maturity (gr/lit)—was calculated according to Formula XXXXIII above.

Total dry matter per plant at harvest/water until maturity (gr/lit)—was calculated according to Formula XXXXIV above.

Yield/SPAD at grain filling (kg/SPAD units) was calculated according to Formula XXXXVII above.

Grains number per dunam (num)—Grains yield per dunam divided by the average 1000 grain weight.

Grains per plant (num)—Grains yield per plant divided by the average 1000 grain weight.

Main head grains num per plant (num)—main head grain yield divided by the number of plants.

1000 grain weight (gr.)—was calculated according to Formula XIV above.

Grain area ($cm^2$)—At the end of the growing period the grains were separated from the head (harvest). A sample of ~200 grains were weighted, photographed and images were processed using the below described image processing system. The grain area was measured from those images and was divided by the number of grains.

Grain fill duration (num)—Duration of grain filling period was calculated by subtracting the number of days to flowering from the number of days to maturity.

Grain fill duration (GDD)—Duration of grain filling period according to the growing degree units (GDD) method. The accumulated GDD during the grain filling period was calculated by subtracting the Num days to Anthesis (GDD) from Num days to Maturity (GDD).

Yield per dunam filling rate (kg/day)—was calculated according to Formula XXXIX (using grain yield per dunam).

Yield per plant filling rate (gr/day)—was calculated according to Formula XXXIX (using grain yield per plant).

Head area ($cm^2$)—At the end of the growing period (harvest) 6 plants main heads were photographed and images were processed using the below described image processing system. The head area was measured from those images and was divided by the number of plants.

Number days to flag leaf senescence (num)—the number of days from sowing till 50% of the plot arrives to Flag leaf senescence (above half of the leaves are yellow).

Number days to flag leaf senescence (GDD)—Number days to flag leaf senescence according to the growing degree units method. The accumulated GDD from sowing until flag leaf senescence.

% yellow leaves number at flowering (percentage)—At flowering stage, leaves of 4 plants per plot were collected. Yellow and green leaves were separately counted. Percent of yellow leaves at flowering was calculated for each plant by dividing yellow leaves number per plant by the overall number of leaves per plant and multiplying by 100.

% yellow leaves number at harvest (percentage)—At the end of the growing period (harvest) yellow and green leaves from 6 plants per plot were separately counted. Percent of the yellow leaves was calculated per each plant by dividing yellow leaves number per plant by the overall number of leaves per plant and multiplying by 100.

Leaf temperature at flowering (° Celsius)—Leaf temperature was measured at flowering stage using Fluke IR thermometer 568 device. Measurements were done on 4 plants per plot on an open flag leaf.

Specific leaf area at flowering ($cm^2/gr$)—was calculated according to Formula XXXVII above.

Flag leaf thickness at flowering (mm)—At the flowering stage, flag leaf thickness was measured for 4 plants per plot. Micrometer was used to measure the thickness of a flag leaf at an intermediate position between the border and the midrib.

Relative water content at flowering (percentage)—was calculated based on Formula I above.

Leaf water content at flowering (percentage)—was calculated based on Formula XXXXIX above.

Stem water content at flowering (percentage)—was calculated based on Formula XXXXVIII above.

Total heads per dunam at harvest (number)—At the end of the growing period the total number of heads per plot was counted (harvest). Total heads per dunam was calculated by multiplying heads number per $m^2$ by 1000 (dunam is 1000 $m^2$).

Heads per plant (num)—At the end of the growing period total number of heads were counted and divided by the total number plants.

Tillering per plant (num)—Tillers of 6 plants per plot were counted at harvest stage and divided by the number of plants.

Harvest index (plot) (ratio)—The harvest index was calculated using Formula LVIII above.

Heads index (ratio)—Heads index was calculated using Formula XXXXVI above.

Total dry matter per plant at flowering (gr)—Total dry matter per plant was calculated at flowering. The vegetative portion above ground and all the heads dry weight of 4 plants per plot were summed and divided by the number of plants.

Total dry matter per plant (kg)—Total dry matter per plant at harvest was calculated by summing the average head dry weight and the average vegetative dry weight of 6 plants per plot.

Vegetative dry weight per plant at flowering (gr)—At the flowering stage, vegetative material (excluding roots) of 4 plants per plot were collected and weighted after (dry weight) oven dry. The biomass per plant was calculated by dividing total biomass by the number of plants.

Vegetative dry weight per plant (kg)—At the harvest stage, all vegetative material (excluding roots) were collected and weighted after (dry weight) oven dry.

Vegetative dry weight per plant was calculated by dividing the total biomass by the number of plants.

Plant height growth (cm/day)—The relative growth rate (RGR) of plant height was calculated based on Formula III above.

% Canopy coverage at flowering (percentage)—The % Canopy coverage at flowering was calculated based on Formula XXXII above.

PAR LAI (Photosynthetic active radiance—Leaf area index)—Leaf area index values were determined using an AccuPAR Ceptometer Model LP-80 and measurements were performed at flowering stage with three measurements per plot.

Leaves area at flowering (cm$^2$)—Green leaves area of 4 plants per plot was measured at flowering stage. Measurement was performed using a Leaf area-meter.

SPAD at vegetative stage (SPAD unit)—Chlorophyll content was determined using a Minolta SPAD 502 chlorophyll meter and measurement was performed at vegetative stage. SPAD meter readings were done on fully developed leaves of 4 plants per plot by performing three measurements per leaf per plant.

SPAD at flowering (SPAD unit)—Chlorophyll content was determined using a Minolta SPAD 502 chlorophyll meter and measurement was performed at flowering stage. SPAD meter readings were done on fully developed leaves of 4 plants per plot by performing three measurements per leaf per plant.

SPAD at grain filling (SPAD unit)—Chlorophyll content was determined using a Minolta SPAD 502 chlorophyll meter and measurement was performed at grain filling stage. SPAD meter readings were done on fully developed leaves of 4 plants per plot by performing three measurements per leaf per plant.

RUE (Radiation use efficiency)—(gr/% canopy coverage)—Total dry matter produced per intercepted PAR at flowering stage was calculated by dividing the average total dry matter per plant at flowering by the percent of canopy coverage.

Lower stem width at flowering (mm)—Lower stem width was measured at the flowering stage. Lower internodes from 4 plants per plot were separated from the plant and their diameter was measured using a caliber.

Upper stem width at flowering (mm)—Upper stem width was measured at flowering stage. Upper internodes from 4 plants per plot were separated from the plant and their diameter was measured using a caliber.

All stem volume at flowering (cm$^3$)—was calculated based on Formula L above.

Number days to heading (num)—Number of days to heading was calculated as the number of days from sowing till 50% of the plot arrive heading.

Number days to heading (GDD)—Number days to heading according to the growing degree units method. The accumulated GDD from sowing until heading stage.

Number days to anthesis (num)—Number of days to flowering was calculated as the number of days from sowing till 50% of the plot arrive anthesis.

Number days to anthesis (GDD)—Number days to anthesis according to the growing degree units method. The accumulated GDD from sowing until anthesis stage.

Number days to maturity (GDD)—Number days to maturity according to the growing degree units method. The accumulated GDD from sowing until maturity stage.

N (Nitrogen) use efficiency (kg/kg)—was calculated based on Formula LI above.

Total NUtE—was calculated based on Formula LIII above.

Grain NUtE—was calculated based on Formula LV above.

NUpE (kg/kg)—was calculated based on Formula LII above.

N (Nitrogen) harvest index (Ratio)—was calculated based on Formula LVI above.

% N (Nitrogen) in shoot at flowering—% N content of dry matter in the shoot at flowering.

% N (Nitrogen) in head at flowering—% N content of dry matter in the head at flowering.

% N In (Nitrogen) shoot at harvest—% N content of dry matter in the shoot at harvest.

% N (Nitrogen) in grain at harvest—% N content of dry matter in the grain at harvest.

Data parameters collected are summarized in Table 165 herein below.

TABLE 165

*Sorghum* correlated parameters under normal and low N conditions (vectors)

| Correlated parameter with | Correlation ID |
|---|---|
| 1000 grain weight [gr.] | 1 |
| All stem volume (F) [cm$^3$] | 2 |
| Average heads weight per plant [F][gr.] | 3 |
| % Canopy coverage (F) [%] | 4 |
| Flag leaf thickness (F) [mm] | 5 |
| Grain area [cm$^2$] | 6 |
| Grain fill duration [GDD] | 7 |
| Grain fill duration [number] | 8 |
| Grain NUtE [Float value] | 9 |
| Grains number per dunam [number] | 10 |
| Grains per plant [number] | 11 |
| Grains yield per dunam [kg] | 12 |
| Grains yield per head [gr.] | 13 |
| Grains yield per plant (plot) [gr.] | 14 |
| Harvest index (plot) [ratio] | 15 |
| Head area [cm$^2$] | 16 |
| Heads dry weight per dunam [kg] | 17 |
| Heads index [ratio] | 18 |
| Heads per plant [number] | 19 |
| Leaf carbon isotope discrimination (H) [%] | 20 |
| Leaf temperature at flowering [CA°] | 21 |
| Leaf water content at flowering [%] | 22 |
| Leaves area (F) [cm$^2$] | 23 |
| Lower stem width (F) [mm] | 24 |
| Main head grains num per plant [num] | 25 |
| Main head grains yield per plant [gr.] | 26 |
| N Harvest index [Ratio] | 27 |
| % N in (Nitrogen) shoot (F) [%] | 28 |
| % N (Nitrogen) in grain (H) [%] | 29 |
| % N (Nitrogen) in head (F) [%] | 30 |
| % N Nitrogen in shoot (F) [%] | 31 |
| NUE [kg/kg] | 32 |
| Number days to anthesis [GDD | 33 |
| Number days to anthesis [number] | 34 |
| Number days to flag leaf senescence [GDD] | 35 |
| Number days to flag leaf senescence [number] | 36 |
| Number days to heading [GDD] | 37 |
| Number days to maturity [GDD] | 38 |
| NUpE [kg/kg] | 39 |

TABLE 165-continued

Sorghum correlated parameters under normal and low N conditions (vectors)

| Correlated parameter with | Correlation ID |
|---|---|
| PAR LAI | 40 |
| Plant height growth [cm/day] | 41 |
| Relative water content (F) [%], Normal | 42 |
| RUE (Radiation use efficiency) - (gr/% canopy coverage) | 43 |
| Secondary heads grains yield per plant [gr.] | 44 |
| SPAD at vegetative stage [SPAD unit] | 45 |
| SPAD (F) [SPAD unit] | 46 |
| SPAD (GF) [SPAD unit] | 47 |
| Specific leaf area (F) [cm$^2$/gr.] | 48 |
| Stem water content (F) [%] | 49 |
| Tillering per plant [num] | 50 |
| Total dry matter per plant at harvest/water until maturity [gr./lit] | 51 |
| Total dry matter per plant (F) (gr.) | 52 |
| Total dry matter per plant [kg] | 53 |
| Total heads per dunam (H) [number] | 54 |
| Total NUtE [Float value] | 55 |
| Upper stem width (F) [mm] | 56 |
| Vegetative DW per plant (F) [gr.] | 57 |
| Vegetative DW per plant [kg] | 58 |
| Vegetative DW per plant/water until maturity [gr./lit] | 59 |
| % yellow leaves number (F) [%] | 60 |
| % yellow leaves number (H) [%] | 61 |
| Yield per dunam filling rate [kg/day] | 62 |
| Yield per dunam/water until maturity [kg/lit] | 63 |
| Yield per plant filling rate [gr./day] | 64 |
| Yield/SPAD (GF) [kg/SPAD units] | 65 |

Table 165. Provided are the *Sorghum* correlated parameters vectors).
"kg" = kilograms;
"gr." = grams;
"RP" = Rest of plot;
"SP" = Selected plants;
"lit" = liter;
"ml"—milliliter;
"cm" = centimeter;
"num" = number;
"GDD"—Growing degree day;
"SPAD" = chlorophyll levels;
"FW" = Plant Fresh weight;
"DW" = Plant Dry weight;
"GF" = grain filling growth stage;
"F" = flowering stage;
"H" = harvest stage;
"N"—Nitrogen;
"NupE"—Nitrogen uptake efficiency;
"VDW" = vegetative dry weight;
"TDM" = Total dry matter.
"RUE" = radiation use efficiency;
"RWC" relative water content;
"veg" = vegetative stage.

Experimental Results

Thirty-six different *sorghum* inbreds and hybrids lines were grown and characterized for different parameters (Table 165). The average for each of the measured parameter was calculated using the JMP software (Tables 166-175) and a subsequent correlation analysis was performed (Tables 176-177). Results were then integrated to the database.

TABLE 166

Measured parameters in *Sorghum* accessions under normal conditions

| Corr. ID | Line-1 | Line-2 | Line-3 | Line-4 | Line-5 | Line-6 | Line-7 |
|---|---|---|---|---|---|---|---|
| 4 | 87.3 | 90.1 | 75.7 | 75.6 | 76.1 | 69.9 | 84.4 |
| 60 | 0.144 | 0.244 | 0.08 | 0.134 | 0.274 | 0.132 | 0.101 |
| 61 | 0.265 | 0.157 | 0.323 | 0.389 | 0.323 | 0.095 | 0.139 |
| 29 | 1.91 | NA | 1.621 | 2.086 | NA | 1.594 | NA |
| 30 | 2.315 | NA | 2.722 | 1.844 | NA | 1.97 | NA |
| 31 | 1.729 | NA | 1.414 | 1.303 | NA | 1.602 | NA |
| 28 | 1.08 | NA | 0.559 | 0.722 | NA | 1.112 | NA |
| 1 | 29.8 | 32 | 33.8 | 31.3 | 30 | 24.1 | 18.4 |
| 2 | 23261.2 | 19941.6 | 14878.4 | 31092.4 | 39294.6 | 13029.4 | 33015.4 |
| 3 | 17 | 17.7 | 9.7 | 10.2 | 37.7 | 11.1 | 11.3 |
| 5 | 0.179 | 0.144 | 0.144 | 0.164 | 0.127 | 0.186 | 0.138 |
| 9 | 18.51 | NA | 35.87 | 31.06 | NA | 30.94 | NA |
| 6 | 0.119 | 0.133 | 0.13 | 0.136 | 0.13 | 0.105 | 0.092 |
| 7 | 459.6 | 407.9 | 396.8 | 423.6 | 358.8 | 414.6 | 305.6 |
| 8 | 35 | 32.4 | 31 | 32.4 | 27.6 | 32.8 | 23.4 |
| 10 | 27117640 | 27702000 | 25021020 | 29202780 | 21264980 | 25132460 | 20308520 |
| 11 | 2766.2 | 3370.4 | 3162.2 | 4531.2 | 3464.5 | 3570.4 | 2267.5 |
| 12 | 818.9 | 893.2 | 861.8 | 912.8 | 661.8 | 612.2 | 421 |
| 13 | 30.3 | 32.8 | 25.4 | 21.4 | 37.3 | 33.2 | 17 |
| 14 | 77.2 | 103.5 | 100.8 | 130.3 | 100.3 | 72.4 | 43.5 |
| 15 | 0.225 | 0.271 | 0.281 | 0.335 | 0.271 | 0.306 | 0.126 |
| 16 | 134.4 | 96.7 | 112.8 | 101.7 | 106.1 | 84.1 | 105.6 |
| 17 | 1.046 | 1.062 | 0.956 | 1.01 | 0.797 | 0.768 | 0.747 |
| 18 | 0.345 | 0.399 | 0.393 | 0.453 | 0.384 | 0.536 | 0.344 |
| 19 | 1.12 | 1.31 | 1.71 | 2.28 | 1.14 | 1.15 | 1.29 |
| 20 | −12.8578 | −13.2 | −13.1156 | −12.8344 | −13.16 | −13.0467 | −13.16 |
| 22 | 66 | NA | 74.1 | 71.8 | 63.3 | 77.5 | 70 |
| 23 | 16514.4 | 12058.4 | 12787 | 9932.2 | 11459.3 | 9116.4 | 9023.2 |
| 24 | 20 | 15.5 | 14.2 | 18.4 | 16 | 16.4 | 15.4 |
| 25 | 1322.3 | 1669.9 | 1615.1 | 1624.3 | 1784.3 | 1480.9 | 1008.7 |
| 26 | 38.2 | 53.8 | 55.6 | 51 | 53.4 | 36 | 19.8 |

TABLE 166-continued

Measured parameters in Sorghum accessions under normal conditions

| Corr. ID | Line-1 | Line-2 | Line-3 | Line-4 | Line-5 | Line-6 | Line-7 |
|---|---|---|---|---|---|---|---|
| 27 | 0.354 | NA | 0.582 | 0.648 | NA | 0.493 | NA |
| 32 | 45.5 | 49.6 | 47.9 | 50.7 | 36.8 | 34 | 23.4 |
| 39 | 1.913 | NA | 1.325 | 1.56 | NA | 1.101 | NA |
| 33 | 777.5 | 709.7 | 740.6 | 768.4 | 773 | 725.7 | 831.9 |
| 34 | 89.2 | 83 | 85.8 | 88.4 | 88.8 | 84.2 | 93.4 |
| 35 | 1469.5 | 1165.8 | 1254.9 | 1441.2 | 1142.7 | NA | 1272 |
| 36 | 141 | 119 | 125.5 | 139 | 117.2 | NA | 126.8 |
| 37 | 739.4 | 625.3 | 709 | 721.1 | 763.8 | 629.6 | 769.5 |
| 38 | 1237.2 | 1117.6 | 1137.4 | 1191.9 | 1131.7 | 1137.4 | 1137.4 |
| 40 | 5.34 | 5.58 | 4.42 | 3.76 | 3.62 | 4.01 | 4.92 |
| 41 | 1.24 | 2.55 | 2.04 | 2.01 | 2.76 | 1.12 | 2.18 |
| 43 | 2.27 | 1.34 | 1.03 | 1.11 | 2.1 | 1.07 | 1.96 |
| 42 | 90.8 | 91.7 | 91.2 | 88.7 | 88.3 | 84.5 | 87.2 |
| 46 | 56.9 | 52.5 | 49.2 | 55.1 | 48.2 | 53.3 | 48.9 |
| 47 | 56.3 | 56.3 | 53.3 | 59.1 | 52 | 54.2 | 47 |
| 45 | 48.5 | 42.4 | 43.1 | 42.1 | 39.3 | 46 | 33.3 |
| 44 | 2.45 | 7 | 2.2 | 30.99 | 5.72 | 2.84 | 2.33 |
| 48 | 137.5 | 148.3 | 164.8 | 175.8 | 162.4 | 150.5 | 110.2 |
| 49 | 53.8 | 77.8 | 79.8 | 78.5 | 67.2 | 78 | 71.9 |
| 50 | 1.23 | 3.28 | 4.13 | 3.17 | 1.1 | 2.33 | 3.07 |
| 55 | 91.3 | NA | 123.2 | 89 | NA | 93.7 | NA |
| 52 | 198.5 | 120.9 | 77.8 | 83.1 | 159.6 | 70.7 | 143.3 |
| 53 | 0.193 | 0.218 | 0.198 | 0.235 | 0.217 | 0.137 | 0.172 |
| 51 | 0.0379 | 0.0469 | 0.0425 | 0.0478 | 0.0465 | 0.0297 | 0.0369 |
| 54 | 25950 | 25250 | 31350 | 37950 | 15917.6 | 16250 | 23200 |
| 56 | 11.28 | 9.93 | 8.12 | 10.66 | 9.86 | 9.02 | 8.27 |
| 57 | 181.5 | 103.2 | 68 | 73 | 121.9 | 59.5 | 132 |
| 59 | 0.025 | 0.0283 | 0.0259 | 0.0263 | 0.0287 | 0.0129 | 0.024 |
| 58 | 0.097 | 0.103 | 0.106 | 0.088 | 0.101 | 0.08 | 0.126 |
| 62 | 23.4 | 27.6 | 27.8 | 28.2 | 23.9 | 20 | 17.9 |
| 63 | 1.62 | 1.92 | 1.85 | 1.85 | 1.42 | 1.26 | 0.9 |
| 64 | 1.11 | 1.88 | 1.86 | 2.54 | 2.1 | 1.13 | 0.93 |
| 65 | 24 | 33.7 | 34 | 48.1 | 38 | 28.4 | 23.7 |

Table 166: Provided are the values of each of the parameters (as described above) measured in Sorghum accessions ("L" = Line) under normal conditions. Growth conditions are specified in the experimental procedure section.

TABLE 167

Measured parameters in additional Sorghum accessions under normal conditions

| Corr. ID | Line-8 | Line-9 | Line-10 | Line-11 | Line-12 | Line-13 | Line-14 |
|---|---|---|---|---|---|---|---|
| 4 | NA | 89.5 | 95.1 | 92.8 | 67.3 | 80.4 | 72.2 |
| 60 | 0 | 0.061 | 0.145 | 0.13 | 0.183 | 0.096 | 0.121 |
| 61 | 0.166 | 0.578 | 0.55 | 0.321 | 0.231 | 0.04 | 0.129 |
| 29 | NA | 1.796 | NA | NA | NA | NA | NA |
| 30 | NA | 1.369 | NA | NA | NA | NA | NA |
| 31 | NA | 1.795 | NA | NA | NA | NA | NA |
| 28 | NA | 1.151 | NA | NA | NA | NA | NA |
| 1 | 22.6 | 23.2 | 17.3 | 27 | 24.7 | 22.6 | 16.8 |
| 2 | 9480.2 | 21372.2 | 57928.1 | 42021.2 | 15340.9 | 10035.2 | 20685.1 |
| 3 | 6.8 | 12 | 22.4 | 35.7 | 8.8 | 10.3 | 24 |
| 5 | NA | 0.179 | 0.15 | 0.206 | 0.178 | 0.197 | 0.173 |
| 9 | NA | 26.69 | NA | NA | NA | NA | NA |
| 6 | 0.119 | 0.098 | 0.086 | 0.116 | 0.105 | 0.103 | 0.083 |
| 7 | 433.9 | 425.1 | 285.1 | 479.2 | 478.1 | 528.2 | 401.2 |
| 8 | 37 | 32.4 | 20.8 | 35.2 | 37.4 | 41 | 29.3 |
| 10 | 6938386 | 26620980 | 23566280 | 16059440 | 10047874 | 24969700 | 15586667 |
| 11 | 883.9 | 3870.3 | 3226.6 | 3209.9 | 1567.8 | 2899.6 | 3451.8 |
| 12 | 154.3 | 663.3 | 457 | 473.8 | 257 | 664.8 | 297.9 |
| 13 | 8.6 | 27.9 | 30.8 | 39.5 | 9.2 | 29 | 15.1 |
| 14 | 18.7 | 89.4 | 57.3 | 86.9 | 37.1 | 67.9 | 62.4 |
| 15 | 0.172 | 0.295 | 0.062 | 0.177 | 0.168 | 0.291 | 0.15 |
| 16 | 226.2 | 156.4 | 120.4 | 210.5 | 121.3 | 74.8 | 244.5 |
| 17 | 0.241 | 0.85 | 0.588 | 0.613 | 0.495 | 0.846 | 0.336 |
| 18 | 0.414 | 0.485 | 0.127 | 0.31 | 0.476 | 0.443 | 0.322 |
| 19 | 1.04 | 1.4 | 0.95 | 1 | 1.32 | 1.26 | 1.43 |
| 20 | −13.4733 | −12.825 | −12.99 | −13.3789 | −12.5867 | −13.14 | NA |
| 22 | 70.2 | 73.2 | 71.1 | 69.7 | 80.1 | 75.6 | 70.6 |
| 23 | 3520.4 | 12434.2 | 18050.2 | 16771.2 | 7915.8 | 8866.2 | 18167.7 |

TABLE 167-continued

Measured parameters in additional *Sorghum* accessions under normal conditions

| Corr. ID | Line-8 | Line-9 | Line-10 | Line-11 | Line-12 | Line-13 | Line-14 |
|---|---|---|---|---|---|---|---|
| 24 | 9.3 | 20.5 | 21.9 | 22.6 | 17.9 | 13.7 | 24.7 |
| 25 | 450.1 | 1979.2 | 1582.7 | 1734.6 | 932.8 | 1362.5 | 2390.5 |
| 26 | 10 | 46.6 | 28.5 | 46.9 | 22.2 | 31.1 | 43.4 |
| 27 | NA | 0.479 | NA | NA | NA | NA | NA |
| 32 | 8.6 | 36.9 | 25.4 | 26.3 | 14.3 | 36.9 | 16.6 |
| 39 | NA | 1.527 | NA | NA | NA | NA | NA |
| 33 | 650.1 | 790.9 | 1167.9 | 1008.4 | 719 | 721.1 | 1091.8 |
| 34 | 77.8 | 90.2 | 119 | 107 | 83.8 | 84 | 113.3 |
| 35 | 1078.8 | 1581.4 | 1588.7 | 1630.5 | 1580.2 | 1198.4 | 1628.1 |
| 36 | 112.6 | 148.8 | 149.2 | 152.2 | 148.7 | 121.3 | 152 |
| 37 | 630.5 | 756.1 | NA | 945.2 | 621.2 | 663.5 | 945.2 |
| 38 | 1084 | 1216 | 1453 | 1487.5 | 1197.2 | 1122.6 | 1493 |
| 40 | NA | 6.04 | 7.09 | 3.9 | 2.94 | 4.6 | 2.36 |
| 41 | 2.84 | 0.82 | 1.49 | 1.2 | 1.11 | 1.2 | 0.62 |
| 43 | NA | 1.21 | 3.13 | 2.5 | 1.09 | 0.85 | 3.22 |
| 42 | 91.5 | 84 | 85.9 | 89 | 85.5 | 88 | 89.7 |
| 46 | NA | 57.6 | 53.6 | 59.8 | 50.9 | 54.5 | 58.9 |
| 47 | 60.1 | 59.9 | 50.5 | 58.6 | 51.9 | 52.7 | 57.1 |
| 45 | 48.9 | 45.6 | 39.6 | 43.7 | 45.2 | 42.7 | 37 |
| 44 | 0.11 | 4.37 | 0.21 | NA | 2.75 | 1.47 | 0.7 |
| 48 | 191.1 | 123.3 | 143.9 | 118.6 | 171.9 | 154.9 | 121.1 |
| 49 | 83.4 | 72.3 | 74.5 | 63.2 | 76.2 | 75.9 | 56 |
| 50 | 1.43 | 2.93 | 1.7 | 2.23 | 3.27 | 2.13 | 1.94 |
| 55 | NA | 88.5 | NA | NA | NA | NA | NA |
| 52 | 26 | 108.5 | 292.9 | 232.7 | 72.5 | 68.4 | 233.2 |
| 53 | 0.06 | 0.17 | 0.415 | 0.248 | 0.132 | 0.107 | 0.252 |
| 51 | 0.0135 | 0.0333 | 0.0736 | 0.0441 | 0.0284 | 0.0221 | 0.0447 |
| 54 | 17500 | 22300 | 14750 | 11450 | 24700 | 21250 | 18694.4 |
| 56 | 7.78 | 9.95 | 7.34 | 11.88 | 9.94 | 9.19 | 9.46 |
| 57 | 19.2 | 96.5 | 278.5 | 197.1 | 63.7 | 58.1 | 209.2 |
| 59 | 0.008 | 0.0174 | 0.0644 | 0.0308 | 0.0154 | 0.0125 | 0.0305 |
| 58 | 0.033 | 0.074 | 0.474 | 0.178 | 0.058 | 0.078 | 0.126 |
| 62 | 4 | 20.5 | 21.9 | 13.2 | 6.9 | 19.8 | 10.8 |
| 63 | 0.32 | 1.31 | 0.81 | 0.84 | 0.51 | 1.39 | 0.53 |
| 64 | 0.28 | 1.58 | 1.39 | 1.36 | 0.67 | 0.86 | 1.51 |
| 65 | 7.5 | 36 | 33 | 29.8 | 20.2 | 26.2 | 42.1 |

Table 167: Provided are the values of each of the parameters (as described above) measured in *Sorghum* accessions ("L" = Line) under normal conditions. Growth conditions are specified in the experimental procedure section.

TABLE 168

Measured parameters in additional *Sorghum* accessions under normal conditions

| Corr. ID | Line-15 | Line-16 | Line-17 | Line-18 | Line-19 | Line-20 | Line-21 |
|---|---|---|---|---|---|---|---|
| 4 | 72.7 | 66.3 | 90.9 | 68.5 | 93 | 62.2 | 85.5 |
| 60 | 0.188 | 0.229 | 0.246 | 0.036 | 0.173 | 0.015 | 0.147 |
| 61 | 0.142 | 0.213 | 0.272 | 0.241 | 0.302 | 0.141 | 0.042 |
| 29 | NA | NA | NA | NA | NA | NA | NA |
| 30 | NA | NA | NA | NA | NA | NA | NA |
| 31 | NA | NA | NA | NA | NA | NA | NA |
| 28 | NA | NA | NA | NA | NA | NA | NA |
| 1 | 28.2 | 21.8 | 16.9 | 37 | 18.2 | 28.8 | 17.4 |
| 2 | 12649.4 | 15432.6 | 14500.7 | 26609.8 | 17621.5 | 13556.3 | 12018.1 |
| 3 | 9.6 | 14.1 | 7.7 | 24.7 | 24.1 | 13.5 | 16.6 |
| 5 | 0.169 | 0.195 | 0.144 | 0.209 | 0.162 | 0.204 | 0.189 |
| 9 | NA | NA | NA | NA | NA | NA | NA |
| 6 | 0.122 | 0.115 | 0.082 | 0.146 | 0.093 | 0.121 | 0.089 |
| 7 | 364 | 331.6 | 341.9 | 390.9 | 395.4 | 385.1 | 303.8 |
| 8 | 29 | 25.2 | 26.2 | 29.8 | 29.8 | 29.8 | 23.2 |
| 10 | 23737260 | 25534520 | 19319316 | 12802788 | 14629600 | 16643442 | 31788060 |
| 11 | 3187.1 | 3304.8 | 2184.2 | 2187.1 | 1951.8 | 2731.1 | 3818.6 |
| 12 | 731.8 | 609.8 | 378.1 | 470.8 | 291.5 | 496.6 | 611 |
| 13 | 33 | 29.5 | 14.9 | 22.2 | 8.1 | 29.6 | 30.1 |
| 14 | 88 | 72.9 | 39.1 | 76 | 37 | 75.9 | 67.5 |
| 15 | 0.324 | 0.322 | 0.187 | 0.179 | 0.11 | 0.351 | 0.264 |
| 16 | 82 | 106.1 | 129.3 | 86.3 | 83.3 | 114 | 90 |
| 17 | 0.86 | 0.762 | 0.646 | 0.602 | 0.619 | 0.523 | 0.717 |
| 18 | 0.472 | 0.519 | 0.302 | 0.326 | 0.278 | 0.508 | 0.35 |
| 19 | 1.09 | 1 | 1.24 | 1.53 | 2.06 | 1.03 | 1.12 |

TABLE 168-continued

Measured parameters in additional *Sorghum* accessions under normal conditions

| Corr. ID | Line-15 | Line-16 | Line-17 | Line-18 | Line-19 | Line-20 | Line-21 |
|---|---|---|---|---|---|---|---|
| 20 | −12.9933 | −12.7333 | −13.1533 | −13.2933 | −13.0033 | −13.1933 | −12.82 |
| 22 | 75.3 | 63.1 | 71.9 | 76.1 | 66.5 | 78.5 | 76.4 |
| 23 | 16019.6 | 20833 | 13190.4 | 16299.5 | 12096.8 | 11573.2 | 11655.8 |
| 24 | 16.1 | 20.9 | 16.9 | 22.3 | 16.3 | 19.2 | 19.1 |
| 25 | 1554.3 | 1950.9 | 993.2 | 848.9 | 686.6 | 1329 | 1808.6 |
| 26 | 43.2 | 43.2 | 18 | 31.8 | 13 | 37.8 | 32.5 |
| 27 | NA | NA | NA | NA | NA | NA | NA |
| 32 | 40.7 | 33.9 | 21 | 26.2 | 16.2 | 27.6 | 33.9 |
| 39 | NA | NA | NA | NA | NA | NA | NA |
| 33 | 728.4 | 892.5 | 795.5 | 843.1 | 940.9 | 769.5 | 845 |
| 34 | 84.6 | 98 | 90.6 | 94.2 | 101.8 | 88.2 | 94.4 |
| 35 | 1242.8 | NA | NA | 1628.1 | 1548.8 | NA | 1412 |
| 36 | 124.6 | NA | NA | 152 | 146.5 | NA | 137 |
| 37 | 697.4 | 853.2 | 728.4 | 755.8 | 892.4 | 655.2 | 763.8 |
| 38 | 1092.4 | 1224 | 1137.4 | 1234 | 1336.3 | 1154.5 | 1148.8 |
| 40 | 3.76 | 3.53 | 6.38 | 3.87 | 3.98 | 3.05 | 4.78 |
| 41 | 1.41 | 0.86 | 0.9 | 1.22 | 1.52 | 0.73 | 0.67 |
| 43 | 1.06 | 2.42 | 0.89 | 3.96 | 1.63 | 1.32 | 2.27 |
| 42 | 91.9 | 91.4 | 83.6 | 90.9 | 87.9 | 90.2 | 89.5 |
| 46 | 52.6 | 49.1 | 53.9 | 61.5 | 51.4 | 51.6 | 47.9 |
| 47 | 54.3 | 49.8 | 54.8 | 61.8 | 54.2 | 55.6 | 51.6 |
| 45 | 45.1 | 43 | 40.2 | 42.4 | 31.7 | 49.6 | 41.8 |
| 44 | 0.95 | 0.25 | 5.63 | 10.96 | 5.36 | 5.89 | 1.7 |
| 48 | 179.1 | 183 | 159.2 | 157.5 | 111.3 | 163.5 | 142.6 |
| 49 | 82.2 | 54.7 | 76.7 | 48.3 | 62.8 | 81 | 29.1 |
| 50 | 1.8 | 1.37 | 1.89 | 4.5 | 5.12 | 2.7 | 1.1 |
| 55 | NA | NA | NA | NA | NA | NA | NA |
| 52 | 74.4 | 153.1 | 81.3 | 258.1 | 151.9 | 76.8 | 187 |
| 53 | 0.13 | 0.126 | 0.126 | 0.226 | 0.158 | 0.132 | 0.132 |
| 51 | 0.028 | 0.0249 | 0.027 | 0.0452 | 0.0283 | 0.0284 | 0.0284 |
| 54 | 19607.1 | 18300 | 23150 | 22687.5 | 43348.2 | 14873.5 | 18625.7 |
| 56 | 8 | 11.43 | 7.69 | 12.31 | 6.85 | 10.76 | 7.71 |
| 57 | 64.8 | 139 | 73.6 | 233.4 | 127.8 | 63.3 | 170.4 |
| 59 | 0.0149 | 0.012 | 0.0191 | 0.0306 | 0.018 | 0.0135 | 0.0186 |
| 58 | 0.078 | 0.058 | 0.052 | 0.144 | 0.131 | 0.055 | 0.08 |
| 62 | 25.2 | 24.2 | 14.9 | 15.9 | 10.4 | 16.4 | 27.2 |
| 63 | 1.57 | 1.2 | 0.81 | 0.94 | 0.53 | 1.07 | 1.31 |
| 64 | 1.5 | 1.72 | 0.81 | 1.45 | 0.63 | 1.52 | 1.5 |
| 65 | 28.8 | 39.4 | 20.5 | 19.3 | 18.4 | 27.8 | 36.2 |

Table 168: Provided are the values of each of the parameters (as described above) measured in *Sorghum* accessions ("L" = Line) under normal conditions. Growth conditions are specified in the experimental procedure section.

TABLE 169

Measured parameters in additional *Sorghum* accessions under normal conditions

| Corr. ID | Line-22 | Line-23 | Line-24 | Line-25 | Line-26 | Line-27 | Line-28 |
|---|---|---|---|---|---|---|---|
| 4 | 76 | 92.1 | 88.4 | 62.2 | 54.7 | 94.4 | 57.5 |
| 60 | 0.043 | 0.125 | 0.245 | 0.128 | 0.114 | 0.327 | 0.077 |
| 61 | 0.059 | 0.413 | 0.788 | 0.188 | 0.152 | 0.635 | 0.139 |
| 29 | NA | NA | 1.542 | 1.604 | NA | NA | NA |
| 30 | NA | NA | 1.862 | 1.651 | NA | NA | NA |
| 31 | NA | NA | 0.795 | 1.293 | NA | NA | NA |
| 28 | NA | NA | 0.408 | 0.834 | NA | NA | NA |
| 1 | 21.4 | 28 | 27 | 29 | 20.9 | 29.4 | 22.5 |
| 2 | 8397.1 | 28819.2 | 52862.1 | 23299.4 | 8716.9 | NA | 18934.9 |
| 3 | 8.6 | 27.6 | 17.5 | 15.5 | 15 | NA | 20.3 |
| 5 | NA | 0.164 | 0.175 | 0.147 | 0.153 | 0.17 | 0.177 |
| 9 | NA | NA | 35.13 | 39.99 | NA | NA | NA |
| 6 | 0.103 | 0.129 | 0.116 | 0.129 | 0.103 | 0.125 | 0.112 |
| 7 | 500.3 | 476.6 | 343.1 | 415.1 | 423.7 | 268.1 | 363.8 |
| 8 | 40.6 | 35.2 | 25 | 31.6 | 33 | 20.4 | 28.6 |
| 10 | 13130962 | 6653443 | 23933120 | 24881460 | 19456260 | 19639820 | 21045320 |
| 11 | 2058.7 | 1109.8 | 3819.2 | 5346.8 | 2650.3 | 3204.7 | 3102 |
| 12 | 307.6 | 221 | 685.9 | 792 | 449.8 | 626.1 | 497.1 |
| 13 | 13.3 | 8.4 | 37.6 | 48.3 | 25.1 | 31.6 | 30.9 |
| 14 | 44.3 | 33.6 | 101.5 | 153.4 | 56.4 | 93.6 | 69 |
| 15 | 0.271 | 0.076 | 0.174 | 0.367 | 0.25 | 0.238 | 0.245 |
| 16 | 55 | 200.5 | 136.5 | 192.1 | 85.9 | 119.3 | 151.3 |

TABLE 169-continued

Measured parameters in additional *Sorghum* accessions under normal conditions

| Corr. ID | Line-22 | Line-23 | Line-24 | Line-25 | Line-26 | Line-27 | Line-28 |
|---|---|---|---|---|---|---|---|
| 17 | 0.361 | 0.417 | 0.981 | 0.898 | 0.636 | 0.748 | 0.826 |
| 18 | 0.417 | 0.204 | 0.337 | 0.594 | 0.453 | 0.358 | 0.586 |
| 19 | 1.82 | 2.18 | 1.06 | 1.29 | 1.02 | 1.44 | 1.14 |
| 20 | −12.72 | −13.0767 | −12.4078 | −13.1378 | −12.8267 | −12.6767 | −13.0033 |
| 22 | NA | 67.3 | 70 | 68.2 | 72.9 | 67.3 | 76.1 |
| 23 | 6785.6 | 14171.8 | 21989.2 | 13038.2 | 10639.6 | NA | 14682.2 |
| 24 | 15 | 20.3 | 21.9 | 18.9 | 18.9 | 23.2 | 22 |
| 25 | 756.2 | 573.1 | 2299.1 | 3152.2 | 1392.1 | 1579.3 | 1438 |
| 26 | 16.8 | 17.5 | 62.2 | 89.3 | 30 | 46.8 | 33.5 |
| 27 | NA | NA | 0.542 | 0.641 | NA | NA | NA |
| 32 | 17.1 | 12.3 | 38.1 | 44 | 25 | 34.8 | 27.6 |
| 39 | NA | NA | 1.211 | 1.089 | NA | NA | NA |
| 33 | 611.9 | 996.1 | 1115.4 | 782.1 | 736.1 | 945.2 | 745.5 |
| 34 | 74.4 | 106 | 115.2 | 89.6 | 85.4 | 102 | 86.2 |
| 35 | NA | 1579.1 | 1498.6 | 1343.5 | NA | 1610.7 | 1084 |
| 36 | NA | 148.6 | 143 | 132 | NA | 150.8 | 113 |
| 37 | 530.2 | 945.2 | 945.2 | 740.6 | 693.3 | 879.2 | 709 |
| 38 | 1112.2 | 1472.8 | 1458.5 | 1197.2 | 1159.8 | 1213.4 | 1109.2 |
| 40 | 3.56 | 4.34 | 3.26 | 2.88 | 2.37 | 7.28 | 2.81 |
| 41 | 0.97 | 1.15 | 1.12 | 1.6 | 0.78 | 0.97 | 0.87 |
| 43 | 0.66 | 3.19 | 3.36 | 2.57 | 1.45 | NA | 1.45 |
| 42 | 94.6 | 88.7 | 89.2 | 89.3 | 90.5 | 91.9 | 91.3 |
| 46 | 52.7 | 54.7 | 52.5 | 57.7 | 53.5 | 50.2 | 54.9 |
| 47 | 47.2 | 56 | 52.4 | 57.6 | 56.6 | 52.3 | 54.4 |
| 45 | 40.9 | 35.7 | 41.2 | 43.3 | 44.9 | 40.2 | 43 |
| 44 | 4.1 | 1.83 | NA | 5.05 | 1.25 | NA | NA |
| 48 | 166.9 | 108.4 | 139.9 | 164.9 | 164.4 | NA | 156.7 |
| 49 | NA | 57.3 | 68.5 | 53.5 | 79.6 | NA | 84.6 |
| 50 | 3.5 | 4.83 | 1 | 1.2 | 2.07 | 1.2 | 1 |
| 55 | NA | NA | 169.7 | 105.9 | NA | NA | NA |
| 52 | 49.9 | 292.6 | 293.9 | 134.6 | 70.7 | NA | 81.5 |
| 53 | 0.068 | 0.249 | 0.298 | 0.24 | 0.119 | 0.176 | 0.123 |
| 51 | 0.0145 | 0.0442 | 0.0529 | 0.0488 | 0.0251 | 0.0352 | 0.0265 |
| 54 | 22218.2 | 27333.3 | 15850 | 13892.9 | 16300 | 17150 | 14650 |
| 56 | 8.24 | 8.41 | 11.43 | 10.41 | 9.62 | 11.29 | 11.57 |
| 57 | 41.3 | 265 | 276.4 | 119.1 | 55.6 | NA | 61.2 |
| 59 | 0.0084 | 0.0357 | 0.035 | 0.0198 | 0.0138 | 0.0224 | 0.011 |
| 58 | 0.062 | 0.234 | 0.219 | 0.087 | 0.064 | 0.153 | 0.089 |
| 62 | 7.6 | 6.5 | 27.8 | 25.6 | 14 | 30.6 | 17.4 |
| 63 | 0.66 | 0.39 | 1.22 | 1.62 | 0.96 | 1.25 | 1.07 |
| 64 | 0.51 | 0.58 | 2.5 | 2.9 | 0.92 | 2.42 | 1.17 |
| 65 | 20.6 | 11.5 | 44 | 53.3 | 25.1 | 31.3 | 26.6 |

Table 169: Provided are the values of each of the parameters (as described above) measured in *Sorghum* accessions ("L" = Line) under normal conditions. Growth conditions are specified in the experimental procedure section.

TABLE 170

Measured parameters in additional *Sorghum* accessions under normal conditions

| Corr. ID | Line-29 | Line-30 | Line-31 | Line-32 | Line-33 | Line-34 | Line-35 | Line-36 |
|---|---|---|---|---|---|---|---|---|
| 4 | 85.8 | 88.8 | 92.6 | 87.3 | 81.6 | 90.1 | 66.2 | 82.3 |
| 60 | 0.09 | 0.127 | 0.3 | 0.171 | 0.033 | 0.087 | 0.24 | 0.131 |
| 61 | 0 | 0.018 | 0.168 | 0.256 | 0.117 | 0.148 | 0.226 | 0.263 |
| 29 | NA | NA | 1.841 | NA | NA | 1.557 | NA | 1.84 |
| 30 | NA | NA | 1.927 | NA | NA | 1.704 | NA | 2.047 |
| 31 | NA | NA | 1.324 | NA | NA | 1.235 | NA | 1.34 |
| 28 | NA | NA | 0.971 | NA | NA | 1.231 | NA | 0.631 |
| 1 | 25.9 | 28.4 | 26.8 | 21.8 | 25.4 | 23.5 | 22.6 | 28.3 |
| 2 | 14471.9 | 11682.4 | 12897.2 | 27195.9 | 18515.8 | 16533.5 | 14367.4 | 45771.7 |
| 3 | 14.8 | 12.2 | 9.9 | 29.6 | 38 | 17 | 19 | 24.6 |
| 5 | NA | NA | NA | 0.214 | 0.189 | 0.172 | 0.168 | 0.156 |
| 9 | NA | NA | 32.59 | NA | NA | 26.71 | NA | 19.84 |
| 6 | 0.11 | 0.12 | 0.111 | 0.102 | 0.111 | 0.109 | 0.104 | 0.116 |
| 7 | 525.9 | 525.9 | 493.6 | 351.9 | 425.1 | 394.9 | 413.2 | 438.2 |
| 8 | 42.5 | 42.5 | 40.2 | 26.8 | 32.5 | 30 | 31.4 | 33.4 |
| 10 | 25439325 | 22595225 | 23516220 | 35903040 | 35910300 | 30637940 | 37887500 | 22720400 |
| 11 | 3607.6 | 2713.3 | 3012.8 | 5869.7 | 5994.7 | 4733.1 | 4927.1 | 3710.2 |
| 12 | 693.9 | 663 | 668.8 | 861.9 | 904.6 | 757.3 | 874.2 | 653.2 |
| 13 | 35.5 | 35.6 | 30 | 56 | 52.7 | 46.2 | 48.7 | 27.2 |

TABLE 170-continued

Measured parameters in additional *Sorghum* accessions under normal conditions

| Corr. ID | Line-29 | Line-30 | Line-31 | Line-32 | Line-33 | Line-34 | Line-35 | Line-36 |
|---|---|---|---|---|---|---|---|---|
| 14 | 91.9 | 74.1 | 80.3 | 130.1 | 122.6 | 108.7 | 112.8 | 99.9 |
| 15 | 0.358 | 0.345 | 0.316 | 0.284 | 0.312 | 0.307 | 0.308 | 0.135 |
| 16 | 115.1 | 141.7 | 99 | 174.1 | 245.3 | 195 | 180.4 | 136 |
| 17 | 0.816 | 0.81 | 0.845 | 1.027 | 1.014 | 0.968 | 1.139 | 0.787 |
| 18 | 0.545 | 0.583 | 0.549 | 0.466 | 0.556 | 0.464 | 0.472 | 0.223 |
| 19 | 1.15 | 1.12 | 1.22 | 1.06 | 1.14 | 1.1 | 1 | 1.46 |
| 20 | −13.36 | −13 | −13.0744 | −12.85 | NA | −12.5611 | −12.79 | −13.1378 |
| 22 | NA | NA | NA | 52.6 | 44.3 | 35.4 | 75.1 | 66 |
| 23 | 10885.2 | 9702 | 12009.2 | 20599.4 | 16039.2 | 17728.8 | 17360.8 | 15975.6 |
| 24 | 17.4 | 16.6 | 15.1 | 21.6 | 20.6 | 19.4 | 15.7 | 20.9 |
| 25 | 1964.2 | 1191.6 | 1513.4 | 2925.2 | 3386.4 | 2454.2 | 2247.4 | 2021.1 |
| 26 | 50.8 | 34 | 40.9 | 65.7 | 79.8 | 57.3 | 62.7 | 56.6 |
| 27 | NA | NA | 0.6 | NA | NA | 0.416 | NA | 0.365 |
| 32 | 38.6 | 36.8 | 37.2 | 47.9 | 50.3 | 42.1 | 48.6 | 36.3 |
| 39 | NA | NA | 1.259 | NA | NA | 1.475 | NA | 1.753 |
| 33 | 607.2 | 607.2 | 607.2 | 840 | 769.5 | 826.6 | 786.8 | 814 |
| 34 | 74 | 74 | 74 | 94 | 88.5 | 93 | 90 | 92 |
| 35 | NA | NA | NA | 1544.8 | NA | NA | NA | 1473.8 |
| 36 | NA | NA | NA | 146.2 | NA | NA | NA | 141.3 |
| 37 | 563.9 | 537.2 | 591 | 769.5 | 715.1 | 756.1 | 756.1 | 768.4 |
| 38 | 1133.1 | 1133.1 | 1100.8 | 1191.9 | 1194.6 | 1221.5 | 1200 | 1252.2 |
| 40 | 4.77 | 4.96 | 5.75 | 6.06 | 5.25 | 6.68 | 3.39 | 4.76 |
| 41 | 1.02 | 0.96 | 0.98 | 0.84 | 1.12 | 0.88 | 0.94 | 1.78 |
| 43 | 0.81 | 0.64 | 0.63 | 4.94 | 4.05 | 3.01 | 2.1 | 2.89 |
| 42 | 92.4 | 91.8 | 91.4 | 87.2 | 87.9 | 85.7 | 90.9 | 92.5 |
| 46 | 53.9 | 60.1 | 51.1 | 49.7 | 57 | 55.1 | 53.9 | 53.9 |
| 47 | 51.5 | 54.7 | 50.5 | 54.4 | 55.8 | 53.6 | 52.8 | 55.7 |
| 45 | 43.5 | 47.8 | 43.1 | 44.1 | 45.1 | 46.7 | 44.8 | 41.2 |
| 44 | 0.55 | 0.41 | 6.98 | 3.44 | 6.65 | 1.21 | NA | 7.5 |
| 48 | 173.3 | 151.9 | 167.2 | 104 | 82.3 | 66.9 | 172.6 | 131.3 |
| 49 | NA | NA | NA | 20.6 | 38 | 37.4 | 70.1 | 66.7 |
| 50 | 3.58 | 3.54 | 2.89 | 2.17 | 1 | 1.07 | 1.13 | 2.73 |
| 55 | NA | NA | 91.4 | NA | NA | 88.6 | NA | 129.5 |
| 52 | 68.2 | 56 | 59 | 403.1 | 323.4 | 264.5 | 140.9 | 231.1 |
| 53 | 0.141 | 0.11 | 0.128 | 0.25 | 0.227 | 0.198 | 0.198 | 0.397 |
| 51 | 0.0304 | 0.0237 | 0.0274 | 0.0511 | 0.0456 | 0.0396 | 0.0401 | 0.0786 |
| 54 | 19875 | 17979.2 | 21600 | 14064.3 | 16583.3 | 15400 | 16500 | 21250 |
| 56 | 10.1 | 8.91 | 8.77 | 10.07 | 11.5 | 8.81 | 8.56 | 10.1 |
| 57 | 53.3 | 43.8 | 49.1 | 373.5 | 285.5 | 247.5 | 121.9 | 206.5 |
| 59 | 0.0137 | 0.0115 | 0.0125 | 0.0272 | 0.0205 | 0.022 | 0.0213 | 0.061 |
| 58 | 0.056 | 0.062 | 0.074 | 0.128 | 0.072 | 0.083 | 0.083 | 0.283 |
| 62 | 16.3 | 15.6 | 16.5 | 32.2 | 27.4 | 25.1 | 27.8 | 20 |
| 63 | 1.49 | 1.42 | 1.44 | 1.74 | 1.81 | 1.52 | 1.77 | 1.29 |
| 64 | 1.2 | 0.8 | 1.12 | 2.5 | 2.4 | 1.92 | 2.01 | 1.84 |
| 65 | 38 | 22 | 32.7 | 54.3 | 58.9 | 46.1 | 50.5 | 39.9 |

Table 170: Provided are the values of each of the parameters (as described above) measured in *Sorghum* accessions ("L" = Line) under normal conditions. Growth conditions are specified in the experimental procedure section

TABLE 171

Measured parameters in *Sorghum* accessions under low N conditions

| Corr. ID | Line-1 | Line-2 | Line-3 | Line-4 | Line-5 | Line-6 | Line-7 |
|---|---|---|---|---|---|---|---|
| 4 | 71 | 80.8 | 71.1 | 62.9 | 65.1 | 74.3 | 83.1 |
| 60 | 0.149 | 0.204 | 0.123 | 0.14 | 0.289 | 0.063 | 0.099 |
| 61 | 0.303 | 0.177 | 0.091 | 0.303 | 0.321 | 0.048 | 0.275 |
| 29 | 2.012 | NA | 1.641 | 1.494 | NA | 1.565 | NA |
| 30 | 1.617 | NA | 2.306 | 1.38 | NA | 2.062 | NA |
| 31 | 1.223 | NA | 1.005 | 1.417 | NA | 1.674 | NA |
| 28 | 0.925 | NA | 0.667 | 0.58 | NA | 0.992 | NA |
| 1 | 29.8 | 30.6 | 35.4 | 30.7 | 29.2 | 23.4 | 20.1 |
| 2 | 21835.9 | 19319.4 | 15290.9 | 24497 | 44648.6 | 13714.8 | 30943.7 |
| 3 | 19.6 | 17.3 | 10 | 11.7 | 38.7 | 12.4 | 13.7 |
| 5 | 0.179 | 0.147 | 0.153 | 0.13 | 0.135 | 0.2 | 0.149 |
| 9 | 24.77 | NA | 29.66 | 37.89 | NA | 28.94 | NA |
| 6 | 0.121 | 0.127 | 0.132 | 0.133 | 0.13 | 0.103 | 0.094 |
| 7 | 444.5 | 380.4 | 439.6 | 373.5 | 273.3 | 428.1 | 285.1 |
| 8 | 33.8 | 29.6 | 35 | 28.5 | 26.2 | 33.6 | 21.8 |
| 10 | 22070840 | 24438020 | 21504340 | 21499680 | 20685020 | 21825800 | 16454200 |

TABLE 171-continued

Measured parameters in Sorghum accessions under low N conditions

| Corr. ID | Line-1 | Line-2 | Line-3 | Line-4 | Line-5 | Line-6 | Line-7 |
|---|---|---|---|---|---|---|---|
| 11 | 3110.7 | 3929.4 | 2654.6 | 3987.6 | 4127.2 | 3314.9 | 2216.5 |
| 12 | 661.8 | 769.5 | 745.2 | 653.3 | 610.1 | 581.2 | 324.5 |
| 13 | 34.2 | 35.1 | 23.1 | 18.8 | 42.8 | 38.9 | 15 |
| 14 | 88.1 | 116 | 87.4 | 113 | 115 | 79.5 | 42.2 |
| 15 | 0.238 | 0.281 | 0.245 | 0.294 | 0.27 | 0.3 | 0.126 |
| 16 | 135.4 | 108.3 | 102.8 | 108.1 | 134 | 94.1 | 97.7 |
| 17 | 0.871 | 0.883 | 0.818 | 0.737 | 0.685 | 0.673 | 0.505 |
| 18 | 0.419 | 0.408 | 0.364 | 0.414 | 0.39 | 0.447 | 0.31 |
| 19 | 1.15 | 1.35 | 1.64 | 2.16 | 0.99 | 1.13 | 1.15 |
| 20 | −12.7811 | −13.1067 | −12.9944 | −12.8322 | −13.0467 | −13.4367 | −12.9633 |
| 22 | 70.5 | NA | 71.9 | 71.8 | 61.3 | 76.6 | 65.1 |
| 23 | 16770.4 | 10615.2 | 9361.4 | 12263.6 | 12503.9 | 7283.2 | 7295.8 |
| 24 | 19.7 | 14.3 | 14.1 | 17.1 | 17.3 | 15.1 | 16.1 |
| 25 | 1700.3 | 2239.1 | 1281.7 | 1754.3 | 2275.7 | 1569.7 | 1123.2 |
| 26 | 49.9 | 68.3 | 45.8 | 53.9 | 67 | 37.5 | 23.1 |
| 27 | 0.498 | NA | 0.487 | 0.566 | NA | 0.453 | NA |
| 32 | 330.9 | 384.8 | 372.6 | 326.6 | 305.1 | 290.6 | 162.2 |
| 39 | 14.71 | NA | 12 | 8.51 | NA | 9.04 | NA |
| 33 | 814 | 751.3 | 689.4 | 782.1 | 781 | 720.6 | 863.6 |
| 34 | 92 | 86.8 | 81.2 | 89.6 | 89.5 | 84 | 95.8 |
| 35 | 1442 | 1139.8 | 1215.2 | 1357.9 | 1115.5 | NA | 1266.7 |
| 36 | 139 | 117 | 122.6 | 133 | 115.2 | NA | 126.4 |
| 37 | 762.2 | 669.1 | 675.1 | 757.6 | 757.6 | 649.4 | 823.4 |
| 38 | 1258.5 | 1131.7 | 1129 | 1154.5 | 1123.3 | 1148.8 | 1148.8 |
| 40 | 3.95 | 4.1 | 3.36 | 3.02 | 2.14 | 3.82 | 4.35 |
| 41 | 0.9 | 2.18 | 1.92 | 1.48 | 2.09 | 1.37 | 2.05 |
| 43 | 2.75 | 1.27 | 1.29 | 1.56 | 3.22 | 0.9 | 1.67 |
| 42 | 91.3 | 90.9 | 91.3 | 87.3 | 89.6 | 87.1 | 84.6 |
| 46 | 56.3 | 49.7 | 47 | 48.6 | 42.8 | 54.8 | 43.7 |
| 47 | 54.5 | 51.7 | 47.5 | 48.7 | 44.6 | 52.8 | 47.8 |
| 45 | 50.2 | 39.1 | 42.4 | 38.9 | 36.2 | 41.5 | 37 |
| 44 | 6.43 | 0.79 | 3.96 | 18.9 | 5.83 | 0.14 | 2.18 |
| 48 | 155.1 | 162.5 | 161.9 | 181.4 | 148.3 | 144.1 | 100.3 |
| 49 | 49.5 | 81.6 | 76.1 | 78 | 60.2 | 79.4 | 72.6 |
| 50 | 1.14 | 2.23 | 5.03 | 2.2 | 1.1 | 2.79 | 3 |
| 55 | 93.3 | NA | 120.5 | 126.6 | NA | 99.8 | NA |
| 52 | 166 | 103.7 | 85.7 | 90.8 | 205.7 | 66.7 | 138.3 |
| 53 | 0.2 | 0.231 | 0.213 | 0.243 | 0.262 | 0.131 | 0.183 |
| 51 | 0.0384 | 0.0497 | 0.0458 | 0.0529 | 0.0563 | 0.0281 | 0.0392 |
| 54 | 19050 | 19500 | 30600 | 29007.1 | 13250 | 14125 | 19550 |
| 56 | 10.72 | 9.68 | 7.88 | 9.47 | 10.83 | 9.78 | 8.96 |
| 57 | 146.5 | 86.4 | 75.7 | 79.1 | 167 | 54.2 | 124.6 |
| 59 | 0.0225 | 0.0296 | 0.0292 | 0.0326 | 0.0344 | 0.016 | 0.0272 |
| 58 | 0.114 | 0.114 | 0.102 | 0.083 | 0.101 | 0.085 | 0.127 |
| 62 | 20 | 26.2 | 21.5 | 21.7 | 22 | 16.9 | 14.8 |
| 63 | 1.28 | 1.65 | 1.6 | 1.33 | 1.31 | 1.25 | 0.7 |
| 64 | 1.57 | 2.35 | 1.43 | 2.43 | 2.86 | 1.14 | 1.15 |
| 65 | 32.7 | 43.5 | 30.9 | 52.1 | 57.2 | 29.5 | 25.5 |

Table 171: Provided are the values of each of the parameters (as described above) measured in Sorghum accessions (Line) under low N conditions. Growth conditions are specified in the experimental procedure section.

TABLE 172

Measured parameters in additional Sorghum accessions under low N conditions

| Corr. ID | Line-8 | Line-9 | Line-10 | Line-11 | Line-12 | Line-13 | Line-14 |
|---|---|---|---|---|---|---|---|
| 4 | NA | 87.4 | 85.5 | 93.1 | 55.4 | 74.1 | 67.4 |
| 60 | 0 | 0.105 | 0.2 | 0.037 | 0.24 | 0.165 | 0.244 |
| 61 | 0.199 | 0.416 | 0.59 | 0.344 | 0.186 | 0.032 | 0.206 |
| 29 | NA | 1.759 | NA | NA | NA | NA | NA |
| 30 | NA | 1.16 | NA | NA | NA | NA | NA |
| 31 | NA | 1.314 | NA | NA | NA | NA | NA |
| 28 | NA | 0.892 | NA | NA | NA | NA | NA |
| 1 | 23.7 | 22.8 | 16.5 | 24.8 | 25.6 | 25.2 | 29.5 |
| 2 | 8654.4 | 22138.7 | 48187.8 | 46278.3 | 15264.7 | 9784.8 | 13167 |
| 3 | 6.7 | 11 | 10.2 | 31.7 | 7.7 | 10.1 | 9.5 |
| 5 | NA | 0.169 | 0.131 | 0.175 | 0.168 | 0.185 | 0.181 |
| 9 | NA | 22.9 | NA | NA | NA | NA | NA |
| 6 | 0.121 | 0.096 | 0.083 | 0.111 | 0.11 | 0.108 | 0.123 |

TABLE 172-continued

Measured parameters in additional *Sorghum* accessions under low N conditions

| Corr. ID | Line-8 | Line-9 | Line-10 | Line-11 | Line-12 | Line-13 | Line-14 |
|---|---|---|---|---|---|---|---|
| 7 | 453.5 | 437 | 303.1 | 381.1 | 448.5 | 400.9 | 366.1 |
| 8 | 37 | 33.3 | 22 | 27.8 | 34.8 | 31.6 | 28.6 |
| 10 | 6420783 | 26192733 | 21156820 | 10734122 | 10820540 | 21581650 | 22437200 |
| 11 | 1326.9 | 4021.6 | 3454.5 | 1697.2 | 1472.7 | 3041.2 | 2942.7 |
| 12 | 152 | 633.4 | 389.1 | 306.5 | 283 | 558.3 | 690.4 |
| 13 | 12.9 | 28 | 27.7 | 20.9 | 10 | 27.6 | 34.1 |
| 14 | 31.1 | 90.2 | 58.7 | 44.1 | 35.7 | 74.7 | 84.1 |
| 15 | 0.194 | 0.225 | 0.065 | 0.085 | 0.165 | 0.357 | 0.296 |
| 16 | 235.3 | 156.9 | 136.7 | 190.3 | 117 | 75.9 | 79 |
| 17 | 0.2 | 0.756 | 0.509 | 0.47 | 0.499 | 0.627 | 0.783 |
| 18 | 0.36 | 0.363 | 0.122 | 0.176 | 0.469 | 0.51 | 0.46 |
| 19 | 1.07 | 1.41 | 0.95 | 1.13 | 1.46 | 1.26 | 1.11 |
| 20 | −13.6167 | −12.69 | −13.1067 | −13.1678 | −12.5867 | −13.1267 | −12.9967 |
| 22 | 71.9 | 69.2 | 68.6 | 69.3 | 79.7 | 76.7 | 73.6 |
| 23 | 3501 | 12503.7 | 15699.7 | 22712.4 | 8595.4 | 8279.6 | 14579.4 |
| 24 | 9 | 19.4 | 20.6 | 22.7 | 18 | 13.9 | 17 |
| 25 | 520.9 | 1874.6 | 1912.8 | 732.1 | 810.6 | 1593.3 | 1572.2 |
| 26 | 12.3 | 43.7 | 33 | 19.1 | 19.8 | 40.8 | 46.4 |
| 27 | NA | 0.403 | NA | NA | NA | NA | NA |
| 32 | 76 | 316.7 | 194.5 | 153.2 | 141.5 | 279.2 | 345.2 |
| 39 | NA | 11.61 | NA | NA | NA | NA | NA |
| 33 | 630.5 | 802.2 | 1189.1 | 1097 | 740.6 | 725.1 | 751.5 |
| 34 | 76 | 91 | 120.6 | 113.8 | 85.8 | 84.4 | 86.8 |
| 35 | 1070.9 | 1554.5 | 1534.2 | 1659.7 | 1570.2 | 1412 | 1165.8 |
| 36 | 112 | 147 | 145.5 | 154.2 | 148 | 137 | 119 |
| 37 | 630.5 | 734.9 | NA | 945.2 | 661.9 | 670 | 717.1 |
| 38 | 1084 | 1239.2 | 1492.2 | 1478.1 | 1189.1 | 1126 | 1117.6 |
| 40 | NA | 5.22 | 4.97 | 6.28 | 2.15 | 4.02 | 2.83 |
| 41 | 2.5 | 0.65 | 1.15 | 0.96 | 0.71 | 1 | 1.12 |
| 43 | NA | 1.35 | 2.88 | 2.15 | 1.06 | 0.88 | 1.05 |
| 42 | 92.3 | 87.2 | 86.7 | 88.1 | 86.9 | 85.9 | 91.5 |
| 46 | NA | 51.2 | 46.2 | 57.4 | 49.6 | 53.6 | 48.5 |
| 47 | 50.1 | 53.1 | 42.8 | 56.9 | 49.1 | 50.5 | 48.8 |
| 45 | 41.9 | 40.1 | 36 | 39.4 | 36.3 | 40.4 | 45.4 |
| 44 | 5.2 | 10.09 | NA | 5.25 | 1.45 | 9.66 | NA |
| 48 | 189.5 | 125.5 | 140.6 | 160 | 159.6 | 178.5 | 157.8 |
| 49 | 84.1 | 67.7 | 73.1 | 71.7 | 82.5 | 74.4 | 80 |
| 50 | 1.83 | 2.47 | 1.2 | 2.27 | 2.53 | 3.83 | 1.54 |
| 55 | NA | 104.4 | NA | NA | NA | NA | NA |
| 52 | 26.2 | 120 | 241 | 200.8 | 55.3 | 64.6 | 68 |
| 53 | 0.078 | 0.223 | 0.418 | 0.292 | 0.122 | 0.125 | 0.168 |
| 51 | 0.0179 | 0.0436 | 0.0742 | 0.0518 | 0.0253 | 0.0269 | 0.0361 |
| 54 | 12833.3 | 20833.3 | 13166.7 | 14150 | 25900 | 18950 | 18250 |
| 56 | 7.89 | 9.5 | 6.88 | 11.01 | 9.43 | 8.68 | 8.36 |
| 57 | 19.4 | 109 | 230.8 | 169.1 | 47.6 | 54.5 | 58.5 |
| 59 | 0.0111 | 0.0277 | 0.0633 | 0.0429 | 0.0142 | 0.0131 | 0.0152 |
| 58 | 0.053 | 0.119 | 0.467 | 0.192 | 0.059 | 0.052 | 0.071 |
| 62 | 4 | 18.9 | 18 | 11.9 | 8.2 | 17.2 | 24.3 |
| 63 | 0.32 | 1.25 | 0.69 | 0.54 | 0.57 | 1.2 | 1.48 |
| 64 | 0.49 | 1.51 | 1.52 | 0.75 | 0.61 | 1.42 | 1.63 |
| 65 | 12 | 40.6 | 40.9 | 13.3 | 17.5 | 34.9 | 31.9 |

Table 172: Provided are the values of each of the parameters (as described above) measured in *Sorghum* accessions (Line) under low N conditions. Growth conditions are specified in the experimental procedure section.

TABLE 173

Measured parameters in additional *Sorghum* accessions under low N conditions

| Corr. ID | Line-15 | Line-16 | Line-17 | Line-18 | Line-19 | Line-20 | Line-21 |
|---|---|---|---|---|---|---|---|
| 4 | 71.2 | 87.7 | 66.6 | 88.7 | 69.2 | 83 | 61.3 |
| 60 | 0.28 | 0.108 | 0.142 | 0.197 | 0.044 | 0.176 | 0.009 |
| 61 | 0.276 | 0.215 | 0.08 | 0.227 | 0.034 | 0.151 | 0.057 |
| 29 | NA | NA | NA | NA | NA | NA | NA |
| 30 | NA | NA | NA | NA | NA | NA | NA |
| 31 | NA | NA | NA | NA | NA | NA | NA |
| 28 | NA | NA | NA | NA | NA | NA | NA |
| 1 | 22.7 | 16.5 | 37 | 16.8 | 26.6 | 17.8 | 21.1 |
| 2 | 14934.2 | 18163.1 | 28962.4 | 18746.5 | 12235.2 | 15453.2 | 7723.9 |
| 3 | 9.9 | 11.4 | 19.7 | 16.1 | 17.3 | 13.9 | 8.3 |

TABLE 173-continued

Measured parameters in additional *Sorghum* accessions under low N conditions

| | Line | | | | | | |
|---|---|---|---|---|---|---|---|
| Corr. ID | Line-15 | Line-16 | Line-17 | Line-18 | Line-19 | Line-20 | Line-21 |
| 5 | 0.177 | 0.165 | 0.199 | 0.16 | 0.183 | 0.185 | NA |
| 9 | NA | NA | NA | NA | NA | NA | NA |
| 6 | 0.116 | 0.079 | 0.144 | 0.089 | 0.113 | 0.088 | 0.101 |
| 7 | 293.6 | 384.4 | 389.2 | 405.6 | 454.6 | 323.1 | 527.5 |
| 8 | 22.2 | 29.2 | 29.5 | 30 | 35.4 | 24.6 | 42.6 |
| 10 | 25344720 | 20035920 | 11582823 | 14659840 | 20818740 | 23299560 | 11431484 |
| 11 | 3864.4 | 2620.7 | 1944 | 1369.3 | 3561.9 | 3839.1 | 1999.4 |
| 12 | 605.1 | 366.7 | 423.1 | 280.2 | 590.6 | 454.7 | 263.7 |
| 13 | 37.1 | 17.6 | 16.1 | 5.7 | 36.4 | 28.1 | 13.2 |
| 14 | 85.5 | 44.3 | 66.9 | 23.6 | 95.7 | 68.2 | 43.3 |
| 15 | 0.327 | 0.196 | 0.146 | 0.074 | 0.351 | 0.258 | 0.29 |
| 16 | 107 | 176.3 | 83 | 66.7 | 117.5 | 98.1 | 47.5 |
| 17 | 0.693 | 0.58 | 0.474 | 0.577 | 0.679 | 0.508 | 0.262 |
| 18 | 0.492 | 0.352 | 0.257 | 0.203 | 0.526 | 0.39 | 0.367 |
| 19 | 1.06 | 1.11 | 1.78 | 2.3 | 1.15 | 1.22 | 2.54 |
| 20 | −12.96 | −13.07 | −12.9367 | −12.7733 | −13.3467 | −12.6033 | −12.8267 |
| 22 | 68.7 | 70.9 | 73.2 | 65.3 | 75.6 | 63 | NA |
| 23 | 16710.3 | 13218.2 | 14464.5 | 11759.2 | 8621.8 | 13816.8 | 6363.6 |
| 24 | 21 | 20 | 21.5 | 17.7 | 18.5 | 20.7 | 14.8 |
| 25 | 2037.5 | 1422.1 | 854.8 | 449.6 | 1466.9 | 1989.8 | 659.5 |
| 26 | 46.2 | 24.5 | 31.9 | 7.7 | 40.6 | 35.6 | 14.2 |
| 27 | NA | NA | NA | NA | NA | NA | NA |
| 32 | 302.5 | 183.3 | 211.6 | 140.1 | 295.3 | 227.3 | 131.8 |
| 39 | NA | NA | NA | NA | NA | NA | NA |
| 33 | 967.4 | 840 | 889.2 | 1013.4 | 726.8 | 863.5 | 607.2 |
| 34 | 103.8 | 94 | 97.8 | 107.4 | 84.6 | 95.8 | 74 |
| 35 | 1498.3 | NA | 1584.5 | 1576.2 | 1512.8 | 1412 | NA |
| 36 | 143 | NA | 149 | 148.4 | 144 | 137 | NA |
| 37 | 892.6 | 769.5 | 814.2 | 905.8 | 641.5 | 773 | 534.2 |
| 38 | 1261 | 1224.3 | 1278.5 | 1419 | 1181.3 | 1186.6 | 1134.7 |
| 40 | 3.57 | 5.91 | 3.22 | 6.07 | 3.7 | 4.37 | 2.22 |
| 41 | 0.77 | 0.77 | 1.07 | 1.26 | 0.69 | 0.64 | 0.88 |
| 43 | 2.35 | 1.03 | 3.93 | 1.5 | 1.32 | 1.68 | 0.78 |
| 42 | 91.4 | 84.5 | 92.5 | 85.1 | 88.2 | 87 | 92.4 |
| 46 | 46.3 | 50 | 56.2 | 49.7 | 51.3 | 48.1 | 52.5 |
| 47 | 47.4 | 55.9 | 55.5 | 49.9 | 51.2 | 48.1 | 44.4 |
| 45 | 39.9 | 39.1 | 42 | 42 | 44.5 | 39.4 | 38.2 |
| 44 | 0.85 | 0.5 | 6.54 | 3.62 | 4.04 | 0.62 | 11.12 |
| 48 | 153.2 | 149.9 | 148.2 | 123.3 | 147.8 | 130.5 | 150.1 |
| 49 | 47.5 | 78.8 | 48.8 | 65.8 | 74.6 | 43.8 | NA |
| 50 | 1.24 | 1.3 | 4.79 | 4.27 | 2.37 | 1.43 | 4.93 |
| 55 | NA | NA | NA | NA | NA | NA | NA |
| 52 | 159.4 | 90.7 | 240.2 | 133.7 | 88.7 | 138.1 | 48.1 |
| 53 | 0.139 | 0.134 | 0.267 | 0.194 | 0.115 | 0.129 | 0.092 |
| 51 | 0.027 | 0.0265 | 0.0507 | 0.0345 | 0.0239 | 0.0265 | 0.0198 |
| 54 | 15050 | 18650 | 26500 | 47771.4 | 15378.6 | 14791.3 | 23437.3 |
| 56 | 9.78 | 8.57 | 12.73 | 7.75 | 10.95 | 7.75 | 7.52 |
| 57 | 149.5 | 79.3 | 220.5 | 117.6 | 71.4 | 123.4 | 39.8 |
| 59 | 0.0136 | 0.0172 | 0.0377 | 0.0284 | 0.0113 | 0.0163 | 0.0122 |
| 58 | 0.069 | 0.055 | 0.147 | 0.106 | 0.071 | 0.092 | 0.092 |
| 62 | 27.3 | 13 | 14.8 | 9.3 | 16.7 | 18.5 | 6.2 |
| 63 | 1.18 | 0.73 | 0.79 | 0.5 | 1.23 | 0.93 | 0.57 |
| 64 | 2.11 | 0.88 | 1.35 | 0.37 | 1.25 | 1.46 | 0.59 |
| 65 | 44 | 26.3 | 19.7 | 12 | 31.1 | 41.7 | 25.8 |

Table 173: Provided are the values of each of the parameters (as described above) measured in *Sorghum* accessions (Line) under low N conditions. Growth conditions are specified in the experimental procedure section.

TABLE 174

Measured parameters in additional *Sorghum* accessions under low N conditions

| | Line | | | | | | |
|---|---|---|---|---|---|---|---|
| Corr. ID | Line-22 | Line-23 | Line-24 | Line-25 | Line-26 | Line-27 | Line-28 |
| 4 | 90.3 | 85.7 | 71.2 | 60.1 | 94.8 | 60.6 | 81.1 |
| 60 | 0.194 | 0.209 | 0.145 | 0.151 | NA | 0.074 | 0.012 |
| 61 | 0.407 | 0.693 | 0.225 | 0.277 | 0.472 | 0.179 | 0.05 |
| 29 | NA | 1.466 | 1.411 | NA | NA | NA | NA |
| 30 | NA | 1.976 | 1.639 | NA | NA | NA | NA |
| 31 | NA | 0.695 | 0.986 | NA | NA | NA | NA |
| 28 | NA | 0.488 | 0.7 | NA | NA | NA | NA |

TABLE 174-continued

Measured parameters in additional *Sorghum* accessions under low N conditions

| Corr. ID | Line-22 | Line-23 | Line-24 | Line-25 | Line-26 | Line-27 | Line-28 |
|---|---|---|---|---|---|---|---|
| 1 | 26.7 | 22.7 | 31.6 | 20.3 | 31.2 | 21.5 | 26 |
| 2 | 32879.7 | 62130.2 | 28010.3 | 8132.7 | NA | 18761.8 | 13549.2 |
| 3 | 20.4 | 19.8 | 37 | 11 | NA | 18.2 | 14.5 |
| 5 | 0.156 | 0.164 | 0.178 | 0.146 | NA | 0.188 | NA |
| 9 | NA | 18.14 | 40.26 | NA | NA | NA | NA |
| 6 | 0.129 | 0.105 | 0.136 | 0.102 | 0.133 | 0.105 | 0.109 |
| 7 | 395.4 | 404.2 | 428.2 | 411.5 | 295.7 | 380.9 | 522 |
| 8 | 29 | 29.2 | 32.8 | 31.8 | 22.4 | 29.4 | 42.2 |
| 10 | 4496747 | 11541518 | 18740650 | 16305080 | 20382340 | 12164286 | 23557125 |
| 11 | 592.6 | 1907.3 | 3702.6 | 2806.6 | 3624.3 | 2363.9 | 3599.6 |
| 12 | 145.5 | 282.2 | 605.5 | 378 | 581.1 | 291.8 | 671.5 |
| 13 | 9.5 | 19.1 | 36.4 | 22 | 36.6 | 19.1 | 33.9 |
| 14 | 17.5 | 43.2 | 111.3 | 59.1 | 109.3 | 52.9 | 93.9 |
| 15 | 0.052 | 0.086 | 0.312 | 0.237 | 0.218 | 0.206 | 0.364 |
| 16 | 178.3 | 124 | 150.2 | 82.5 | 123.7 | 113.7 | 108.2 |
| 17 | 0.347 | 0.485 | 0.71 | 0.503 | 0.72 | 0.639 | 0.774 |
| 18 | 0.158 | 0.235 | 0.518 | 0.439 | 0.342 | 0.426 | 0.518 |
| 19 | 1.69 | 0.98 | 1.34 | 1.02 | 1.53 | 1.16 | 1.43 |
| 20 | −12.9 | −12.3556 | −13.1 | −13.06 | −12.7533 | −12.8967 | −13.0267 |
| 22 | 60.4 | 72.8 | 66.8 | 73.9 | NA | 76.3 | NA |
| 23 | 16953.3 | 26482.6 | 15781.4 | 8543 | NA | 15080.6 | 9350.7 |
| 24 | 20.9 | 24.4 | 18.2 | 16.9 | NA | 21.5 | 16.8 |
| 25 | 161.4 | 1071.8 | 2162.9 | 1311.7 | 1900.6 | 1326.5 | 1619 |
| 26 | 4.8 | 24.8 | 66.9 | 27.1 | 58.6 | 30.3 | 42.6 |
| 27 | NA | 0.266 | 0.568 | NA | NA | NA | NA |
| 32 | 72.7 | 141.1 | 302.8 | 189 | 290.5 | 145.9 | 335.8 |
| 39 | NA | 8.79 | 7.16 | NA | NA | NA | NA |
| 33 | 1060.4 | 1153.7 | 771.5 | 748.3 | 955.1 | 762.2 | 607.2 |
| 34 | 111 | 118 | 88.6 | 86.6 | 102.8 | 87.8 | 74 |
| 35 | 1575.2 | 1586.7 | 1250.8 | 1369 | 1631 | NA | NA |
| 36 | 148.3 | 149.2 | 125.2 | 134 | 152.2 | NA | NA |
| 37 | 912.2 | NA | 751.5 | 677.8 | 901.2 | 727.2 | 574.8 |
| 38 | 1483.8 | 1558 | 1199.7 | 1159.8 | 1250.8 | 1143.1 | 1129.2 |
| 40 | 4 | 2.98 | 2.92 | 2.88 | 6.85 | 2.32 | 3.89 |
| 41 | 0.84 | 0.85 | 1.55 | 0.82 | 0.83 | 0.57 | 0.74 |
| 43 | 3.4 | 4.56 | 2.64 | 0.91 | NA | 1.35 | 0.85 |
| 42 | 88.6 | 88.9 | 89.9 | 93.1 | 90.6 | 92.4 | 93.3 |
| 46 | 47.8 | 47.1 | 54.9 | 50.3 | 43.2 | 50.7 | 55.1 |
| 47 | 49 | 41 | 49.2 | 49.6 | 48.7 | 52.5 | 52.9 |
| 45 | 35.9 | 38.5 | 40.5 | 48.4 | 40.6 | 41.1 | 44.6 |
| 44 | 1.76 | NA | 3.74 | 10.92 | 36.79 | 0.5 | 6.36 |
| 48 | 96.9 | 165.9 | 153.4 | 165.2 | NA | 153.1 | 143.3 |
| 49 | 52.3 | 62.9 | 56.2 | 78.7 | NA | 81.8 | NA |
| 50 | 5.33 | 1 | 1.43 | 1.83 | 1.4 | 1.07 | 3.5 |
| 55 | NA | 194.9 | 128.5 | NA | NA | NA | NA |
| 52 | 306.1 | 385 | 180.8 | 53.3 | NA | 80.8 | 70.3 |
| 53 | 0.204 | 0.25 | 0.214 | 0.127 | 0.272 | 0.138 | 0.133 |
| 51 | 0.0332 | 0.0443 | 0.0442 | 0.0268 | 0.0536 | 0.0296 | 0.0281 |
| 54 | 26033.3 | 13200 | 14404.8 | 13600 | 15500 | 13466.7 | 20520.8 |
| 56 | 9.43 | 11.94 | 12.75 | 9.97 | NA | 10.98 | 9.12 |
| 57 | 285.7 | 365.3 | 143.9 | 42.3 | NA | 62.6 | 55.8 |
| 59 | 0.0273 | 0.034 | 0.0207 | 0.0151 | 0.0348 | 0.0172 | 0.0137 |
| 58 | 0.244 | 0.267 | 0.076 | 0.069 | 0.187 | 0.064 | 0.057 |
| 62 | 7.6 | 9.9 | 19.8 | 12.1 | 25.9 | 10 | 15.9 |
| 63 | 0.33 | 0.5 | 1.27 | 0.8 | 1.13 | 0.63 | 1.41 |
| 64 | 0.39 | 0.87 | 2.19 | 1.01 | 2.44 | 1.05 | 1.13 |
| 65 | 5 | 23.2 | 44.9 | 30.1 | 36.3 | 25.4 | 33.8 |

Table 174: Provided are the values of each of the parameters (as described above) measured in *Sorghum* accessions (Line) under low N conditions. Growth conditions are specified in the experimental procedure section.

TABLE 175

Measured parameters in additional *Sorghum* accessions under low N conditions

| Corr. ID | Line-29 | Line-30 | Line-31 | Line-32 | Line-33 | Line-34 |
|---|---|---|---|---|---|---|
| 4 | 74 | 88.2 | 94.3 | 84.5 | 68.6 | 84 |
| 60 | 0.084 | 0.254 | 0.088 | 0.118 | 0.22 | 0.205 |
| 61 | 0.092 | 0.069 | 0.175 | 0.137 | 0.326 | 0.404 |
| 29 | NA | 1.684 | NA | 1.326 | NA | 2.015 |

TABLE 175-continued

Measured parameters in additional *Sorghum* accessions under low N conditions

| | Line | | | | | |
|---|---|---|---|---|---|---|
| Corr. ID | Line-29 | Line-30 | Line-31 | Line-32 | Line-33 | Line-34 |
| 30 | NA | 1.532 | NA | 1.478 | NA | 1.703 |
| 31 | NA | 1.38 | NA | 1.137 | NA | 1.584 |
| 28 | NA | 0.856 | NA | 0.808 | NA | 0.539 |
| 1 | 27.9 | 28.4 | 20.9 | 24.4 | 23.5 | 26.1 |
| 2 | 9492.3 | 14554.4 | 27230.6 | 18260.1 | 18322.3 | 42073.4 |
| 3 | 10.9 | 11.1 | 16 | 22.6 | 19.8 | 14.7 |
| 5 | NA | NA | 0.2 | 0.178 | 0.159 | 0.158 |
| 9 | NA | 35.16 | NA | 43.48 | NA | 15.48 |
| 6 | 0.118 | 0.116 | 0.098 | 0.113 | 0.104 | 0.109 |
| 7 | 522.5 | 518.8 | 344.9 | 412.3 | 391 | 436.9 |
| 8 | 42.2 | 42 | 26.2 | 31.2 | 29.8 | 33.2 |
| 10 | 16479475 | 25747580 | 36116975 | 36860650 | 33562075 | 18000140 |
| 11 | 2406.1 | 3436.2 | 6082.5 | 5855.7 | 4395.8 | 3020.8 |
| 12 | 510.9 | 774.6 | 816.4 | 922.4 | 828.4 | 485.5 |
| 13 | 27.9 | 40 | 57.5 | 50.8 | 48.7 | 26.4 |
| 14 | 68.2 | 95.3 | 127.8 | 139.4 | 101.2 | 76.1 |
| 15 | 0.344 | 0.334 | 0.256 | 0.366 | 0.3 | 0.114 |
| 16 | 138.6 | 112.2 | 185.6 | 222.3 | 140.8 | 115.6 |
| 17 | 0.635 | 0.926 | 0.969 | 0.996 | 1.04 | 0.585 |
| 18 | 0.61 | 0.533 | 0.425 | 0.535 | 0.486 | 0.176 |
| 19 | 1.08 | 1.16 | 1.02 | 1.14 | 1.06 | 1.28 |
| 20 | −13.0233 | −12.9756 | −13.0333 | −12.8422 | −12.6367 | −13.0322 |
| 22 | NA | NA | 67.3 | 68.6 | 71.7 | 69 |
| 23 | 5454 | 9065.6 | 20008 | 21922.8 | 15977 | 18430.4 |
| 24 | 15.4 | 15.4 | 21.2 | 20.8 | 17.5 | 20.5 |
| 25 | 1259.4 | 1724 | 3230.2 | 3170.3 | 2099.2 | 1383.3 |
| 26 | 36 | 48.8 | 69.2 | 79.2 | 49.6 | 36.4 |
| 27 | NA | 0.592 | NA | 0.577 | NA | 0.312 |
| 32 | 255.4 | 387.3 | 408.2 | 461.2 | 414.2 | 242.8 |
| 39 | NA | 11.09 | NA | 10.96 | NA | 13.24 |
| 33 | 607.2 | 607.2 | 872.8 | 866.2 | 820 | 813.4 |
| 34 | 74 | 74 | 96.5 | 96 | 92.5 | 92 |
| 35 | NA | 1247.5 | 1528 | NA | 1405.5 | 1392.6 |
| 36 | NA | 125 | 145 | NA | 136.5 | 135.5 |
| 37 | 574.8 | 607.2 | 814.2 | 749.1 | 769.5 | 773 |
| 38 | 1129.8 | 1126 | 1217.6 | 1278.6 | 1211 | 1250.3 |
| 40 | 3.18 | 5.37 | 6.86 | 4.96 | 3.39 | 4.38 |
| 41 | 0.85 | 1.17 | 0.82 | 0.77 | 0.91 | 1.54 |
| 43 | 0.6 | 0.65 | 3.13 | 3.28 | 1.84 | 4.08 |
| 42 | 93.5 | 94.2 | 85.9 | 87.6 | 92.2 | 92 |
| 46 | 55.5 | 49.8 | 45.8 | 51 | 45 | 50.6 |
| 47 | 52.2 | 49.9 | 47.3 | 53.8 | 45.9 | 50.9 |
| 45 | 46.9 | 41.4 | 39.9 | 41.8 | 39.5 | 38.3 |
| 44 | 5.12 | 1.57 | NA | 12.83 | 0.77 | 5.67 |
| 48 | 151.1 | 142.9 | 152.4 | 133.1 | 159.4 | 139.7 |
| 49 | NA | NA | 30.3 | 39.9 | 72.5 | 50.5 |
| 50 | 3.46 | 3.4 | 2.25 | 1 | 1.08 | 2.83 |
| 55 | NA | 102.2 | NA | 112.4 | NA | 154.2 |
| 52 | 45.4 | 58.6 | 293.9 | 275.5 | 124.4 | 344 |
| 53 | 0.105 | 0.145 | 0.263 | 0.212 | 0.163 | 0.405 |
| 51 | 0.0226 | 0.031 | 0.0526 | 0.0398 | 0.0319 | 0.0801 |
| 54 | 16495.8 | 17950 | 12910.7 | 15812.5 | 15567.9 | 18400 |
| 56 | 8.63 | 8.78 | 9.05 | 9.4 | 9.41 | 9.06 |
| 57 | 34.5 | 47.5 | 277.9 | 252.9 | 104.5 | 329.2 |
| 59 | 0.0088 | 0.0147 | 0.0303 | 0.0184 | 0.0174 | 0.0658 |
| 58 | 0.045 | 0.075 | 0.147 | 0.091 | 0.083 | 0.217 |
| 62 | 12.2 | 18.4 | 31.9 | 29.9 | 27.8 | 14.9 |
| 63 | 1.1 | 1.66 | 1.63 | 1.74 | 1.69 | 0.96 |
| 64 | 0.91 | 1.18 | 2.67 | 2.66 | 1.67 | 1.32 |
| 65 | 26.9 | 35.3 | 69.8 | 61.6 | 45.6 | 31.9 |

Table 175: Provided are the values of each of the parameters (as described above) measured in *Sorghum* accessions (Line) under low N conditions. Growth conditions are specified in the experimental procedure section.

TABLE 176

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGB15 | 0.72 | 2.76E−02 | 3 | 9 | LGB16 | 0.76 | 1.68E−02 | 3 | 27 |
| LGB16 | 0.71 | 3.36E−02 | 1 | 27 | LGB16 | 0.71 | 3.07E−02 | 1 | 9 |
| LGM15 | 0.81 | 8.18E−03 | 3 | 30 | LGM17 | 0.87 | 2.31E−03 | 3 | 28 |

Table 176. Provided are the correlations (R) between the genes expression levels in various tissues and the phenotypic performance. "Corr. ID"—correlation set ID according to the correlated parameters specified in Table 165. "Exp. Set"—Expression set specified in Table 163. "R" = Pearson correlation coefficient; "P" = p value.

TABLE 177

Correlation between the expression level of selected genes of some embodiments of the invention in various tissues and the phenotypic performance under Low N growth stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGB15 | 0.70 | 3.47E−02 | 1 | 30 | LGB16 | 0.83 | 5.35E−03 | 1 | 55 |

Table 177. Provided are the correlations (R) between the genes expression levels in various tissues and the phenotypic performance. "Corr. ID"—correlation set ID according to the correlated parameters specified in Table 165. "Exp. Set"—Expression set specified in Table 164. "R" = Pearson correlation coefficient; "P" = p value

Example 18

Identification of Genes which Increase Abst, Growth Rate, Vigor, Yield, Biomass, Oil Content, Wue, Nue and/or Fue in Plants Based on the above described bioinformatics and experimental tools, the present inventors have identified 89 genes which exhibit a major impact on abiotic stress tolerance, plant yield, seed yield, oil content, growth rate, vigor, biomass, fiber yield and quality, photosynthetic capacity, root coverage, rosette area, plot coverage, growth rate, nitrogen use efficiency, water use efficiency and fertilizer use efficiency when expression thereof is increased in plants. The identified genes, their curated polynucleotide and polypeptide sequences, as well as their updated sequences according to GenBank database are summarized in Table 178, hereinbelow.

TABLE 178

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Organism/Cluster Name | Polyn. SEQ ID NO: | Polyp. SEQ ID NO: |
|---|---|---|---|
| LGA1 | barley|12v1|AV833096 | 1 | 182 |
| LGA2 | barley|12v1|AV834937 | 2 | 183 |
| LGA6 | cotton|11v1|AI728967 | 3 | 184 |
| LGA9 | gossypium_raimondii|13v1|BQ410590 | 4 | 185 |
| LGA17 | sorghum|13v2|BF176782 | 5 | 186 |
| LGA1_H4 | rice|13v2|AU058418 | 6 | 187 |
| LGB1 | cotton|11v1|DT468691 | 7 | 188 |
| LGB2 | foxtail_millet|13v2|EC613682 | 8 | 189 |
| LGB4 | foxtail_millet|13v2|SRR350548X122303 | 9 | 190 |
| LGB5 | foxtail_millet|13v2|SRR350548X140046 | 10 | 191 |
| LGB7 | maize|13v2|AI901347 | 11 | 192 |
| LGB8 | maize|13v2|CF036651 | 12 | 193 |
| LGB9 | rice|13v2|AA750795 | 13 | 194 |
| LGB10 | rice|13v2|BE229598 | 14 | 195 |
| LGB11 | rice|13v2|CA753146 | 15 | 196 |
| LGB14 | sorghum|13v2|AI724216 | 16 | 197 |
| LGB15 | sorghum|13v2|AW564221 | 17 | 198 |
| LGB16 | sorghum|13v2|BF317828 | 18 | 199 |
| LGB18 | wheat|12v3|CA720225 | 19 | 200 |
| LGB18_H2 | barley|12v1|BE422321 | 20 | 201 |
| LGD1 | wheat|12v3|BE404793 | 21 | 202 |
| LGD2 | tomato|13v1|AA824770 | 22 | 203 |
| LGD3 | bean|12v2|CA905318 | 23 | 204 |
| LGD6 | arabidopsis|13v2|AT3G12290 | 24 | 205 |

TABLE 178-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Organism/Cluster Name | Polyn. SEQ ID NO: | Polyp. SEQ ID NO: |
|---|---|---|---|
| LGD7 | b_juncea|12v1|E6ANDIZ01AX6UP | 25 | 206 |
| LGD8 | bean|12v2|HO781071 | 26 | 207 |
| LGD9 | bean|13v1|CA898975 | 27 | 208 |
| LGD10 | bean|13v1|SRR001335X441509 | 28 | 209 |
| LGD11 | bean|13v1|SRR090491X1205635 | 29 | 210 |
| LGD12 | canola|11v1|DY024508 | 30 | 211 |
| LGD14 | *medicago*|13v1|AL368483 | 31 | 212 |
| LGD15 | *medicago*|13v1|AW690234 | 32 | 213 |
| LGD16 | *medicago*|13v1|BF641377 | 33 | 214 |
| LGD17 | *medicago*|13v1|BI270559 | 34 | 215 |
| LGD18 | soybean|13v2|GLYMA07G01230 | 35 | 216 |
| LGD19 | soybean|13v2|GLYMA08G22020 | 36 | 217 |
| LGD20 | soybean|13v2|GLYMA11G37630 | 37 | 218 |
| LGD21 | soybean|13v2|GLYMA12G00350 | 38 | 219 |
| LGD23 | soybean|13v2|GLYMA20G17440 | 39 | 220 |
| LGD24 | tomato|13v1|AF233745 | 40 | 221 |
| LGD25 | tomato|13v1|AI897510 | 41 | 222 |
| LGD26 | tomato|13v1|AW219459 | 42 | 223 |
| LGM4 | maize|10v1|AI586576 | 44 | 225 |
| LGM5 | maize|10v1|AI745971 | 45 | 226 |
| LGM7 | maize|10v1|BG836857 | 46 | 227 |
| LGM8 | maize|10v1|BG841757 | 47 | 228 |
| LGM9 | maize|13v2|AI737203 | 48 | 229 |
| LGM10 | rice|13v2|AB239801 | 49 | 230 |
| LGM11 | *sorghum*|12v1|SB07G007870 | 50 | 231 |
| LGM12 | *sorghum*|12v1|SB07G024310 | 51 | 232 |
| LGM13 | rice|13v2|AU069785 | 52 | 233 |
| LGM14 | maize|10v1|T23364 | 53 | 234 |
| LGM15 | *sorghum*|13v2|BE594866 | 54 | 235 |
| LGM16 | maize|13v2|AI615185 | 55 | 236 |
| LGM17 | *sorghum*|13v2|BG048663 | 56 | 237 |
| LGM18 | *brachypodium*|12v1|BRADI3G57667 | 57 | 238 |
| LGM21 | maize|13v2|AW076322 | 59 | 240 |
| LGM22 | rice|13v2|CF306237 | 60 | 241 |
| LGM23 | *sorghum*|13v2|CD232722 | 61 | 242 |
| LGM18_H1 | rice|13v2|BI808928 | 62 | 243 |
| MGP15 | barley|12v1|BF265446 | 63 | 244 |
| MGP16 | barley|12v1|BF627028 | 64 | 245 |
| MGP17 | barley|12v1|EX585887 | 65 | 246 |
| MGP18 | cotton|11v1|CO074273 | 66 | 247 |
| MGP19 | foxtail_millet|13v2|EC612255 | 67 | 248 |
| MGP20 | maize|13v2|AI396237 | 68 | 249 |
| MGP21 | maize|13v2|BE509799 | 69 | 250 |
| MGP22 | maize|13v2|CF629964 | 70 | 251 |
| MGP23 | maize|13v2|BU197720 | 71 | 252 |
| MGP24 | maize|13v2|EU943272 | 72 | 253 |
| MGP25 | rice|11v1|BI797334 | 73 | 254 |
| MGP26 | rice|13v2|AU056740 | 74 | 255 |
| MGP27 | rice|13v2|AU174125 | 75 | 256 |
| MGP28 | rice|13v2|BQ908084 | 76 | 257 |
| MGP30 | rice|13v2|CI354913 | 77 | 258 |
| MGP33 | *sorghum*|12v1|SB03G000370 | 78 | 259 |
| MGP34 | *sorghum*|13v2|BF587276 | 79 | 260 |
| MGP35 | *sorghum*|12v1|SB03G040900 | 80 | 261 |
| MGP37 | *sorghum*|13v2|CD204652 | 81 | 262 |
| MGP38 | *sorghum*|13v2|CD213494 | 82 | 263 |
| MGP39 | *sorghum*|13v2|CN128367 | 83 | 264 |
| MGP40 | tomato|13v1|AI485915 | 84 | 265 |
| MGP42 | wheat|12v3|BF201691 | 85 | 266 |
| MGP19_H1 | *sorghum*|13v2|BF656809 | 86 | 267 |
| MGP30_H3 | *sorghum*|13v2|CF480985 | 87 | 268 |
| RIN44 | rice|11v1|BE039940 | 88 | 269 |
| LGA1_H4 | rice|13v2|AU058418 | 89 | 187 |
| LGB4 | foxtail_millet|13v2|SRR350548X122303 | 90 | 190 |
| LGB11 | rice|13v2|CA753146 | 91 | 270 |
| LGB18_H2 | barley|12v1|BE422321 | 92 | 271 |
| LGD7 | b_juncea|12v1|E6ANDIZ01AX6UP | 93 | 272 |
| LGD16 | *medicago*|13v1[BF641377 | 94 | 214 |
| LGD25 | tomato|13v1|AI897510 | 95 | 222 |
| LGM18_H1 | rice|13v2|BI808928 | 96 | 243 |
| MGP22 | maize|13v2|CF629964 | 97 | 251 |
| MGP24 | maize|13v2|EU943272 | 98 | 273 |
| MGP40 | tomato|13v1|AI485915 | 99 | 274 |

TABLE 178-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Organism/Cluster Name | Polyn. SEQ ID NO: | Polyp. SEQ ID NO: |
|---|---|---|---|
| MGP19_H1 | sorghum\|13v2\|BF656809 | 100 | 267 |
| MGP30_H3 | sorghum\|13v2\|CF480985 | 101 | 268 |
| LGM2 | sorghum\|12v1\|SB03G012590 | 140 | 224 |
| LGM19 | maize\|10v1\|AW000428 | 154 | 288 |
| LYM672_H1, LGM2 | sorghum\|13v2\|XM_002457691 | 1865 | 5051 |
| LYM672 | maize\|13v2\|EE162371_T1 | 1866 | 5052 |
| LYM466 | sorghum\|13v2\|BE361086 | 2345 | 5457 |
| LYM466_H2 | maize\|13v2\|AI783091_P1 | 2346 | 5458 |
| LGM19_H2 | echinochloa\|14v1\|SRR522894X38582D1_P1 | 2347 | 5459 |
| LGM19_H1 | foxtail_millet\|13v2\|SRR350548X1141 | 2348 | 5460 |
| LGM19_H1 | foxtail_millet\|14v1\|JK548042_P1 | 2349 | 5461 |
| LYM466_H5 | rice\|13v2\|AU089825 | 2350 | 5462 |
| LGM19_H3 | echinochloa\|14v1\|SRR522894X126026D1_P1 | 2351 | 5463 |
| LYM466_H7 | brachypodium\|13v2\|BRADI2G57640T2 | 2352 | 5464 |
| LYM466_H7 | brachypodium\|14v1\|DV469198_T1 | 2353 | 5464 |
| LGA2 | barley\|12v1\|AV834937 | 102 | 183 |
| LGA6 | cotton\|11v1\|AI728967 | 103 | 275 |
| LGA9 | gossypium_raimondii\|13v1\|BQ410590 | 104 | 276 |
| LGA17 | sorghum\|13v2\|BF176782 | 105 | 277 |
| LGA1_H4 | rice\|13v2\|AU058418 | 106 | 187 |
| LGB1 | cotton\|11v1\|DT468691 | 107 | 278 |
| LGB2 | foxtail_millet\|13v2\|EC613682 | 108 | 189 |
| LGB4 | foxtail_millet\|13v2\|SRR350548X122303 | 109 | 190 |
| LGB5 | foxtail_millet\|13v2\|SRR350548X140046 | 110 | 191 |
| LGB8 | maize\|13v2\|CF036651 | 111 | 193 |
| LGB9 | rice\|13v2\|AA750795 | 112 | 194 |
| LGB10 | rice\|13v2\|BE229598 | 113 | 279 |
| LGB11 | rice\|13v2\|CA753146 | 114 | 196 |
| LGB14 | sorghum\|13v2\|AI724216 | 115 | 197 |
| LGB15 | sorghum\|13v2\|AW564221 | 116 | 198 |
| LGB16 | sorghum\|13v2\|BF317828 | 117 | 199 |
| LGB18_H2 | barley\|12v1\|BE422321 | 118 | 280 |
| LGD1 | wheat\|12v3\|BE404793 | 119 | 281 |
| LGD2 | tomato\|13v1\|AA824770 | 120 | 203 |
| LGD3 | bean\|12v2\|CA905318 | 121 | 204 |
| LGD6 | arabidopsis\|13v2\|AT3G12290 | 122 | 205 |
| LGD7 | b_juncea\|12v1\|E6ANDIZ01AX6UP | 123 | 282 |
| LGD8 | bean\|12v2\|HO781071 | 124 | 283 |
| LGD9 | bean\|13v1\|CA898975 | 125 | 208 |
| LGD10 | bean\|13v1\|SRR001335X441509 | 126 | 284 |
| LGD11 | bean\|13v1\|SRR090491X1205635 | 127 | 210 |
| LGD12 | canola\|11v1\|DY024508 | 128 | 211 |
| LGD14 | medicago\|13v1\|AL368483 | 129 | 285 |
| LGD15 | medicago\|13v1\|AW690234 | 130 | 213 |
| LGD16 | medicago\|13v1\|BF641377 | 131 | 214 |
| LGD17 | medicago\|13v1\|BI270559 | 132 | 215 |
| LGD18 | soybean\|13v2\|GLYMA07G01230 | 133 | 216 |
| LGD19 | soybean\|13v2\|GLYMA08G22020 | 134 | 217 |
| LGD20 | soybean\|13v2\|GLYMA11G37630 | 135 | 218 |
| LGD21 | soybean\|13v2\|GLYMA12G00350 | 136 | 219 |
| LGD23 | soybean\|13v2\|GLYMA20G17440 | 137 | 220 |
| LGD24 | tomato\|13v1\|AF233745 | 138 | 221 |
| LGD26 | tomato\|13v1\|AW219459 | 139 | 223 |
| LGM4 | maize\|10v1\|AI586576 | 141 | 225 |
| LGM5 | maize\|10v1\|AI745971 | 142 | 226 |
| LGM7 | maize\|10v1\|BG836857 | 143 | 286 |
| LGM8 | maize\|10v1\|BG841757 | 144 | 228 |
| LGM9 | maize\|13v2\|AI737203 | 145 | 229 |
| LGM10 | rice\|13v2\|AB239801 | 146 | 230 |
| LGM11 | sorghum\|12v1\|SB07G007870 | 147 | 231 |
| LGM12 | sorghum\|12v1\|SB07G024310 | 148 | 232 |
| LGM13 | rice\|13v2\|AU069785 | 149 | 233 |
| LGM14 | maize\|10v1\|T23364 | 150 | 234 |
| LGM15 | sorghum\|13v2\|BE594866 | 151 | 235 |
| LGM16 | maize\|13v2\|AI615185 | 152 | 287 |
| LGM17 | sorghum\|13v2\|BG048663 | 153 | 237 |
| LGM21 | maize\|13v2\|AW076322 | 155 | 240 |
| LGM22 | rice\|13v2\|CF306237 | 156 | 289 |
| LGM23 | sorghum\|13v2\|CD232722 | 157 | 290 |
| LGM18_H1 | rice\|13v2\|BI808928 | 158 | 243 |
| MGP15 | barley\|12v1\|BF265446 | 159 | 244 |
| MGP16 | barley\|12v1\|BF627028 | 160 | 245 |

TABLE 178-continued

Identified genes for increasing abiotic stress tolerance, water use efficiency, yield, growth rate, vigor, biomass, growth rate, oil content, fiber yield, fiber quality, nitrogen use efficiency and fertilizer use efficiency of a plant

| Gene Name | Organism/Cluster Name | Polyn. SEQ ID NO: | Polyp. SEQ ID NO: |
|---|---|---|---|
| MGP17 | barley\|12v1\|EX585887 | 161 | 291 |
| MGP18 | cotton\|11v1\|CO074273 | 162 | 292 |
| MGP20 | maize\|13v2\|AI396237 | 163 | 293 |
| MGP21 | maize\|13v2\|BE509799 | 164 | 250 |
| MGP22 | maize\|13v2\|CF629964 | 165 | 251 |
| MGP23 | maize\|13v2\|BU197720 | 166 | 252 |
| MGP24 | maize\|13v2\|EU943272 | 167 | 253 |
| MGP25 | rice\|11v1\|BI797334 | 168 | 254 |
| MGP26 | rice\|13v2\|AU056740 | 169 | 255 |
| MGP27 | rice\|13v2\|AU174125 | 170 | 256 |
| MGP28 | rice\|13v2\|BQ908084 | 171 | 294 |
| MGP33 | sorghum\|12v1\|SB03G000370 | 172 | 259 |
| MGP34 | sorghum\|13v2\|BF587276 | 173 | 295 |
| MGP35 | sorghum\|12v1\|SB03G040900 | 174 | 261 |
| MGP38 | sorghum\|13v2\|CD213494 | 175 | 263 |
| MGP39 | sorghum\|13v2\|CN128367 | 176 | 264 |
| MGP40 | tomato\|13v1\|AI485915 | 177 | 296 |
| MGP42 | wheat\|12v3\|BF201691 | 178 | 297 |
| MGP19_H1 | sorghum\|13v2\|BF656809 | 179 | 267 |
| MGP30_H1 | sorghum\|13v2\|CF480985 | 180 | 268 |
| RIN44 | rice\|11v1\|BE039940 | 181 | 269 |

Table 178. Provided are the identified genes which expression thereof in plants increases abiotic stress tolerance, water use efficiency, yield, growth rate, vigor, biomass, fiber yield, fiber quality, gowth rate, oil content, nitrogen use efficiency and fertilizer use efficiency of a plant.
"Polyn."—polynucleotide;
"Polyp."—polypeptide.

Example 19

Identification of Homologues which Affect Abst, Wue, Yield, Growth Rate, Vigor, Biomass, Oil Content, Nue and/or Fue of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

Identification of putative orthologs of the genes identified in Table 178 above can be performed using various tools such as the BLAST™ (National Library of Medicine; Basic Local Alignment Search Tool/). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing to construct a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

Methods for searching and identifying homologues of yield and improved agronomic traits such as ABS tolerance and FUE related polypeptides or polynucleotides are well within the realm of the skilled artisan. The search and identification of homologous genes involves the screening of sequence information available, for example, in public databases, which include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST™ programs. There are five implementations of BLAST™, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST™ algorithm calculates percent sequence identity and performs a statistical analysis of the similarity between the two sequences. The software for performing BLAST™ analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48:

443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of the invention. Example of other plants are included here but not limited to, barley (Hordeum vulgare), Arabidopsis (Arabidopsis thaliana), maize (Zea mays), cotton (Gossypium), Oilseed rape (Brassica napus), Rice (Oryza sativa), Sugar cane (Saccharum officinarum), Sorghum (Sorghum bicolor), Soybean (Glycine max), Sunflower (Helianthus annuus), Tomato (Lycopersicon esculentum), Wheat (Triticum aestivum).

The above-mentioned analyses for sequence homology is preferably carried out on a full-length sequence, but may also be based on a comparison of certain regions such as conserved domains. The identification of such domains would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem (dot) ucl (dot) ac (dot) uk/bsm/dbbrowser/protocol/prodomqry (dot) html), PIR (pir (dot) Georgetown (dot) edu/) or Pfam (sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 178 (Example 18 above) were identified from the databases using BLAST™ software with the BLASTP™ and tBLASTN™ algorithms as filters for the first stage, and the needle (EMBOSS package) or Frame+ algorithm alignment for the second stage. Local identity (Blast alignments) was defined with a very permissive cutoff—60% Identity on a span of 60% of the sequences lengths because it use as only a filter for the global alignment stage. The default filtering of the Blast package was not utilized (by setting the parameter "–F F").

In the second stage, homologs were defined based on a global identity of at least 80% to the core gene polypeptide sequence. Two distinct forms for finding the optimal global alignment for protein or nucleotide sequences were used in this application:

1. Between Two Proteins (Following the BLASTP™ Filter):
EMBOSS-6.0.1 Needleman-Wunsch algorithm with the following modified parameters: gapopen=8 gapextend=2. The rest of the parameters were unchanged from the default options described hereinabove.

2. Between a Protein Sequence and a Nucleotide Sequence (Following the tBLASTN™ Filter):
GenCore 6.0 OneModel application utilizing the Frame+ algorithm with the following parameters: model= frame+_p2n.model mode=qglobal -q=protein. sequence -db=nucleotide.sequence. The rest of the parameters are unchanged from the default options described hereinabove.

The query polypeptide sequences were SEQ ID NOs: 182-269 [which are encoded by the polynucleotides SEQ ID NOs: 1-88 shown in Table 178 above] and the identified orthologous and homologous sequences having at least 80% global sequence identity are provided in Table 179, below. These homologous genes (e.g., orthologues) are expected to increase plant ABST, yield, seed yield, oil yield, oil content, growth rate, fiber yield, fiber quality, fiber length, photosynthetic capacity, root coverage, rosette area, plot coverage, biomass, vigor, WUE and/or NUE of a plant.

TABLE 179

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 298 | LGA1 | rye\|12v1\|DRR001012.323154 | 3651 | 182 | 88.3 | globlastp |
| 299 | LGA1 | lolium\|13v1\|DT670466_P1 | 3652 | 182 | 87 | globlastp |
| 300 | LGA1 | brachypodium\|13v2\|BRADI3G02190 | 3653 | 182 | 84.8 | globlastp |
| 301 | LGA1 | brachypodium\|14v1\|XM_003573582_P1 | 3653 | 182 | 84.8 | globlastp |
| 302 | LGA1 | sorghum\|13v2\|BE917942 | 3654 | 182 | 82.26 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 303 | LGA1 | foxtail_millet\|13v2\|EC612864 | 3655 | 182 | 82.1 | glotblastn |
| 304 | LGA1 | foxtail_millet\|14v1\|EC612864_T1 | 3655 | 182 | 82.1 | glotblastn |
| 305 | LGA1 | switchgrass\|12v1\|FL689916 | 3656 | 182 | 82.1 | globlastp |
| 306 | LGA1 | maize\|13v2\|AI629570_T1 | 3657 | 182 | 80.33 | glotblastn |
| 307 | LGA2 | wheat\|12v3\|BE414179 | 3658 | 183 | 97.4 | globlastp |
| 308 | LGA2 | rye\|12v1\|DRR001012.148240 | 3659 | 183 | 95.9 | globlastp |
| 309 | LGA2 | oat\|11v1\|CN819657 | 3660 | 183 | 91.38 | globlastp |
| 310 | LGA2 | brachypodium\|13v2\|BRADI5G09300 | 3661 | 183 | 90.5 | globlastp |
| 311 | LGA2 | brachypodium\|14v1\|DV475979_P1 | 3661 | 183 | 90.5 | globlastp |
| 312 | LGA2 | millet\|10v1\|EVO454PM038345_P1 | 3662 | 183 | 88.6 | globlastp |
| 313 | LGA2 | foxtail_millet\|13v2\|SRR350548X172234 | 3663 | 183 | 88.4 | globlastp |
| 314 | LGA2 | foxtail_millet\|14v1\|JK579185_P1 | 3663 | 183 | 88.4 | globlastp |
| 315 | LGA2 | switchgrass\|12v1\|FE600798 | 3664 | 183 | 87.3 | globlastp |
| 316 | LGA2 | switchgrass\|12v1\|FL746019 | 3665 | 183 | 87.3 | globlastp |
| 317 | LGA2 | sugarcane\|10v1\|CA101792 | 3666 | 183 | 86.9 | globlastp |
| 318 | LGA2 | sorghum\|13v2\|BG463884 | 3667 | 183 | 86.7 | globlastp |
| 319 | LGA2 | echinochloa\|14v1\|SRR522894X174301D1_P1 | 3668 | 183 | 86.2 | globlastp |
| 320 | LGA2 | maize\|13v2\|AW267412_P1 | 3669 | 183 | 84.7 | globlastp |
| 321 | LGA2 | rice\|13v2\|AA754266 | 3670 | 183 | 82.6 | globlastp |
| 322 | LGA6 | cacao\|13v1\|CU504227_P1 | 3671 | 184 | 82.8 | globlastp |
| 323 | LGA9 | heritiera\|10v1\|SRR005794S0002404_P1 | 3672 | 185 | 91.6 | globlastp |
| 324 | LGA9 | cotton\|11v1\|BQ410590_P1 | 3673 | 185 | 91.2 | globlastp |
| 325 | LGA9 | clementine\|11v1\|BE205694_P1 | 3674 | 185 | 90.9 | globlastp |
| 326 | LGA9 | cotton\|11v1\|AI729046_P1 | 3675 | 185 | 90.9 | globlastp |
| 327 | LGA9 | cotton\|11v1\|DT460610_P1 | 3675 | 185 | 90.9 | globlastp |
| 328 | LGA9 | gossypium_raimondii\|13v1\|AI729046_P1 | 3675 | 185 | 90.9 | globlastp |
| 329 | LGA9 | grape\|13v1\|GSVIVT01027807001_P1 | 3676 | 185 | 90.9 | globlastp |
| 330 | LGA9 | kiwi\|gb166\|FG426627_P1 | 3677 | 185 | 90.9 | globlastp |
| 331 | LGA9 | orange\|11v1\|BE205694_P1 | 3674 | 185 | 90.9 | globlastp |
| 332 | LGA9 | tea\|10v1\|DN976213 | 3678 | 185 | 90.9 | globlastp |
| 333 | LGA9 | beech\|11v1\|SRR006293.23297_T1 | 3679 | 185 | 90.21 | glotblastn |
| 334 | LGA9 | chestnut\|14v1\|SRR006295X103970D1_P1 | 3680 | 185 | 90.2 | globlastp |
| 335 | LGA9 | cacao\|13v1\|CA794551_P1 | 3681 | 185 | 90.2 | globlastp |
| 336 | LGA9 | chestnut\|gb170\|SRR006295S0016251 | 3680 | 185 | 90.2 | globlastp |
| 337 | LGA9 | cotton\|11v1\|DW486688_P1 | 3682 | 185 | 90.2 | globlastp |
| 338 | LGA9 | gossypium_raimondii\|13v1\|DQ402081_P1 | 3683 | 185 | 90.2 | globlastp |
| 339 | LGA9 | kiwi\|gb166\|FG454272_P1 | 3684 | 185 | 90.2 | globlastp |
| 340 | LGA9 | oak\|10v1\|DB996957_P1 | 3680 | 185 | 90.2 | globlastp |
| 341 | LGA9 | papaya\|gb165\|EX266243_P1 | 3685 | 185 | 90.2 | globlastp |
| 342 | LGA9 | sarracenia\|11v1\|SRR192669.101397 | 3686 | 185 | 89.51 | glotblastn |
| 343 | LGA9 | eucalyptus\|11v2\|CT985594_P1 | 3687 | 185 | 89.5 | globlastp |
| 344 | LGA9 | ginseng\|13v1\|JK985794_P1 | 3688 | 185 | 89.5 | globlastp |
| 345 | LGA9 | tripterygium\|11v1\|SRR098677X161078 | 3689 | 185 | 88.81 | glotblastn |
| 346 | LGA9 | aquilegia\|10v2\|JGIAC006059_P1 | 3690 | 185 | 88.8 | globlastp |
| 347 | LGA9 | cassava\|09v1\|CK647478_P1 | 3691 | 185 | 88.8 | globlastp |
| 348 | LGA9 | ginseng\|13v1\|SRR547977.311590_P1 | 3692 | 185 | 88.8 | globlastp |
| 349 | LGA9 | platanus\|11v1\|SRR096786X113569_P1 | 3693 | 185 | 88.8 | globlastp |
| 350 | LGA9 | primula\|11v1\|SRR098679X121300_P1 | 3694 | 185 | 88.8 | globlastp |
| 351 | LGA9 | tabernaemontana\|11v1\|SRR098689X126417 | 3695 | 185 | 88.8 | globlastp |
| 352 | LGA9 | blueberry\|12v1\|SRR353282X49566D1_P1 | 3696 | 185 | 88.4 | globlastp |
| 353 | LGA9 | blueberry\|12v1\|SRR353282X49798D1_P1 | 3696 | 185 | 88.4 | globlastp |
| 354 | LGA9 | platanus\|11v1\|SRR096786X131715_T1 | 3697 | 185 | 88.11 | glotblastn |
| 355 | LGA9 | amsonia\|11v1\|SRR098688X102074_P1 | 3698 | 185 | 88.1 | globlastp |
| 356 | LGA9 | olea\|13v1\|SRR014466X15986D1_P1 | 3699 | 185 | 88.1 | globlastp |
| 357 | LGA9 | cassava\|09v1\|DV456382_P1 | 3700 | 185 | 87.8 | globlastp |
| 358 | LGA9 | kiwi\|gb166\|FG403301_P1 | 3701 | 185 | 87.6 | globlastp |
| 359 | LGA9 | euphorbia\|11v1\|DV138926XX2_P1 | 3702 | 185 | 87.4 | globlastp |
| 360 | LGA9 | spurge\|gb161\|DV138926 | 3702 | 185 | 87.4 | globlastp |
| 361 | LGA9 | poplar\|13v1\|AI161893_P1 | 3703 | 185 | 87 | globlastp |
| 362 | LGA9 | acacia\|10v1\|FS584002_P1 | 3704 | 185 | 86.9 | globlastp |
| 363 | LGA9 | nasturtium\|11v1\|GH165610_P1 | 3705 | 185 | 86.8 | globlastp |
| 364 | LGA9 | blueberry\|12v1\|SRR353282X88853D1_T1 | 3706 | 185 | 86.71 | glotblastn |
| 365 | LGA9 | cannabis\|12v1\|JK493672_P1 | 3707 | 185 | 86.7 | globlastp |
| 366 | LGA9 | ipomoea_batatas\|10v1\|CB330087_P1 | 3708 | 185 | 86.7 | globlastp |
| 367 | LGA9 | blueberry\|12v1\|SRR353283X29934D1_P1 | 3709 | 185 | 86.2 | globlastp |
| 368 | LGA9 | amorphophallus\|11v2\|SRR089351X169832_P1 | 3710 | 185 | 86 | globlastp |
| 369 | LGA9 | cannabis\|12v1\|JK497352_P1 | 3711 | 185 | 86 | globlastp |
| 370 | LGA9 | grape\|13v1\|GSVIVT01028324001_P1 | 3712 | 185 | 86 | globlastp |
| 371 | LGA9 | prunus_mume\|13v1\|AJ533276 | 3713 | 185 | 86 | globlastp |
| 372 | LGA9 | prunus\|10v1\|AJ533276 | 3713 | 185 | 86 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 373 | LGA9 | ipomoea_batatas|10v1|EE875692_P1 | 3714 | 185 | 85.6 | globlastp |
| 374 | LGA9 | monkeyflower|12v1|GO968079_P1 | 3715 | 185 | 85.6 | globlastp |
| 375 | LGA9 | peanut|13v1|SRR042413X23566_P1 | 3716 | 185 | 85.5 | globlastp |
| 376 | LGA9 | valeriana|11v1|SRR099039X20196 | 3717 | 185 | 85.5 | globlastp |
| 377 | LGA9 | peanut|13v1|SRR042413X23566 | — | 185 | 85.5 | globlastp |
| 378 | LGA9 | rose|12v1|SRR397984.107788 | 3718 | 185 | 85.3 | globlastp |
| 379 | LGA9 | peanut|13v1|EH043558_P1 | 3719 | 185 | 84.8 | globlastp |
| 380 | LGA9 | amborella|12v3|FD435822_T1 | 3720 | 185 | 84.62 | glotblastn |
| 381 | LGA9 | amorphophallus|11v2|SRR089351X100781_T1 | 3721 | 185 | 84.62 | glotblastn |
| 382 | LGA9 | catharanthus|11v1|EG554720_T1 | 3722 | 185 | 84.62 | glotblastn |
| 383 | LGA9 | chickpea|13v2|SRR133519.99714_T1 | 3723 | 185 | 84.62 | glotblastn |
| 384 | LGA9 | soybean|13v2|GLYMA06G03640 | 3724 | 185 | 84.62 | glotblastn |
| 385 | LGA9 | strawberry|11v1|DV440449 | 3725 | 185 | 84.6 | globlastp |
| 386 | LGA9 | cleome_gynandra|10v1|SRR015532S0003823_P1 | 3726 | 185 | 84.2 | globlastp |
| 387 | LGA9 | amborella|12v3|SRR038644.123058_T1 | 3727 | 185 | 83.92 | glotblastn |
| 388 | LGA9 | chickpea|13v2|GR407527_T1 | 3728 | 185 | 83.92 | glotblastn |
| 389 | LGA9 | peanut|13v1|SRR042421X352010_T1 | 3729 | 185 | 83.92 | glotblastn |
| 390 | LGA9 | banana|14v1|FF557535_P1 | 3730 | 185 | 83.9 | globlastp |
| 391 | LGA9 | banana|12v1|FF557535 | 3730 | 185 | 83.9 | globlastp |
| 392 | LGA9 | iceplant|gb164|BE033912_P1 | 3731 | 185 | 83.9 | globlastp |
| 393 | LGA9 | cleome_spinosa|10v1|SRR015531S0000759_P1 | 3732 | 185 | 83.6 | globlastp |
| 394 | LGA9 | catharanthus|11v1|SRR098691X104078_P1 | 3733 | 185 | 83.4 | globlastp |
| 395 | LGA9 | triphysaria|13v1|EY127719 | 3734 | 185 | 83.4 | globlastp |
| 396 | LGA9 | cannabis|12v1|SOLX00019810_T1 | 3735 | 185 | 83.22 | glotblastn |
| 397 | LGA9 | ginseng|13v1|SRR547977.23761_T1 | — | 185 | 83.22 | glotblastn |
| 398 | LGA9 | coconut|14v1|COCOS14V1K19C221494_P1 | 3736 | 185 | 83.2 | globlastp |
| 399 | LGA9 | chelidonium|11v1|SRR084752X103690_P1 | 3737 | 185 | 83.2 | globlastp |
| 400 | LGA9 | clover|gb162|BB920045 | 3738 | 185 | 83.2 | globlastp |
| 401 | LGA9 | eschscholzia|11v1|CD479696_P1 | 3739 | 185 | 83.2 | globlastp |
| 402 | LGA9 | euonymus|11v1|SRR070039X261280_P1 | 3740 | 185 | 83.2 | globlastp |
| 403 | LGA9 | nuphar|gb166|CK749359_P1 | 3741 | 185 | 83.2 | globlastp |
| 404 | LGA9 | silene|11v1|GH291501 | 3742 | 185 | 83.2 | globlastp |
| 405 | LGA9 | cyclamen|14v1|B14ROOTK19C157046_P1 | 3743 | 185 | 83.1 | globlastp |
| 406 | LGA9 | pigeonpea|11v1|SRR054580X127598_P1 | 3744 | 185 | 83.1 | globlastp |
| 407 | LGA9 | soybean|13v2|GLYMA10G32400T3 | 3745 | 185 | 83.1 | globlastp |
| 408 | LGA9 | liquorice|gb171|FS262480_P1 | 3746 | 185 | 83 | globlastp |
| 409 | LGA9 | nicotiana_benthamiana|12v1|EB444981_P1 | 3747 | 185 | 82.9 | globlastp |
| 410 | LGA9 | amsonia|11v1|SRR098688X134561_P1 | 3748 | 185 | 82.8 | globlastp |
| 411 | LGA9 | ginseng|13v1|DV554591_P1 | 3749 | 185 | 82.8 | globlastp |
| 412 | LGA9 | ginseng|13v1|SRR547977.113238_P1 | 3749 | 185 | 82.8 | globlastp |
| 413 | LGA9 | ginseng|13v1|SRR547977.132740_P1 | 3749 | 185 | 82.8 | globlastp |
| 414 | LGA9 | potato|10v1|BI406929_P1 | 3750 | 185 | 82.8 | globlastp |
| 415 | LGA9 | sarracenia|11v1|SRR192669.101127 | 3751 | 185 | 82.8 | globlastp |
| 416 | LGA9 | sarracenia|11v1|SRR192669.120144 | 3752 | 185 | 82.8 | globlastp |
| 417 | LGA9 | solanum_phureja|09v1|SPHBG127977 | 3750 | 185 | 82.8 | globlastp |
| 418 | LGA9 | coffea|10v1|DV665820_P1 | 3753 | 185 | 82.7 | globlastp |
| 419 | LGA9 | oil_palm|11v1|EL691301_T1 | 3754 | 185 | 82.52 | glotblastn |
| 420 | LGA9 | amorphophallus|11v2|SRR089351X105365_P1 | 3755 | 185 | 82.5 | globlastp |
| 421 | LGA9 | euonymus|11v1|SRR070038X203567_P1 | 3756 | 185 | 82.5 | globlastp |
| 422 | LGA9 | poppy|11v1|SRR030259.107097_P1 | 3757 | 185 | 82.5 | globlastp |
| 423 | LGA9 | poppy|11v1|SRR030259.180373_P1 | 3758 | 185 | 82.5 | globlastp |
| 424 | LGA9 | poppy|11v1|SRR096789.121313_P1 | 3757 | 185 | 82.5 | globlastp |
| 425 | LGA9 | soybean|13v2|GLYMA20G35190T2 | 3759 | 185 | 82.4 | globlastp |
| 426 | LGA9 | cowpea|12v1|FF387668_P1 | 3760 | 185 | 82.3 | globlastp |
| 427 | LGA9 | medicago|13v1|AW690419_P1 | 3761 | 185 | 82.3 | globlastp |
| 428 | LGA9 | euonymus|11v1|SRR070038X117717_P1 | 3762 | 185 | 82.2 | globlastp |
| 429 | LGA9 | liquorice|gb171|FS250353_P1 | 3763 | 185 | 82.2 | globlastp |
| 430 | LGA9 | lotus|09v1|BI419197_P1 | 3764 | 185 | 82.2 | globlastp |
| 431 | LGA9 | pigeonpea|11v1|SRR054580X111113_P1 | 3765 | 185 | 82.2 | globlastp |
| 432 | LGA9 | poplar|13v1|BU809147_P1 | 3766 | 185 | 82.2 | globlastp |
| 433 | LGA9 | tripterygium|11v1|SRR098677X102309 | 3767 | 185 | 82.2 | globlastp |
| 434 | LGA9 | olea|13v1|SRR014463X23360D1_P1 | 3768 | 185 | 82.1 | globlastp |
| 435 | LGA9 | tomato|13v1|BG127977 | 3769 | 185 | 82.1 | globlastp |
| 436 | LGA9 | cannabis|12v1|EW701684_T1 | 3770 | 185 | 81.82 | glotblastn |
| 437 | LGA9 | oak|10v1|FP051422_T1 | 3771 | 185 | 81.82 | glotblastn |
| 438 | LGA9 | oil_palm|11v1|AF236068_T1 | 3772 | 185 | 81.82 | glotblastn |
| 439 | LGA9 | trigonella|11v1|SRR066194X137024 | 3773 | 185 | 81.82 | glotblastn |
| 440 | LGA9 | valeriana|11v1|SRR099039X235042 | 3774 | 185 | 81.82 | glotblastn |
| 441 | LGA9 | aquilegia|10v2|JGIAC022563_P1 | 3775 | 185 | 81.8 | globlastp |
| 442 | LGA9 | cowpea|12v1|FF385157_P1 | 3776 | 185 | 81.5 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 443 | LGA9 | cyamopsis\|10v1\|EG977119_P1 | 3777 | 185 | 81.5 | globlastp |
| 444 | LGA9 | euonymus\|11v1\|SRR070038X417451_P1 | 3778 | 185 | 81.5 | globlastp |
| 445 | LGA9 | oil_palm\|11v1\|EL687051XX1_P1 | 3779 | 185 | 81.4 | globlastp |
| 446 | LGA9 | ambrosia\|11v1\|SRR346935.151012_T1 | 3780 | 185 | 81.12 | glotblastn |
| 447 | LGA9 | clover\|14v1\|BB920045_P1 | 3781 | 185 | 81 | globlastp |
| 448 | LGA9 | clover\|14v1\|ERR351507S19XK19C724761_P1 | 3782 | 185 | 81 | globlastp |
| 449 | LGA9 | bean\|13v1\|CA908001_P1 | 3783 | 185 | 81 | globlastp |
| 450 | LGA9 | bean\|13v1\|CA898594_P1 | 3784 | 185 | 80.8 | globlastp |
| 451 | LGA9 | lupin\|13v4\|SRR520491.1046965_P1 | 3785 | 185 | 80.8 | globlastp |
| 452 | LGA9 | trigonella\|11v1\|SRR066194X104521 | 3786 | 185 | 80.8 | globlastp |
| 453 | LGA9 | coconut\|14v1\|COCOS14V1K19C1175578_T1 | 3787 | 185 | 80.42 | glotblastn |
| 454 | LGA9 | nicotiana_benthamiana\|12v1\|EB693358_T1 | 3788 | 185 | 80.42 | glotblastn |
| 455 | LGA9 | oil_palm\|11v1\|EY397399_T1 | 3789 | 185 | 80.42 | glotblastn |
| 456 | LGA9 | poppy\|11v1\|SRR096789.44671_T1 | 3790 | 185 | 80.14 | glotblastn |
| 457 | LGA9 | clover\|14v1\|ERR351507S19XK19C177886_P1 | 3791 | 185 | 80.1 | globlastp |
| 458 | LGA9 | prunus_mume\|13v1\|BU045423 | 3792 | 185 | 80.1 | globlastp |
| 459 | LGA9 | prunus\|10v1\|BU045423 | 3793 | 185 | 80.1 | globlastp |
| 460 | LGA9 | tomato\|13v1\|BG124624 | 3794 | 185 | 80 | globlastp |
| 461 | LGA17 | rice\|13v2\|BX898423 | 3795 | 186 | 94.6 | globlastp |
| 462 | LGA17 | brachypodium\|13v2\|BRADI2G31580 | 3796 | 186 | 92.8 | globlastp |
| 463 | LGA17 | brachypodium\|14v1\|DV470431_P1 | 3796 | 186 | 92.8 | globlastp |
| 464 | LGA17 | barley\|12v1\|BG343162_P1 | 3797 | 186 | 91.9 | globlastp |
| 465 | LGA17 | rye\|12v1\|DRR001012.104857 | 3798 | 186 | 91.59 | glotblastn |
| 466 | LGA17 | coconut\|14v1\|COCOS14V1K19C1604185_P1 | 3799 | 186 | 85.5 | globlastp |
| 467 | LGA17 | pineapple\|14v1\|ACOM14V1K19C146426_T1 | 3800 | 186 | 83.04 | glotblastn |
| 468 | LGA17 | banana\|14v1\|MAGEN2012033041_P1 | 3801 | 186 | 82.1 | globlastp |
| 469 | LGA17 | banana\|12v1\|MAGEN2012033041 | 3802 | 186 | 81.9 | globlastp |
| 470 | LGB1 | gossypium_raimondii\|13v1\|DT468691_P1 | 3803 | 188 | 97.1 | globlastp |
| 471 | LGB1 | cotton\|11v1\|CO105699_P1 | 3804 | 188 | 96.9 | globlastp |
| 472 | LGB2 | millet\|10v1\|EVO454PM011614_P1 | 3805 | 189 | 99 | globlastp |
| 473 | LGB2 | sugarcane\|10v1\|CA070526 | 3806 | 189 | 98.1 | globlastp |
| 474 | LGB2 | echinochloa\|14v1\|SRR522894X123301D1_P1 | 3807 | 189 | 97.7 | globlastp |
| 475 | LGB2 | sorghum\|13v2\|AW284757 | 3808 | 189 | 97.7 | globlastp |
| 476 | LGB2 | switchgrass\|12v1\|DN150738 | 3809 | 189 | 97.7 | globlastp |
| 477 | LGB2 | wheat\|12v3\|CA484480 | 3808 | 189 | 97.7 | globlastp |
| 478 | LGB2 | echinochloa\|14v1\|ECHC14V1K23C332763_P1 | 3810 | 189 | 97.4 | globlastp |
| 479 | LGB2 | maize\|13v2\|AI622103_P1 | 3811 | 189 | 95.8 | globlastp |
| 480 | LGB2 | rice\|13v2\|BI806930 | 3812 | 189 | 93.2 | globlastp |
| 481 | LGB2 | brachypodium\|13v2\|BRADI2G03297 | 3813 | 189 | 92.9 | globlastp |
| 482 | LGB2 | brachypodium\|14v1\|GT763806_P1 | 3813 | 189 | 92.9 | globlastp |
| 483 | LGB2 | wheat\|12v3\|BE470860 | 3814 | 189 | 92.9 | globlastp |
| 484 | LGB2 | wheat\|12v3\|BE500702 | 3815 | 189 | 92.6 | globlastp |
| 485 | LGB2 | oat\|14v1\|GO591091_P1 | 3816 | 189 | 91.9 | globlastp |
| 486 | LGB2 | oat\|14v1\|GR332934_P1 | 3817 | 189 | 91.6 | globlastp |
| 487 | LGB2 | oat\|14v1\|SRR020741X441179D1_P1 | 3818 | 189 | 91.6 | globlastp |
| 488 | LGB2 | lolium\|13v1\|ERR246395S15839_P1 | 3819 | 189 | 91.6 | globlastp |
| 489 | LGB2 | oat\|11v1\|GR332934 | 3818 | 189 | 91.6 | globlastp |
| 490 | LGB2 | oat\|14v1\|ASTE13V1K19C407913_P1 | 3820 | 189 | 91.3 | globlastp |
| 491 | LGB2 | oat\|14v1\|GR326053_P1 | 3821 | 189 | 91.3 | globlastp |
| 492 | LGB2 | fescue\|13v1\|DT680215_P1 | 3822 | 189 | 91.3 | globlastp |
| 493 | LGB2 | oat\|11v1\|GO591091 | 3821 | 189 | 91.3 | globlastp |
| 494 | LGB2 | pseudoroegneria\|gb167\|FF339965 | 3823 | 189 | 89.4 | globlastp |
| 495 | LGB2 | switchgrass\|12v1\|GD021700 | 3824 | 189 | 86.77 | glotblastn |
| 496 | LGB2 | castorbean\|14v2\|EG657378_P1 | 3825 | 189 | 85.8 | globlastp |
| 497 | LGB2 | onion\|14v1\|CF440313_P1 | 3826 | 189 | 85.8 | globlastp |
| 498 | LGB2 | castorbean\|12v1\|EG657378 | 3825 | 189 | 85.8 | globlastp |
| 499 | LGB2 | onion\|12v1\|CF440313 | 3826 | 189 | 85.8 | globlastp |
| 500 | LGB2 | switchgrass\|12v1\|FL786193 | 3824 | 189 | 85.8 | glotblastn |
| 501 | LGB2 | onion\|14v1\|SRR073446X157415D1_P1 | 3827 | 189 | 85.5 | globlastp |
| 502 | LGB2 | pineapple\|14v1\|ACOM14V1K19C2188440_P1 | 3828 | 189 | 85.5 | globlastp |
| 503 | LGB2 | chestnut\|14v1\|SRR006295X104715D1_P1 | 3829 | 189 | 84.8 | globlastp |
| 504 | LGB2 | chestnut\|gb170\|SRR006295S0071914 | 3829 | 189 | 84.8 | globlastp |
| 505 | LGB2 | clementine\|11v1\|CO912652_P1 | 3830 | 189 | 84.5 | globlastp |
| 506 | LGB2 | oak\|10v1\|DB996589_P1 | 3831 | 189 | 84.5 | globlastp |
| 507 | LGB2 | avocado\|10v1\|CO998766_P1 | 3832 | 189 | 84.2 | globlastp |
| 508 | LGB2 | blueberry\|12v1\|SRR353282X19444D1_P1 | 3833 | 189 | 84.2 | globlastp |
| 509 | LGB2 | cucumber\|09v1\|AM723600_P1 | 3834 | 189 | 84.2 | globlastp |
| 510 | LGB2 | melon\|10v1\|AM723600_P1 | 3835 | 189 | 84.2 | globlastp |
| 511 | LGB2 | oil_palm\|11v1\|EL691664XX2_P1 | 3836 | 189 | 84.2 | globlastp |
| 512 | LGB2 | cotton\|11v1\|AI727383_P1 | 3837 | 189 | 83.9 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 513 | LGB2 | cotton\|11v1\|AI730373_P1 | 3837 | 189 | 83.9 | globlastp |
| 514 | LGB2 | gossypium_raimondii\|13v1\|AI727383_P1 | 3837 | 189 | 83.9 | globlastp |
| 515 | LGB2 | platanus\|11v1\|SRR096786X136014_T1 | 3838 | 189 | 83.55 | glotblastn |
| 516 | LGB2 | b_oleracea\|14v1\|BQ791192_P1 | 3839 | 189 | 83.5 | globlastp |
| 517 | LGB2 | b_juncea\|12v1\|E6ANDIZ01BQYV7_P1 | 3840 | 189 | 83.5 | globlastp |
| 518 | LGB2 | b_juncea\|12v1\|E6ANDIZ01C2JOJ_P1 | 3841 | 189 | 83.5 | globlastp |
| 519 | LGB2 | b_oleracea\|gb161\|DY028237 | 3842 | 189 | 83.5 | globlastp |
| 520 | LGB2 | cacao\|13v1\|CU628214_P1 | 3843 | 189 | 83.5 | globlastp |
| 521 | LGB2 | canola\|11v1\|EE451354_P1 | 3840 | 189 | 83.5 | globlastp |
| 522 | LGB2 | canola\|11v1\|EE480343_P1 | 3841 | 189 | 83.5 | globlastp |
| 523 | LGB2 | eschscholzia\|11v1\|SRR014116.111013_P1 | 3844 | 189 | 83.5 | globlastp |
| 524 | LGB2 | soybean\|13v2\|GLYMA02G44090T3 | 3845 | 189 | 83.5 | globlastp |
| 525 | LGB2 | chelidonium\|11v1\|SRR084752X106485_T1 | 3846 | 189 | 83.23 | glotblastn |
| 526 | LGB2 | b_rapa\|11v1\|H07328_P1 | 3847 | 189 | 83.2 | globlastp |
| 527 | LGB2 | cassava\|09v1\|DV447317_P1 | 3848 | 189 | 83.2 | globlastp |
| 528 | LGB2 | cotton\|11v1\|CO081682_P1 | 3849 | 189 | 83.2 | globlastp |
| 529 | LGB2 | echinacea\|13v1\|EPURP13V11466322_P1 | 3850 | 189 | 83.2 | globlastp |
| 530 | LGB2 | eggplant\|10v1\|FS033305_P1 | 3851 | 189 | 83.2 | globlastp |
| 531 | LGB2 | euonymus\|11v1\|SRR070038X219013_P1 | 3852 | 189 | 83.2 | globlastp |
| 532 | LGB2 | radish\|gb164\|EW713768 | 3853 | 189 | 83.2 | globlastp |
| 533 | LGB2 | radish\|gb164\|EX749849 | 3853 | 189 | 83.2 | globlastp |
| 534 | LGB2 | radish\|gb164\|EX753440 | 3854 | 189 | 83.2 | globlastp |
| 535 | LGB2 | sesame\|12v1\|SESI12V1409139 | 3855 | 189 | 83.2 | globlastp |
| 536 | LGB2 | plantago\|11v2\|SRR066373X131265XX1_P1 | 3856 | 189 | 83 | globlastp |
| 537 | LGB2 | banana\|14v1\|FL666977_P1 | 3857 | 189 | 82.9 | globlastp |
| 538 | LGB2 | arabidopsis_lyrata\|13v1\|AA394495_P1 | 3858 | 189 | 82.9 | globlastp |
| 539 | LGB2 | euonymus\|11v1\|SRR070038X242284_T1 | 3859 | 189 | 82.9 | glotblastn |
| 540 | LGB2 | fagopyrum\|11v1\|SRR063689X186569_P1 | 3860 | 189 | 82.9 | globlastp |
| 541 | LGB2 | flaveria\|11v1\|SRR149242.105952_P1 | 3861 | 189 | 82.9 | globlastp |
| 542 | LGB2 | humulus\|11v1\|SRR098683X107381_P1 | 3862 | 189 | 82.9 | globlastp |
| 543 | LGB2 | kiwi\|gb166\|FG409288_P1 | 3863 | 189 | 82.9 | globlastp |
| 544 | LGB2 | poplar\|13v1\|BU816550_P1 | 3864 | 189 | 82.9 | globlastp |
| 545 | LGB2 | poppy\|11v1\|FG608985_P1 | 3865 | 189 | 82.9 | globlastp |
| 546 | LGB2 | poppy\|11v1\|SRR096789.136039_T1 | 3866 | 189 | 82.9 | glotblastn |
| 547 | LGB2 | radish\|gb164\|EV535186 | 3867 | 189 | 82.9 | globlastp |
| 548 | LGB2 | tripterygium\|11v1\|SRR098677X13108 | 3868 | 189 | 82.9 | globlastp |
| 549 | LGB2 | watermelon\|11v1\|AM723600 | 3869 | 189 | 82.9 | globlastp |
| 550 | LGB2 | bean\|13v1\|SRR001334X194966_P1 | 3870 | 189 | 82.6 | globlastp |
| 551 | LGB2 | catharanthus\|11v1\|SRR098691X103212_P1 | 3871 | 189 | 82.6 | globlastp |
| 552 | LGB2 | cleome_gynandra\|10v1\|SRR015532S0095562_P1 | 3872 | 189 | 82.6 | globlastp |
| 553 | LGB2 | echinacea\|13v1\|EPURP13V11471030_P1 | 3873 | 189 | 82.6 | globlastp |
| 554 | LGB2 | flaveria\|11v1\|SRR149232.169887_P1 | 3874 | 189 | 82.6 | globlastp |
| 555 | LGB2 | ipomoea_nil\|10v1\|BJ565705_P1 | 3875 | 189 | 82.6 | globlastp |
| 556 | LGB2 | prunus_mume\|13v1\|BU044801 | 3876 | 189 | 82.6 | globlastp |
| 557 | LGB2 | soybean\|13v2\|GLYMA14G04780 | 3877 | 189 | 82.6 | globlastp |
| 558 | LGB2 | tomato\|13v1\|BG626603 | 3878 | 189 | 82.6 | globlastp |
| 559 | LGB2 | clover\|14v1\|BB906163_P1 | 3879 | 189 | 82.3 | globlastp |
| 560 | LGB2 | arabidopsis\|13v2\|AT3G55360_P1 | 3880 | 189 | 82.3 | globlastp |
| 561 | LGB2 | banana\|12v1\|FL666977 | 3881 | 189 | 82.3 | globlastp |
| 562 | LGB2 | cleome_spinosa\|10v1\|GR934171_P1 | 3882 | 189 | 82.3 | globlastp |
| 563 | LGB2 | eucalyptus\|11v2\|CU395611_P1 | 3883 | 189 | 82.3 | globlastp |
| 564 | LGB2 | flaveria\|11v1\|SRR149229.207327_P1 | 3884 | 189 | 82.3 | globlastp |
| 565 | LGB2 | flaveria\|11v1\|SRR149229.309367_P1 | 3885 | 189 | 82.3 | globlastp |
| 566 | LGB2 | grape\|13v1\|GSVIVT01016549001_P1 | 3886 | 189 | 82.3 | globlastp |
| 567 | LGB2 | medicago\|13v1\|AL374087_P1 | 3887 | 189 | 82.3 | globlastp |
| 568 | LGB2 | parthenium\|10v1\|GW778082_P1 | 3888 | 189 | 82.3 | globlastp |
| 569 | LGB2 | prunus\|10v1\|BU044801 | 3889 | 189 | 82.3 | globlastp |
| 570 | LGB2 | quinoa\|13v2\|SRR315568X607781 | 3890 | 189 | 82.3 | globlastp |
| 571 | LGB2 | sunflower\|12v1\|DY914176 | 3891 | 189 | 82.3 | globlastp |
| 572 | LGB2 | thellungiella_halophilum\|13v1\|BY805356 | 3892 | 189 | 82.3 | globlastp |
| 573 | LGB2 | beet\|12v1\|BI073163_P1 | 3893 | 189 | 82 | globlastp |
| 574 | LGB2 | banana\|14v1\|FL665169_P1 | 3894 | 189 | 81.9 | globlastp |
| 575 | LGB2 | cannabis\|12v1\|SOLX00002886_P1 | 3895 | 189 | 81.9 | globlastp |
| 576 | LGB2 | cannabis\|12v1\|SOLX00020756_P1 | 3895 | 189 | 81.9 | globlastp |
| 577 | LGB2 | cowpea\|12v1\|FF383909_P1 | 3896 | 189 | 81.9 | globlastp |
| 578 | LGB2 | echinacea\|13v1\|EPURP13V1291491_P1 | 3897 | 189 | 81.9 | globlastp |
| 579 | LGB2 | nicotiana_benthamiana\|12v1\|DQ000300_P1 | 3898 | 189 | 81.9 | globlastp |
| 580 | LGB2 | olea\|13v1\|SRR014464X17760D1_P1 | 3899 | 189 | 81.9 | globlastp |
| 581 | LGB2 | poplar\|13v1\|BU834422_P1 | 3900 | 189 | 81.9 | globlastp |
| 582 | LGB2 | primula\|11v1\|SRR098679X101259_P1 | 3901 | 189 | 81.9 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 583 | LGB2 | quinoa\|13v2\|SRR315570X476336 | 3902 | 189 | 81.9 | globlastp |
| 584 | LGB2 | solanum_phureja\|09v1\|SPHBG626603 | 3903 | 189 | 81.9 | globlastp |
| 585 | LGB2 | thellungiella_parvulum\|13v1\|BY805356 | 3904 | 189 | 81.9 | globlastp |
| 586 | LGB2 | tobacco\|gb162\|DW001511 | 3905 | 189 | 81.9 | globlastp |
| 587 | LGB2 | centaurea\|11v1\|EH726764_P1 | 3906 | 189 | 81.7 | globlastp |
| 588 | LGB2 | trigonella\|11v1\|SRR066194X10361 | 3907 | 189 | 81.7 | globlastp |
| 589 | LGB2 | tabernaemontana\|11v1\|SRR098689X10897XX1 | 3908 | 189 | 81.61 | glotblastn |
| 590 | LGB2 | lotus\|09v1\|LLAV414544_P1 | 3909 | 189 | 81.6 | globlastp |
| 591 | LGB2 | olea\|13v1\|SRR014464X39911D1_P1 | 3910 | 189 | 81.6 | globlastp |
| 592 | LGB2 | spruce\|11v1\|ES256255 | 3911 | 189 | 81.6 | globlastp |
| 593 | LGB2 | spruce\|11v1\|ES853090 | 3911 | 189 | 81.6 | globlastp |
| 594 | LGB2 | spruce\|11v1\|EX333821 | 3911 | 189 | 81.6 | globlastp |
| 595 | LGB2 | tripterygium\|11v1\|SRR098677X117679 | 3912 | 189 | 81.6 | globlastp |
| 596 | LGB2 | barley\|12v1\|BE438915_T1 | 3913 | 189 | 81.4 | glotblastn |
| 597 | LGB2 | cirsium\|11v1\|SRR346952.1008569_P1 | 3914 | 189 | 81.4 | globlastp |
| 598 | LGB2 | zostera\|12v1\|AM766030 | 3915 | 189 | 81.35 | glotblastn |
| 599 | LGB2 | ambrosia\|11v1\|SRR346935.102265_P1 | 3916 | 189 | 81.3 | globlastp |
| 600 | LGB2 | eschscholzia\|11v1\|SRR014116.107656_P1 | 3917 | 189 | 81.3 | globlastp |
| 601 | LGB2 | pine\|10v2\|AI919870_P1 | 3918 | 189 | 81.3 | globlastp |
| 602 | LGB2 | ambrosia\|11v1\|SRR346935.228079XX1_T1 | 3919 | 189 | 81.29 | glotblastn |
| 603 | LGB2 | poppy\|11v1\|SRR030259.108104_T1 | 3920 | 189 | 81.29 | glotblastn |
| 604 | LGB2 | banana\|12v1\|FL665169 | 3921 | 189 | 81 | globlastp |
| 605 | LGB2 | maritime_pine\|10v1\|BX677365_P1 | 3922 | 189 | 81 | globlastp |
| 606 | LGB2 | oak\|10v1\|FN711907_P1 | 3923 | 189 | 81 | globlastp |
| 607 | LGB2 | petunia\|gb171\|CV293305_P1 | 3924 | 189 | 81 | globlastp |
| 608 | LGB2 | pigeonpea\|11v1\|SRR054580X123540_P1 | 3925 | 189 | 81 | globlastp |
| 609 | LGB2 | potato\|10v1\|BF053187_P1 | 3926 | 189 | 81 | globlastp |
| 610 | LGB2 | rhizophora\|10v1\|SRR005792S0006315 | 3927 | 189 | 81 | globlastp |
| 611 | LGB2 | sunflower\|12v1\|DY950520 | 3928 | 189 | 81 | globlastp |
| 612 | LGB2 | abies\|11v2\|SRR098676X123645_T1 | 3929 | 189 | 80.97 | glotblastn |
| 613 | LGB2 | clover\|14v1\|BB915821_P1 | 3930 | 189 | 80.7 | globlastp |
| 614 | LGB2 | centaurea\|11v1\|EH747309_P1 | 3931 | 189 | 80.7 | globlastp |
| 615 | LGB2 | cirsium\|11v1\|SRR346952.1005506_P1 | 3932 | 189 | 80.7 | globlastp |
| 616 | LGB2 | cirsium\|11v1\|SRR349641.101468_P1 | 3933 | 189 | 80.7 | globlastp |
| 617 | LGB2 | coconut\|14v1\|COCOS14V1K19C1489572_T1 | 3934 | 189 | 80.65 | glotblastn |
| 618 | LGB2 | aquilegia\|10v2\|DR922280_P1 | 3935 | 189 | 80.6 | globlastp |
| 619 | LGB2 | aristolochia\|10v1\|SRR039082S0203402_P1 | 3936 | 189 | 80.6 | globlastp |
| 620 | LGB2 | cedrus\|11v1\|SRR065007X118000_P1 | 3937 | 189 | 80.6 | globlastp |
| 621 | LGB2 | cirsium\|11v1\|SRR346952.110479_P1 | 3938 | 189 | 80.6 | globlastp |
| 622 | LGB2 | coffea\|10v1\|DV684030_P1 | 3939 | 189 | 80.6 | globlastp |
| 623 | LGB2 | poppy\|11v1\|SRR030259.112973_P1 | 3940 | 189 | 80.6 | globlastp |
| 624 | LGB2 | poppy\|11v1\|SRR096789.116141_P1 | 3941 | 189 | 80.6 | globlastp |
| 625 | LGB2 | pseudotsuga\|10v1\|SRR065119S0031565 | 3942 | 189 | 80.6 | globlastp |
| 626 | LGB2 | rose\|12v1\|BQ105663 | 3943 | 189 | 80.6 | globlastp |
| 627 | LGB2 | strawberry\|11v1\|DY668545 | 3944 | 189 | 80.6 | globlastp |
| 628 | LGB2 | sunflower\|12v1\|BQ967072 | 3945 | 189 | 80.6 | globlastp |
| 629 | LGB2 | valeriana\|11v1\|SRR099039X121531 | 3946 | 189 | 80.6 | globlastp |
| 630 | LGB2 | vinca\|11v1\|SRR098690X103673 | 3947 | 189 | 80.6 | globlastp |
| 631 | LGB2 | chrysanthemum\|14v1\|SRR525216X57552D1_P1 | 3948 | 189 | 80.4 | globlastp |
| 632 | LGB2 | centaurea\|11v1\|EH735837_P1 | 3949 | 189 | 80.4 | globlastp |
| 633 | LGB2 | centaurea\|11v1\|SRR346938.101084_P1 | 3950 | 189 | 80.4 | globlastp |
| 634 | LGB2 | tragopogon\|10v1\|SRR020205S0003822 | 3951 | 189 | 80.39 | glotblastn |
| 635 | LGB2 | thalictrum\|11v1\|SRR096787X143405 | 3952 | 189 | 80.32 | glotblastn |
| 636 | LGB2 | amaranthus\|13v1\|SRR039411X126944D1_P1 | 3953 | 189 | 80.3 | globlastp |
| 637 | LGB2 | arnica\|11v1\|SRR099034X105110_P1 | 3954 | 189 | 80.3 | globlastp |
| 638 | LGB2 | arnica\|11v1\|SRR099034X110708_P1 | 3955 | 189 | 80.3 | globlastp |
| 639 | LGB2 | chickpea\|13v2\|AJ515556_P1 | 3956 | 189 | 80.3 | globlastp |
| 640 | LGB2 | ginseng\|13v1\|GR874665_P1 | 3957 | 189 | 80.3 | globlastp |
| 641 | LGB2 | peanut\|13v1\|CD038149_P1 | 3958 | 189 | 80.3 | globlastp |
| 642 | LGB2 | vinca\|11v1\|SRR098690X121851 | 3959 | 189 | 80.3 | globlastp |
| 643 | LGB2 | centaurea\|11v1\|SRR346938.103317_P1 | 3960 | 189 | 80.1 | globlastp |
| 644 | LGB2 | lupin\|13v4\|SRR520490.22558_P1 | 3961 | 189 | 80.1 | globlastp |
| 645 | LGB2 | chrysanthemum\|14v1\|SRR290491X100872D1_P1 | 3962 | 189 | 80 | globlastp |
| 646 | LGB2 | bupleurum\|11v1\|SRR301254.100686_P1 | 3963 | 189 | 80 | globlastp |
| 647 | LGB2 | cotton\|11v1\|CO112046_P1 | 3964 | 189 | 80 | globlastp |
| 648 | LGB2 | distylium\|11v1\|SRR065077X144417_P1 | 3965 | 189 | 80 | globlastp |
| 649 | LGB4 | echinochloa\|14v1\|SRR522894X158282D1_T1 | 3966 | 190 | 86.27 | glotblastn |
| 650 | LGB4 | sugarcane\|10v1\|CF571414 | 3967 | 190 | 82.9 | globlastp |
| 651 | LGB4 | maize\|13v2\|AW399864_T1 | 3968 | 190 | 80.67 | glotblastn |
| 652 | LGB4 | echinochloa\|14v1\|SRR522894X263108D1_P1 | 3969 | 190 | 80.3 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 653 | LGB4 | sorghum|13v2|CD431363 | 3970 | 190 | 80.3 | globlastp |
| 654 | LGB5 | sorghum|13v2|AW283408 | 3971 | 191 | 84.5 | globlastp |
| 654 | MGP22 | sorghum|13v2|AW283408 | 3971 | 251 | 86.4 | globlastp |
| 655 | LGB5 | switchgrass|12v1|SRR187766.583515 | 3972 | 191 | 82.9 | globlastp |
| 656 | LGB7 | sorghum|13v2|BF655932 | 3973 | 192 | 90.7 | globlastp |
| 657 | LGB7 | maize|13v2|AI621781_P1 | 3974 | 192 | 86.2 | globlastp |
| 658 | LGB7 | foxtail_millet|13v2|SRR350548X124181 | 3975 | 192 | 86 | globlastp |
| 659 | LGB7 | foxtail_millet|14v1|JK567361_P1 | 3976 | 192 | 86 | globlastp |
| 660 | LGB7 | wheat|12v3|CK209067 | 3977 | 192 | 81.9 | globlastp |
| 661 | LGB7 | rye|12v1|DRR001012.103060 | 3978 | 192 | 81.8 | globlastp |
| 662 | LGB7 | brachypodium|13v2|BRADI5G24267 | 3979 | 192 | 80.7 | globlastp |
| 663 | LGB7 | brachypodium|14v1|GT760554_P1 | 3979 | 192 | 80.7 | globlastp |
| 664 | LGB7 | brachypodium|13v2|BRADI3G31487 | 3980 | 192 | 80.5 | globlastp |
| 665 | LGB7 | brachypodium|14v1|GT765915_P1 | 3980 | 192 | 80.5 | globlastp |
| 666 | LGB8 | sorghum|13v2|BE919051 | 3981 | 193 | 88.8 | globlastp |
| 667 | LGB8 | maize|13v2|AW054442_P1 | 3982 | 193 | 83.6 | globlastp |
| 668 | LGB8 | switchgrass|12v1|SRR187766.111287 | 3983 | 193 | 82.9 | globlastp |
| 669 | LGB9 | foxtail_millet|13v2|EC611984 | 3984 | 194 | 93.5 | globlastp |
| 670 | LGB9 | foxtail_millet|14v1|EC611984_P1 | 3984 | 194 | 93.5 | globlastp |
| 671 | LGB9 | sorghum|13v2|AW283387 | 3985 | 194 | 92.9 | globlastp |
| 672 | LGB9 | maize|13v2|AI783379_P1 | 3986 | 194 | 92.7 | globlastp |
| 673 | LGB9 | maize|13v2|AI920551_P1 | 3987 | 194 | 92.5 | globlastp |
| 674 | LGB9 | switchgrass|12v1|DN152496 | 3988 | 194 | 91.4 | globlastp |
| 675 | LGB9 | brachypodium|13v2|BRADI1G46610 | 3989 | 194 | 89.9 | globlastp |
| 676 | LGB9 | brachypodium|14v1|GT803861_P1 | 3989 | 194 | 89.9 | globlastp |
| 677 | LGB9 | rye|12v1|BF429299 | 3990 | 194 | 89.9 | globlastp |
| 678 | LGB9 | oat|14v1|GO593396_P1 | 3991 | 194 | 89.5 | globlastp |
| 679 | LGB9 | oat|14v1|GR355594_P1 | 3991 | 194 | 89.5 | globlastp |
| 680 | LGB9 | millet|10v1|EVO454PM019518_P1 | 3992 | 194 | 89.1 | globlastp |
| 681 | LGB9 | banana|14v1|MAGEN2012028869_P1 | 3993 | 194 | 86.7 | globlastp |
| 682 | LGB9 | banana|12v1|MAGEN2012028869 | 3993 | 194 | 86.7 | globlastp |
| 683 | LGB9 | banana|14v1|ES433243 | 3994 | 194 | 86 | globlastp |
| 684 | LGB9 | amorphophallus|11v2|SRR089351X561588_P1 | 3995 | 194 | 85.9 | globlastp |
| 685 | LGB9 | coconut|14v1|KC140145_P1 | 3996 | 194 | 85.5 | globlastp |
| 686 | LGB9 | coconut|14v1|COCOS14V1K19C1090001_P1 | 3997 | 194 | 85.2 | globlastp |
| 687 | LGB9 | oil_palm|11v1|DW248456_P1 | 3998 | 194 | 85.2 | globlastp |
| 688 | LGB9 | oil_palm|11v1|SRR190698.10356_P1 | 3999 | 194 | 84.8 | globlastp |
| 689 | LGB9 | switchgrass|12v1|FE643490 | 4000 | 194 | 84.71 | glotblastn |
| 690 | LGB9 | banana|12v1|ES433243 | 4001 | 194 | 84.7 | globlastp |
| 691 | LGB9 | rice|13v2|BE040060 | 4002 | 194 | 84.6 | globlastp |
| 692 | LGB9 | onion|14v1|BQ580234_T1 | 4003 | 194 | 84.3 | glotblastn |
| 693 | LGB9 | onion|14v1|CF442013_P1 | 4004 | 194 | 84.3 | globlastp |
| 694 | LGB9 | onion|14v1|CF441228_P1 | 4005 | 194 | 84.1 | globlastp |
| 695 | LGB9 | eucalyptus|11v2|AJ627672_P1 | 4006 | 194 | 84.1 | globlastp |
| 696 | LGB9 | oat|11v1|GO593396 | 4007 | 194 | 83.9 | globlastp |
| 697 | LGB9 | onion|14v1|CF434474_P1 | 4008 | 194 | 83.7 | globlastp |
| 698 | LGB9 | rye|12v1|DRR001012.560312 | 4009 | 194 | 83.3 | globlastp |
| 699 | LGB9 | pineapple|14v1|ACOM14V1K19C1815537_P1 | 4010 | 194 | 82.8 | globlastp |
| 700 | LGB9 | lolium|13v1|GR522531_P1 | 4011 | 194 | 82.6 | globlastp |
| 701 | LGB9 | pigeonpea|11v1|SRR054580X112728_P1 | 4012 | 194 | 82.6 | globlastp |
| 702 | LGB9 | foxtail_millet|13v2|SRR350548X316455 | 4013 | 194 | 82.43 | glotblastn |
| 703 | LGB9 | foxtail_millet|14v1|JK552124_T1 | 4013 | 194 | 82.43 | glotblastn |
| 704 | LGB9 | aristolochia|10v1|FD748373_P1 | 4014 | 194 | 82.4 | globlastp |
| 705 | LGB9 | barley|12v1|BG344276_P1 | 4015 | 194 | 82.4 | globlastp |
| 706 | LGB9 | grape|13v1|GSVIVT01021425001_P1 | 4016 | 194 | 82.3 | globlastp |
| 707 | LGB9 | triphysaria|13v1|DR169504 | 4017 | 194 | 82.15 | glotblastn |
| 708 | LGB9 | soybean|13v2|GLYMA05G25970 | 4018 | 194 | 82 | globlastp |
| 709 | LGB9 | wheat|12v3|CA745967 | 4019 | 194 | 82 | globlastp |
| 710 | LGB9 | cowpea|12v1|FC458818_P1 | 4020 | 194 | 81.9 | globlastp |
| 711 | LGB9 | watermelon|11v1|AM726352 | 4021 | 194 | 81.76 | glotblastn |
| 712 | LGB9 | carrot|14v1|BSS10K19C106946_T1 | 4022 | 194 | 81.72 | glotblastn |
| 713 | LGB9 | cucumber|09v1|DN596201_T1 | 4023 | 194 | 81.72 | glotblastn |
| 714 | LGB9 | bean|13v1|CA900184_P1 | 4024 | 194 | 81.7 | globlastp |
| 715 | LGB9 | jatropha|09v1|DQ987699_P1 | 4025 | 194 | 81.7 | globlastp |
| 716 | LGB9 | poplar|13v1|BI130625_P1 | 4026 | 194 | 81.7 | globlastp |
| 717 | LGB9 | soybean|13v2|GLYMA08G08910 | 4027 | 194 | 81.7 | globlastp |
| 718 | LGB9 | lotus|09v1|BW597832_P1 | 4028 | 194 | 81.6 | globlastp |
| 719 | LGB9 | nicotiana_benthamiana|12v1|FG189814_P1 | 4029 | 194 | 81.6 | globlastp |
| 720 | LGB9 | peanut|13v1|ES721205_P1 | 4030 | 194 | 81.6 | globlastp |
| 721 | LGB9 | nicotiana_benthamiana|12v1|AJ718354_P1 | 4031 | 194 | 81.5 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 722 | LGB9 | phyla\|11v2\|SRR099035X132186_T1 | 4032 | 194 | 81.47 | glotblastn |
| 723 | LGB9 | chickpea\|13v2\|FE669898_P1 | 4033 | 194 | 81.4 | globlastp |
| 724 | LGB9 | cleome_spinosa\|10v1\|GR934069_P1 | 4034 | 194 | 81.3 | globlastp |
| 725 | LGB9 | clover\|14v1\|BB927530_T1 | 4035 | 194 | 81.22 | glotblastn |
| 726 | LGB9 | clover\|14v1\|FY460795_P1 | 4036 | 194 | 81.2 | globlastp |
| 727 | LGB9 | brachypodium\|13v2\|BRADI5G11060 | 4037 | 194 | 81.2 | globlastp |
| 728 | LGB9 | brachypodium\|14v1\|GT790718_P1 | 4037 | 194 | 81.2 | globlastp |
| 729 | LGB9 | euonymus\|11v1\|SRR070038X102874_P1 | 4038 | 194 | 81.2 | globlastp |
| 730 | LGB9 | ginseng\|13v1\|HS079737_P1 | 4039 | 194 | 81.2 | globlastp |
| 731 | LGB9 | medicago\|13v1\|AL378304_P1 | 4040 | 194 | 81.2 | globlastp |
| 732 | LGB9 | sunflower\|12v1\|CD852009 | 4041 | 194 | 81.2 | globlastp |
| 733 | LGB9 | tripterygium\|11v1\|SRR098677X104124 | 4042 | 194 | 81.2 | globlastp |
| 734 | LGB9 | oil_palm\|11v1\|SRR190698.106222_T1 | 4043 | 194 | 81.18 | glotblastn |
| 735 | LGB9 | amaranthus\|13v1\|SRR039408X4252D1_P1 | 4044 | 194 | 81.1 | globlastp |
| 736 | LGB9 | echinacea\|13v1\|EPURP13V11796538_P1 | 4045 | 194 | 81.1 | globlastp |
| 737 | LGB9 | tobacco\|gb162\|AJ718354 | 4046 | 194 | 81.1 | globlastp |
| 738 | LGB9 | platanus\|11v1\|SRR096786X139376_T1 | 4047 | 194 | 81.08 | glotblastn |
| 739 | LGB9 | ginseng\|13v1\|SRR547984.106786_P1 | 4048 | 194 | 81 | globlastp |
| 740 | LGB9 | ginseng\|13v1\|SRR547985.217352_P1 | 4049 | 194 | 81 | globlastp |
| 741 | LGB9 | cotton\|11v1\|BF277590XX2_P1 | 4050 | 194 | 80.9 | globlastp |
| 742 | LGB9 | echinacea\|13v1\|EPURP13V11309529_P1 | 4051 | 194 | 80.9 | globlastp |
| 743 | LGB9 | lupin\|13v4\|SRR520491.1001124_P1 | 4052 | 194 | 80.9 | globlastp |
| 744 | LGB9 | zostera\|12v1\|AM767290 | 4053 | 194 | 80.9 | globlastp |
| 745 | LGB9 | poppy\|11v1\|FG608024_T1 | 4054 | 194 | 80.86 | glotblastn |
| 746 | LGB9 | poppy\|11v1\|SRR030260.21554_T1 | 4055 | 194 | 80.86 | glotblastn |
| 747 | LGB9 | ambrosia\|11v1\|SRR346935.126641_P1 | 4056 | 194 | 80.8 | globlastp |
| 748 | LGB9 | flaveria\|11v1\|SRR149232.216495_P1 | 4057 | 194 | 80.8 | globlastp |
| 749 | LGB9 | ginseng\|13v1\|SRR547985.409495_P1 | 4058 | 194 | 80.8 | globlastp |
| 750 | LGB9 | valeriana\|11v1\|SRR099039X113265 | 4059 | 194 | 80.77 | glotblastn |
| 751 | LGB9 | trigonella\|11v1\|SRR066194X496040 | 4060 | 194 | 80.76 | glotblastn |
| 752 | LGB9 | olea\|13v1\|SRR014463X11417D1_T1 | 4061 | 194 | 80.73 | glotblastn |
| 753 | LGB9 | cotton\|11v1\|AI726385_P1 | 4062 | 194 | 80.7 | globlastp |
| 754 | LGB9 | triphysaria\|13v1\|CB815353 | 4063 | 194 | 80.7 | globlastp |
| 755 | LGB9 | cotton\|11v1\|AI730805_P1 | 4064 | 194 | 80.6 | globlastp |
| 756 | LGB9 | prunus\|10v1\|BU041212 | 4065 | 194 | 80.6 | globlastp |
| 757 | LGB9 | solanum_phureja\|09v1\|SPHAI491045 | 4066 | 194 | 80.6 | globlastp |
| 758 | LGB9 | chrysanthemum\|14v1\|CCOR13V1K19C1351082_T1 | 4067 | 194 | 80.51 | glotblastn |
| 759 | LGB9 | chestnut\|gb170\|SRR006295S0014978 | 4068 | 194 | 80.51 | glotblastn |
| 760 | LGB9 | castorbean\|14v2\|T14995_P1 | 4069 | 194 | 80.5 | globlastp |
| 761 | LGB9 | castorbean\|12v1\|T14995 | 4069 | 194 | 80.5 | globlastp |
| 762 | LGB9 | flaveria\|11v1\|SRR149229.14736_P1 | 4070 | 194 | 80.5 | globlastp |
| 763 | LGB9 | gossypium_raimondii\|13v1\|AI726385_P1 | 4071 | 194 | 80.5 | globlastp |
| 764 | LGB9 | spurge\|gb161\|BG409423 | 4072 | 194 | 80.5 | globlastp |
| 765 | LGB9 | pine\|10v2\|AW064728_T1 | 4073 | 194 | 80.43 | glotblastn |
| 766 | LGB9 | cassava\|09v1\|DB927366_P1 | 4074 | 194 | 80.4 | globlastp |
| 767 | LGB9 | orange\|11v1\|CB290363_P1 | 4075 | 194 | 80.4 | globlastp |
| 768 | LGB9 | sunflower\|12v1\|DY910493 | 4076 | 194 | 80.4 | globlastp |
| 769 | LGB9 | triphysaria\|13v1\|SRR023500X103485 | 4077 | 194 | 80.4 | globlastp |
| 770 | LGB9 | beech\|11v1\|SRR006293.20370_T1 | 4078 | 194 | 80.38 | glotblastn |
| 771 | LGB9 | catharanthus\|11v1\|SRR098691X109498_T1 | 4079 | 194 | 80.38 | glotblastn |
| 772 | LGB9 | cichorium\|gb171\|EH680465 | 4080 | 194 | 80.38 | glotblastn |
| 773 | LGB9 | chrysanthemum\|14v1\|SRR290491X242408D1_T1 | 4081 | 194 | 80.34 | glotblastn |
| 774 | LGB9 | cichorium\|14v1\|DT213723_P1 | 4082 | 194 | 80.3 | globlastp |
| 775 | LGB9 | artemisia\|10v1\|EY032970_P1 | 4083 | 194 | 80.3 | globlastp |
| 776 | LGB9 | canola\|11v1\|ES954643_P1 | 4084 | 194 | 80.3 | globlastp |
| 777 | LGB9 | cotton\|11v1\|CO094295_P1 | 4085 | 194 | 80.3 | globlastp |
| 778 | LGB9 | gossypium_raimondii\|13v1\|AI730805_P1 | 4086 | 194 | 80.3 | globlastp |
| 779 | LGB9 | monkeyflower\|12v1\|DV207158_P1 | 4087 | 194 | 80.3 | globlastp |
| 780 | LGB9 | solanum_phureja\|09v1\|SPHBG123801 | 4088 | 194 | 80.3 | globlastp |
| 781 | LGB9 | echinacea\|13v1\|EPURP13V11375119_T1 | 4089 | 194 | 80.22 | glotblastn |
| 782 | LGB9 | clementine\|11v1\|CB290363_P1 | 4090 | 194 | 80.2 | globlastp |
| 783 | LGB9 | medicago\|13v1\|AW689388_P1 | 4091 | 194 | 80.2 | globlastp |
| 784 | LGB9 | orobanche\|10v1\|SRR023189S0013409_P1 | 4092 | 194 | 80.2 | globlastp |
| 785 | LGB9 | poplar\|13v1\|BI131706_P1 | 4093 | 194 | 80.2 | globlastp |
| 786 | LGB9 | prunus_mume\|13v1\|BU041212 | 4094 | 194 | 80.2 | globlastp |
| 787 | LGB9 | phalaenopsis\|11v1\|SRR125771.1002713_T1 | 4095 | 194 | 80.13 | glotblastn |
| 788 | LGB9 | clover\|14v1\|ERR351507S19XK19C306954_P1 | 4096 | 194 | 80.1 | globlastp |
| 789 | LGB9 | ambrosia\|11v1\|SRR346943.115045_T1 | 4097 | 194 | 80.08 | glotblastn |
| 790 | LGB9 | flaveria\|11v1\|SRR149229.445535_T1 | 4098 | 194 | 80.04 | glotblastn |
| 791 | LGB9 | amaranthus\|13v1\|SRR039411X113602D1_T1 | 4099 | 194 | 80 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 792 | LGB9 | chestnut\|14v1\|SRR006295X111923D1_P1 | 4100 | 194 | 80 | globlastp |
| 793 | LGB9 | cichorium\|14v1\|EH680465_P1 | 4101 | 194 | 80 | globlastp |
| 794 | LGB9 | parsley\|14v1\|BSS12K19C1021428_P1 | 4102 | 194 | 80 | globlastp |
| 795 | LGB9 | parsley\|14v1\|BSS12K19C1056326_P1 | 4103 | 194 | 80 | globlastp |
| 796 | LGB9 | parsley\|14v1\|BSS12K19C127022_P1 | 4103 | 194 | 80 | globlastp |
| 797 | LGB9 | parsley\|14v1\|BSS13K19C372554_P1 | 4102 | 194 | 80 | globlastp |
| 798 | LGB9 | cannabis\|12v1\|GR221287_P1 | 4104 | 194 | 80 | globlastp |
| 799 | LGB9 | cirsium\|11v1\|SRR346952.150049_P1 | 4105 | 194 | 80 | globlastp |
| 800 | LGB9 | eschscholzia\|11v1\|SRR014116.104441_T1 | 4106 | 194 | 80 | glotblastn |
| 801 | LGB9 | euphorbia\|11v1\|DV155575_P1 | 4107 | 194 | 80 | globlastp |
| 802 | LGB9 | melon\|10v1\|AM726352_P1 | 4108 | 194 | 80 | globlastp |
| 803 | LGB9 | strawberry\|11v1\|EX660547 | 4109 | 194 | 80 | globlastp |
| 804 | LGB9 | thellungiella_parvulum\|13v1\|BY819573 | 4110 | 194 | 80 | globlastp |
| 805 | LGB9 | tomato\|13v1\|AI491045 | 4111 | 194 | 80 | globlastp |
| 806 | LGB10 | brachypodium\|13v2\|BRADI3G54890 | 4112 | 195 | 81.9 | globlastp |
| 807 | LGB10 | brachypodium\|14v1\|XM_003570290_P1 | 4112 | 195 | 81.9 | globlastp |
| 808 | LGB10 | foxtail_millet\|13v2\|SRR350548X135383 | 4113 | 195 | 81.5 | globlastp |
| 809 | LGB10 | foxtail_millet\|14v1\|XM_004954258_P1 | 4113 | 195 | 81.5 | globlastp |
| 810 | LGB10 | switchgrass\|12v1\|FL689468 | 4114 | 195 | 80.4 | globlastp |
| 811 | LGB10 | switchgrass\|12v1\|FL697680 | 4115 | 195 | 80.2 | globlastp |
| 812 | LGB11 | rice\|13v2\|GFXAC082645X5 | 4116 | 196 | 97.6 | globlastp |
| 813 | LGB11 | rice\|13v2\|AU031660 | 4117 | 196 | 97.1 | globlastp |
| 814 | LGB11 | rye\|12v1\|DRR001012.108079 | 4118 | 196 | 94.4 | globlastp |
| 815 | LGB11 | sorghum\|13v2\|AW285122 | 4119 | 196 | 93.9 | globlastp |
| 816 | LGB11 | oat\|14v1\|GO588509_P1 | 4120 | 196 | 93.8 | globlastp |
| 817 | LGB11 | foxtail_millet\|13v2\|SRR350548X104286 | 4121 | 196 | 93.7 | globlastp |
| 818 | LGB11 | foxtail_millet\|14v1\|JK588794_P1 | 4121 | 196 | 93.7 | globlastp |
| 819 | LGB11 | millet\|10v1\|EVO454PM003323_P1 | 4122 | 196 | 93.4 | globlastp |
| 820 | LGB11 | maize\|13v2\|AI920735_P1 | 4123 | 196 | 93.1 | globlastp |
| 821 | LGB11 | maize\|13v2\|AI621993_P1 | 4124 | 196 | 92.9 | globlastp |
| 822 | LGB11 | sorghum\|13v2\|AW282672 | 4125 | 196 | 92.6 | globlastp |
| 823 | LGB11 | maize\|13v2\|AW181142_P1 | 4126 | 196 | 91 | globlastp |
| 824 | LGB11 | barley\|12v1\|AV835355_P1 | 4127 | 196 | 90.8 | globlastp |
| 825 | LGB11 | oat\|14v1\|GO589703_P1 | 4128 | 196 | 90.4 | globlastp |
| 826 | LGB11 | brachypodium\|13v2\|BRADI1G78470 | 4129 | 196 | 89.9 | globlastp |
| 827 | LGB11 | brachypodium\|14v1\|DV470451_P1 | 4129 | 196 | 89.9 | globlastp |
| 828 | LGB11 | barley\|12v1\|AW982621_P1 | 4130 | 196 | 89.7 | globlastp |
| 829 | LGB11 | rye\|12v1\|DRR001012.206919 | 4131 | 196 | 89.7 | globlastp |
| 830 | LGB11 | wheat\|12v3\|BE414869 | 4132 | 196 | 89.6 | globlastp |
| 831 | LGB11 | oat\|14v1\|SRR020741X122227D1_P1 | 4133 | 196 | 89.5 | globlastp |
| 832 | LGB11 | oat\|14v1\|SRRG20741X277106D1_P1 | 4134 | 196 | 89.5 | globlastp |
| 833 | LGB11 | rye\|12v1\|DRR001012.10347 | 4135 | 196 | 89.5 | glotblastn |
| 834 | LGB11 | rye\|12v1\|DRR001012.113807 | 4136 | 196 | 89.42 | glotblastn |
| 835 | LGB11 | oat\|14v1\|SRR020741X146372D1_P1 | 4137 | 196 | 89.4 | globlastp |
| 836 | LGB11 | oat\|14v1\|SRR020741X265793D1_P1 | 4137 | 196 | 89.4 | globlastp |
| 837 | LGB11 | brachypodium\|13v2\|BRADI2G55640 | 4138 | 196 | 89.3 | globlastp |
| 838 | LGB11 | brachypodium\|14v1\|GT797955_P1 | 4138 | 196 | 89.3 | globlastp |
| 839 | LGB11 | foxtail_millet\|13v2\|SRR350548X103429 | 4139 | 196 | 89 | globlastp |
| 840 | LGB11 | foxtail_millet\|14v1\|JK589021_P1 | 4139 | 196 | 89 | globlastp |
| 841 | LGB11 | rye\|12v1\|DRR001012.194472 | 4140 | 196 | 87.4 | globlastp |
| 842 | LGB11 | oat\|14v1\|SRR020741X101742D1_P1 | 4141 | 196 | 87.3 | globlastp |
| 843 | LGB11 | wheat\|12v3\|CA499195 | 4142 | 196 | 87.3 | globlastp |
| 844 | LGB11 | rye\|12v1\|DRR001012.118220 | 4143 | 196 | 86.2 | globlastp |
| 845 | LGB11 | oil_palm\|11v1\|ES370575_P1 | 4144 | 196 | 84.5 | globlastp |
| 846 | LGB11 | pineapple\|14v1\|ACOM14V1K19C2376526_P1 | 4145 | 196 | 83.8 | globlastp |
| 847 | LGB11 | pineapple\|14v1\|ACOM14V1K19C1057750_P1 | 4146 | 196 | 83.7 | globlastp |
| 848 | LGB11 | banana\|12v1\|MAGEN2012007197 | 4147 | 196 | 83.4 | globlastp |
| 849 | LGB11 | coconut\|14v1\|COCOS14V1K19C173735_P1 | 4148 | 196 | 83.3 | globlastp |
| 850 | LGB11 | oil_palm\|11v1\|EY408029_P1 | 4149 | 196 | 83.3 | globlastp |
| 851 | LGB11 | coconut\|14v1\|COCOS14V1K19C1059752_T1 | 4150 | 196 | 82.76 | glotblastn |
| 852 | LGB11 | oil_palm\|11v1\|SRR190698.11738_P1 | 4151 | 196 | 82.7 | globlastp |
| 853 | LGB11 | coconut\|14v1\|COCOS14V1K19C1162589_T1 | 4150 | 196 | 82.68 | glotblastn |
| 854 | LGB11 | banana\|14v1\|MAGEN2012015554_P1 | 4152 | 196 | 82.6 | globlastp |
| 855 | LGB11 | banana\|12v1\|MAGEN2012015554 | 4153 | 196 | 82.5 | globlastp |
| 856 | LGB11 | amorphophallus\|11v2\|SRR089351X207130_P1 | 4154 | 196 | 82.3 | globlastp |
| 857 | LGB11 | wheat\|12v3\|BG262442 | 4155 | 196 | 82 | globlastp |
| 858 | LGB11 | banana\|14v1\|ES431444_P1 | 4156 | 196 | 81.9 | globlastp |
| 859 | LGB11 | banana\|14v1\|MAGEN2012024231_P1 | 4157 | 196 | 81.9 | globlastp |
| 860 | LGB11 | orange\|11v1\|CK937614_P1 | 4158 | 196 | 81.7 | globlastp |
| 861 | LGB11 | banana\|12v1\|ES431444 | 4159 | 196 | 81.7 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 862 | LGB11 | clementine|11v1|CK937614_P1 | 4160 | 196 | 81.7 | globlastp |
| 863 | LGB11 | banana|12v1|MAGEN2012024231 | 4161 | 196 | 81.5 | globlastp |
| 864 | LGB11 | chestnut|14v1|SRR006295X118642D1_P1 | 4162 | 196 | 81.2 | globlastp |
| 865 | LGB11 | onion|14v1|CF440084_P1 | 4163 | 196 | 81.1 | globlastp |
| 866 | LGB11 | amborella|12v3|FD435628_P1 | 4164 | 196 | 81 | globlastp |
| 867 | LGB11 | eucalyptus|11v2|CD668418_P1 | 4165 | 196 | 81 | globlastp |
| 868 | LGB11 | poplar|13v1|BI068807_P1 | 4166 | 196 | 81 | globlastp |
| 869 | LGB11 | poplar|13v1|CA825118_P1 | 4167 | 196 | 80.9 | globlastp |
| 870 | LGB11 | prunus|10v1|CN861660 | 4168 | 196 | 80.8 | globlastp |
| 871 | LGB11 | castorbean|14v2|EG660426_P1 | 4169 | 196 | 80.6 | globlastp |
| 872 | LGB11 | chelidonium|11v1|SRR084752X101015_P1 | 4170 | 196 | 80.6 | globlastp |
| 873 | LGB11 | castorbean|12v1|EG660426 | 4169 | 196 | 80.6 | globlastp |
| 874 | LGB11 | grape|13v1|GSVIVT01009813001_P1 | 4171 | 196 | 80.5 | globlastp |
| 875 | LGB11 | cassava|09v1|CK645826_P1 | 4172 | 196 | 80.4 | globlastp |
| 876 | LGB11 | aristolochia|10v1|FD757029_P1 | 4173 | 196 | 80.3 | globlastp |
| 877 | LGB11 | gossypium_raimondii|13v1|AI725568_P1 | 4174 | 196 | 80.3 | globlastp |
| 878 | LGB11 | cotton|11v1|AI728344_P1 | 4175 | 196 | 80.2 | globlastp |
| 879 | LGB11 | gossypium_raimondii|13v1|AI728344_P1 | 4176 | 196 | 80.2 | globlastp |
| 880 | LGB11 | gossypium_raimondii|13v1|AI726992_P1 | 4177 | 196 | 80.1 | globlastp |
| 881 | LGB11 | euphorbia|11v1|DV125161_P1 | 4178 | 196 | 80.1 | globlastp |
| 882 | LGB11 | cacao|13v1|CU477558_P1 | 4179 | 196 | 80 | globlastp |
| 883 | LGB11 | ginseng|13v1|SRR547977.582933_T1 | 4180 | 196 | 80 | glotblastn |
| 884 | LGB11 | cotton|11v1|AI725568_P1 | 4181 | 196 | 80 | globlastp |
| 885 | LGB14 | maize|13v2|T12533_P1 | 4182 | 197 | 95 | globlastp |
| 886 | LGB14 | switchgrass|12v1|DN144186 | 4183 | 197 | 94.1 | globlastp |
| 887 | LGB14 | switchgrass|12v1|FE646331 | 4184 | 197 | 93.8 | globlastp |
| 888 | LGB14 | foxtail_millet|13v2|SRR350548X103342 | 4185 | 197 | 92.3 | globlastp |
| 889 | LGB14 | foxtail_millet|14v1|JK552250_P1 | 4185 | 197 | 92.3 | globlastp |
| 890 | LGB14 | rice|13v2|AI978328 | 4186 | 197 | 87.4 | globlastp |
| 891 | LGB14 | rice|13v2|BI807149 | 4187 | 197 | 87.1 | globlastp |
| 892 | LGB14 | rye|12v1|DRR001012.181565 | 4188 | 197 | 86.3 | globlastp |
| 893 | LGB14 | oat|11v1|GR313122XX2 | 4189 | 197 | 86.1 | globlastp |
| 894 | LGB14 | wheat|12v3|BQ170811 | 4190 | 197 | 85.9 | globlastp |
| 895 | LGB14 | brachypodium|13v2|BRADI1G30730 | 4191 | 197 | 85.6 | globlastp |
| 896 | LGB14 | brachypodium|14v1|DV478682_P1 | 4191 | 197 | 85.6 | globlastp |
| 897 | LGB14 | wheat|12v3|BE606581 | 4192 | 197 | 84.88 | globlastp |
| 898 | LGB14 | rye|12v1|DRR001012.537387 | 4193 | 197 | 82.41 | glotblastn |
| 899 | LGB14 | foxtail_millet|13v2|SRR350548X117115 | 4194 | 197 | 82.4 | globlastp |
| 900 | LGB14 | foxtail_millet|14v1|JK556754_P1 | 4194 | 197 | 82.4 | globlastp |
| 901 | LGB14 | maize|13v2|BG836547_P1 | 4195 | 197 | 82.4 | globlastp |
| 902 | LGB14 | rye|12v1|DRR001012.110057 | 4196 | 197 | 82.19 | glotblastn |
| 903 | LGB14 | brachypodium|13v2|BRADI3G06170T2 | 4197 | 197 | 82 | globlastp |
| 904 | LGB14 | brachypodium|14v1|DV487859_P1 | 4197 | 197 | 82 | globlastp |
| 905 | LGB14 | pseudoroegneria|gb167|FF341321 | 4198 | 197 | 81.9 | globlastp |
| 906 | LGB14 | switchgrass|12v1|FL741463 | 4199 | 197 | 81.8 | globlastp |
| 907 | LGB14 | barley|12v1|Y13191_P1 | 4200 | 197 | 81.7 | globlastp |
| 908 | LGB14 | sugarcane|10v1|CA138251 | 4201 | 197 | 81.2 | globlastp |
| 909 | LGB14 | sorghum|13v2|CD235161 | 4202 | 197 | 80.9 | globlastp |
| 910 | LGB14 | switchgrass|12v1|FL720181 | 4203 | 197 | 80.9 | globlastp |
| 911 | LGB14 | leymus|gb166|CD808797_P1 | 4204 | 197 | 80.7 | globlastp |
| 912 | LGB14 | maize|13v2|AW787558_P1 | 4205 | 197 | 80.5 | globlastp |
| 913 | LGB15 | switchgrass|12v1|FL787212 | 4206 | 198 | 90.7 | globlastp |
| 914 | LGB15 | maize|13v2|BM348982_P1 | 4207 | 198 | 90 | globlastp |
| 915 | LGB15 | maize|13v2|DR812863_P1 | 4208 | 198 | 89.1 | globlastp |
| 916 | LGB15 | foxtail_millet|13v2|SRR350548X119181 | 4209 | 198 | 88.4 | globlastp |
| 917 | LGB15 | foxtail_millet|14v1|XM_004981350_P1 | 4209 | 198 | 88.4 | globlastp |
| 918 | LGB15 | sorghum|13v2|SB13V2CRP000542 | 4210 | 198 | 82.04 | glotblastn |
| 919 | LGB15 | rice|13v2|BI813156 | 4211 | 198 | 80.9 | globlastp |
| 920 | LGB16 | sugarcane|10v1|CA143410 | 4212 | 199 | 87.2 | globlastp |
| 921 | LGB16 | maize|13v2|AW424866_P1 | 4213 | 199 | 86.2 | globlastp |
| 922 | LGB16 | switchgrass|12v1|DN144149 | 4214 | 199 | 86.2 | globlastp |
| 923 | LGB16 | foxtail_millet|14v1|GT091079_P1 | 4215 | 199 | 85.3 | globlastp |
| 924 | LGB16 | foxtail_millet|13v2|GT091079 | 4215 | 199 | 85.3 | globlastp |
| 925 | LGB16 | millet|10v1|CD725513_P1 | 4216 | 199 | 85.3 | globlastp |
| 926 | LGB16 | echinochloa|14v1|SRR522894X129750D1_P1 | 4217 | 199 | 84.4 | globlastp |
| 927 | LGB16 | cynodon|10v1|ES304257_P1 | 4218 | 199 | 83.5 | globlastp |
| 928 | LGB16 | echinochloa|14v1|SRR522894X52150D1_P1 | 4219 | 199 | 82.6 | globlastp |
| 929 | LGB16 | rice|13v2|BM420124 | 4220 | 199 | 82.6 | globlastp |
| 930 | LGB16 | rye|12v1|DRR001014.139350 | 4221 | 199 | 81.65 | glotblastn |
| 931 | LGB18 | wheat|12v3|BE402745 | 4222 | 200 | 99.23 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 932 | LGB18 | rye\|12v1\|DRR001012.274755 | 4223 | 200 | 97.94 | glotblastn |
| 933 | LGB18 | rye\|12v1\|BE587450 | 4224 | 200 | 96.91 | glotblastn |
| 934 | LGB18 | rye\|12v1\|DRR001012.171784 | 4225 | 200 | 96.91 | glotblastn |
| 935 | LGB18 | lolium\|13v1\|SRR029314X10932__T1 | 4226 | 200 | 96.65 | glotblastn |
| 936 | LGB18 | oat\|14v1\|SRR020741X217379D1__T1 | 4227 | 200 | 96.39 | glotblastn |
| 937 | LGB18 | lolium\|13v1\|AU249702__T1 | 4228 | 200 | 96.39 | glotblastn |
| 938 | LGB18 | oat\|14v1\|G0589750__T1 | 4229 | 200 | 96.13 | glotblastn |
| 939 | LGB18 | brachypodium\|13v2\|BRADI2G03740 | 4230 | 200 | 95.36 | glotblastn |
| 940 | LGB18 | brachypodium\|14v1\|DV469839__T1 | 4230 | 200 | 95.36 | glotblastn |
| 941 | LGB18 | switchgrass\|12v1\|FL784116 | 4231 | 200 | 93.56 | glotblastn |
| 942 | LGB18 | rice\|13v2\|BI806200 | 4232 | 200 | 93.04 | glotblastn |
| 943 | LGB18 | leymus\|gb166\|EG391678__P1 | 4233 | 200 | 92.9 | globlastp |
| 944 | LGB18 | foxtail_millet\|13v2\|EC612616 | 4234 | 200 | 92.78 | glotblastn |
| 945 | LGB18 | foxtail_millet\|14v1\|EC612616__T1 | 4234 | 200 | 92.78 | glotblastn |
| 946 | LGB18 | switchgrass\|12v1\|FE633182 | 4235 | 200 | 92.78 | glotblastn |
| 947 | LGB18 | echinochloa\|14v1\|SRR522894X138229D1__T1 | 4236 | 200 | 92.53 | glotblastn |
| 948 | LGB18 | echinochloa\|14v1\|SRR522894X143988D1__T1 | 4237 | 200 | 92.53 | glotblastn |
| 949 | LGB18 | millet\|10v1\|EVO454PM003485__T1 | 4238 | 200 | 92.27 | glotblastn |
| 950 | LGB18 | wheat\|12v3\|BQ170768 | 4239 | 200 | 92.2 | globlastp |
| 951 | LGB18 | maize\|13v2\|AI855283__T1 | 4240 | 200 | 92.01 | glotblastn |
| 952 | LGB18 | sugarcane\|10v1\|BQ533868 | 4241 | 200 | 92.01 | glotblastn |
| 953 | LGB18 | sorghum\|13v2\|BE361478 | 4242 | 200 | 91.24 | glotblastn |
| 954 | LGB18 | fescue\|13v1\|CK802529__P1 | 4243 | 200 | 87.8 | globlastp |
| 955 | LGB18 | oat\|11v1\|GO589750 | 4244 | 200 | 85.57 | glotblastn |
| 956 | LGB18 | oil_palm\|11v1\|ES273673XX1__T1 | 4245 | 200 | 85.57 | glotblastn |
| 957 | LGB18 | pineapple\|14v1\|ACOM14V1K19C1112775__T1 | 4246 | 200 | 84.79 | glotblastn |
| 958 | LGB18 | wheat\|12v3\|BF484678 | 4247 | 200 | 84.2 | globlastp |
| 959 | LGB18 | poppy\|11v1\|SRR096789.121829__T1 | 4248 | 200 | 84.02 | glotblastn |
| 960 | LGB18 | phalaenopsis\|11v1\|CB034621__T1 | 4249 | 200 | 83.76 | glotblastn |
| 961 | LGB18 | poppy\|11v1\|SRR030259.113972__T1 | 4250 | 200 | 83.76 | glotblastn |
| 962 | LGB18 | banana\|14v1\|BBS3059T3__T1 | 4251 | 200 | 83.51 | glotblastn |
| 963 | LGB18 | poppy\|11v1\|SRR030259.115042__T1 | 4252 | 200 | 83.51 | glotblastn |
| 964 | LGB18 | rye\|12v1\|DRR001012.130219 | 4253 | 200 | 83.3 | globlastp |
| 965 | LGB18 | eucalyptus\|11v2\|SRR001659X120087__T1 | 4254 | 200 | 83.25 | glotblastn |
| 966 | LGB18 | banana\|12v1\|MAGEN2012013739 | 4255 | 200 | 82.99 | glotblastn |
| 967 | LGB18 | amorphophallus\|11v2\|SRR089351X236705__T1 | 4256 | 200 | 82.47 | glotblastn |
| 968 | LGB18 | lupin\|13v4\|FG091658__T1 | 4257 | 200 | 82.47 | glotblastn |
| 969 | LGB18 | nasturtium\|11v1\|GH166241__T1 | 4258 | 200 | 82.47 | glotblastn |
| 970 | LGB18 | poppy\|11v1\|SRR030261.41175__T1 | 4259 | 200 | 82.47 | glotblastn |
| 971 | LGB18 | sesame\|12v1\|SESI12V1328242 | 4260 | 200 | 82.47 | glotblastn |
| 972 | LGB18 | rye\|12v1\|DRR001012.105889 | 4261 | 200 | 82.3 | globlastp |
| 973 | LGB18 | parsley\|14v1\|BSS12K19C1015325__T1 | 4262 | 200 | 82.22 | glotblastn |
| 974 | LGB18 | grape\|13v1\|GSVIVT01010526001__T1 | 4263 | 200 | 82.22 | glotblastn |
| 975 | LGB18 | beech\|11v1\|SRR364434.185866__P1 | 4264 | 200 | 82.2 | globlastp |
| 976 | LGB18 | castorbean\|12v1\|EE255101 | 4265 | 200 | 81.44 | glotblastn |
| 977 | LGB18 | euphorbia\|11v1\|DV125982__T1 | 4266 | 200 | 81.44 | glotblastn |
| 978 | LGB18 | triphysaria\|13v1\|DR176160 | 4267 | 200 | 81.44 | glotblastn |
| 979 | LGB18 | cassava\|09v1\|DB934222__T1 | 4268 | 200 | 81.19 | glotblastn |
| 980 | LGB18 | chestnut\|gb170\|SRR006295S0003784 | 4269 | 200 | 81.19 | glotblastn |
| 981 | LGB18 | gossypium_raimondii\|13v1\|DT468407__T1 | 4270 | 200 | 81.19 | glotblastn |
| 982 | LGB18 | oak\|10v1\|FP071071__T1 | 4271 | 200 | 81.19 | glotblastn |
| 983 | LGB18 | olea\|13v1\|SRR014463X15015D1__T1 | 4272 | 200 | 81.19 | glotblastn |
| 984 | LGB18 | aquilegia\|10v2\|DT735193__T1 | 4273 | 200 | 80.93 | glotblastn |
| 985 | LGB18 | cotton\|11v1\|CO106473__T1 | 4274 | 200 | 80.93 | glotblastn |
| 986 | LGB18 | nicotiana_benthamiana\|12v1\|BP746220__T1 | 4275 | 200 | 80.93 | glotblastn |
| 987 | LGB18 | pigeonpea\|11v1\|SRR054580X138773__T1 | 4276 | 200 | 80.93 | glotblastn |
| 988 | LGB18 | apple\|11v1\|CN895518__T1 | 4277 | 200 | 80.67 | glotblastn |
| 989 | LGB18 | chickpea\|13v2\|GR916603__T1 | 4278 | 200 | 80.67 | glotblastn |
| 990 | LGB18 | prunus_mume\|13v1\|DY636641 | 4279 | 200 | 80.67 | glotblastn |
| 991 | LGB18 | solanum_phureja\|09v1\|SPHBG126515 | 4280 | 200 | 80.67 | glotblastn |
| 992 | LGB18 | soybean\|13v2\|GLYMA02G10750 | 4281 | 200 | 80.67 | glotblastn |
| 993 | LGB18 | soybean\|13v2\|GLYMA18G52070 | 4282 | 200 | 80.67 | glotblastn |
| 994 | LGB18 | valeriana\|11v1\|SRR099039X100809 | 4283 | 200 | 80.51 | glotblastn |
| 995 | LGB18 | clover\|14v1\|ERR351507S19XK19C714775__T1 | 4284 | 200 | 80.41 | glotblastn |
| 996 | LGB18 | ginseng\|13v1\|SRR547977.249688__T1 | 4285 | 200 | 80.41 | glotblastn |
| 997 | LGB18 | monkeyflower\|12v1\|GR160342__T1 | 4286 | 200 | 80.41 | glotblastn |
| 998 | LGB18 | strawberry\|11v1\|DY667480 | 4287 | 200 | 80.41 | glotblastn |
| 999 | LGB18 | cichorium\|14v1\|DT211761__T1 | 4288 | 200 | 80.15 | glotblastn |
| 1000 | LGB18 | cichorium\|14v1\|EH699349__T1 | 4289 | 200 | 80.15 | glotblastn |
| 1001 | LGB18 | ginseng\|13v1\|HS077713__T1 | 4290 | 200 | 80.15 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1002 | LGB18 | lettuce\|12v1\|DW084046_T1 | 4291 | 200 | 80.15 | glotblastn |
| 1003 | LGB18 | plantago\|11v2\|SRR066373X116132_T1 | 4292 | 200 | 80.15 | glotblastn |
| 1004 | LGB18 | prunus\|10v1\|CN895518 | 4293 | 200 | 80.15 | glotblastn |
| 1005 | LGD1 | oat\|14v1\|CN815949_P1 | 4294 | 202 | 92.1 | globlastp |
| 1006 | LGD1 | fescue\|13v1\|GO788904_P1 | 4295 | 202 | 90.8 | globlastp |
| 1007 | LGD1 | brachypodium\|13v2\|BRADI4G06087 | — | 202 | 90.59 | glotblastn |
| 1008 | LGD1 | brachypodium\|14v1\|DV488306_P1 | 4296 | 202 | 89.3 | globlastp |
| 1009 | LGD1 | rice\|13v2\|BI813454 | 4297 | 202 | 85 | globlastp |
| 1010 | LGD1 | foxtail_millet\|14v1\|JK577293_P1 | 4298 | 202 | 83.4 | globlastp |
| 1011 | LGD1 | switchgrass\|12v1\|FL886154 | 4299 | 202 | 83.3 | globlastp |
| 1012 | LGD1 | foxtail_millet\|13v2\|SRR350548X126182 | 4300 | 202 | 83.2 | globlastp |
| 1013 | LGD1 | switchgrass\|12v1\|FL766263 | 4301 | 202 | 83.1 | globlastp |
| 1014 | LGD1 | cenchrus\|13v1\|EB660711_P1 | 4302 | 202 | 82.3 | globlastp |
| 1015 | LGD1 | sorghum\|13v2\|CD424217 | 4303 | 202 | 81.2 | globlastp |
| 1016 | LGD1 | maize\|13v2\|AW076155_P1 | 4304 | 202 | 80.5 | globlastp |
| 1017 | LGD2 | solanum_phureja\|09v1\|SPHAA824770 | 4305 | 203 | 98.9 | globlastp |
| 1018 | LGD2 | potato\|10v1\|BE920326_P1 | 4306 | 203 | 98.6 | globlastp |
| 1019 | LGD2 | eggplant\|10v1\|FS025010_P1 | 4307 | 203 | 94.5 | globlastp |
| 1020 | LGD2 | tobacco\|gb162\|AB001546 | 4308 | 203 | 94.2 | globlastp |
| 1021 | LGD2 | nicotiana_benthamiana\|12v1\|BP745887_P1 | 4309 | 203 | 93.6 | globlastp |
| 1022 | LGD2 | nicotiana_benthamiana\|12v1\|BP744607_P1 | 4310 | 203 | 92.8 | globlastp |
| 1023 | LGD2 | ipomoea_nil\|10v1\|BJ553567_P1 | 4311 | 203 | 91.2 | globlastp |
| 1024 | LGD2 | hornbeam\|12v1\|SRR364455.104702_P1 | 4312 | 203 | 89.2 | globlastp |
| 1025 | LGD2 | soybean\|13v2\|GLYMA11G08230 | 4313 | 203 | 88.1 | globlastp |
| 1026 | LGD2 | grape\|13v1\|GSVIVT01018772001_P1 | 4314 | 203 | 87.6 | globlastp |
| 1027 | LGD2 | phyla\|11v2\|SRR099035X100641_P1 | 4315 | 203 | 87.6 | globlastp |
| 1028 | LGD2 | valeriana\|11v1\|SRR099039X217899 | 4316 | 203 | 87.36 | glotblastn |
| 1029 | LGD2 | humulus\|11v1\|GD247906_P1 | 4317 | 203 | 87.1 | globlastp |
| 1030 | LGD2 | cowpea\|12v1\|FF537272_P1 | 4318 | 203 | 87 | globlastp |
| 1031 | LGD2 | olea\|13v1\|SRR014463X59791D1_P1 | 4319 | 203 | 87 | globlastp |
| 1032 | LGD2 | pigeonpea\|11v1\|SRR054580X104401_P1 | 4320 | 203 | 87 | globlastp |
| 1033 | LGD2 | amsonia\|11v1\|SRR098688X100716_P1 | 4321 | 203 | 86.8 | globlastp |
| 1034 | LGD2 | walnuts\|gb166\|EL892058 | 4322 | 203 | 86.8 | globlastp |
| 1035 | LGD2 | aristolochia\|10v1\|FD760753_P1 | 4323 | 203 | 86.7 | globlastp |
| 1036 | LGD2 | bean\|13v1\|CB541466_P1 | 4324 | 203 | 86.7 | globlastp |
| 1037 | LGD2 | orange\|11v1\|CB322080_P1 | 4325 | 203 | 86.7 | globlastp |
| 1038 | LGD2 | pigeonpea\|11v1\|SRR054580X120442_P1 | 4326 | 203 | 86.7 | globlastp |
| 1039 | LGD2 | solanum_phureja\|09v1\|SPHAW934361 | 4327 | 203 | 86.5 | globlastp |
| 1040 | LGD2 | chestnut\|14v1\|SRR006295X50607D1_T1 | 4328 | 203 | 86.46 | glotblastn |
| 1041 | LGD2 | cotton\|11v1\|CO071036_P1 | 4329 | 203 | 86.2 | globlastp |
| 1042 | LGD2 | gossypium_raimondii\|13v1\|CA993070_P1 | 4330 | 203 | 86.2 | globlastp |
| 1043 | LGD2 | peanut\|13v1\|CD037704_P1 | 4331 | 203 | 86.2 | globlastp |
| 1044 | LGD2 | tomato\|13v1\|AW934361 | 4332 | 203 | 86.2 | globlastp |
| 1045 | LGD2 | olea\|13v1\|SRR014464X16950D1_T1 | 4333 | 203 | 86.19 | glotblastn |
| 1046 | LGD2 | tripterygium\|11v1\|SRR098677X100526 | 4334 | 203 | 86.1 | globlastp |
| 1047 | LGD2 | antirrhinum\|gb166\|AJ558891_P1 | 4335 | 203 | 86 | globlastp |
| 1048 | LGD2 | monkeyflower\|12v1\|DV208740_P1 | 4336 | 203 | 86 | globlastp |
| 1049 | LGD2 | tripterygium\|11v1\|SRR098677X107175 | 4337 | 203 | 86 | globlastp |
| 1050 | LGD2 | ginseng\|13v1\|JK987781_P1 | 4338 | 203 | 85.9 | globlastp |
| 1051 | LGD2 | ginseng\|13v1\|SRR547977.584103_P1 | 4338 | 203 | 85.9 | globlastp |
| 1052 | LGD2 | cassava\|09v1\|DV458283_P1 | 4339 | 203 | 85.6 | globlastp |
| 1053 | LGD2 | cotton\|11v1\|CA993070_P1 | 4340 | 203 | 85.6 | globlastp |
| 1054 | LGD2 | ginseng\|13v1\|SRR547984.108232_P1 | 4341 | 203 | 85.6 | globlastp |
| 1055 | LGD2 | eucalyptus\|11v2\|CD669568_P1 | 4342 | 203 | 85.5 | globlastp |
| 1056 | LGD2 | carrot\|14v1\|JG753691_P1 | 4343 | 203 | 85.4 | globlastp |
| 1057 | LGD2 | carrot\|14v1\|JG761743_P1 | 4344 | 203 | 85.4 | globlastp |
| 1058 | LGD2 | bean\|13v1\|CB280596_P1 | 4345 | 203 | 85.4 | globlastp |
| 1059 | LGD2 | beech\|11v1\|AM062888_P1 | 4346 | 203 | 85.4 | globlastp |
| 1060 | LGD2 | bupleurum\|11v1\|SRR301254.10467_P1 | 4347 | 203 | 85.4 | globlastp |
| 1061 | LGD2 | coffea\|10v1\|CF588648_P1 | 4348 | 203 | 85.4 | globlastp |
| 1062 | LGD2 | nasturtium\|11v1\|SRR032558.160646_T1 | 4349 | 203 | 85.4 | glotblastn |
| 1063 | LGD2 | vinca\|11v1\|SRR098690X100483 | 4350 | 203 | 85.3 | globlastp |
| 1064 | LGD2 | prunus\|10v1\|CN444847 | 4351 | 203 | 85.2 | globlastp |
| 1065 | LGD2 | triphysaria\|13v1\|DR169927 | 4352 | 203 | 85.2 | globlastp |
| 1066 | LGD2 | carrot\|14v1\|BSS10K19C13327_P1 | 4353 | 203 | 85.1 | globlastp |
| 1067 | LGD2 | carrot\|14v1\|BSS10K29C1457_P1 | 4354 | 203 | 85.1 | globlastp |
| 1068 | LGD2 | carrot\|14v1\|JG761597_P1 | 4355 | 203 | 85.1 | globlastp |
| 1069 | LGD2 | cassava\|09v1\|DV449297_P1 | 4356 | 203 | 85.1 | globlastp |
| 1070 | LGD2 | scabiosa\|11v1\|SRR063723X107345 | 4357 | 203 | 85 | globlastp |
| 1071 | LGD2 | primula\|11v1\|SRR098679X100834_T1 | 4358 | 203 | 84.93 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1072 | LGD2 | blueberry\|12v1\|SRR353282X19423D1_P1 | 4359 | 203 | 84.9 | globlastp |
| 1073 | LGD2 | prunus_mume\|13v1\|AJ825817 | 4360 | 203 | 84.9 | globlastp |
| 1074 | LGD2 | carrot\|14v1\|BSS10K19C4040_P1 | 4361 | 203 | 84.8 | globlastp |
| 1075 | LGD2 | carrot\|14v1\|JG765320_P1 | 4362 | 203 | 84.8 | globlastp |
| 1076 | LGD2 | aquilegia\|10v2\|DR927797_P1 | 4363 | 203 | 84.8 | globlastp |
| 1077 | LGD2 | eschscholzia\|11v1\|CK744019_P1 | 4364 | 203 | 84.8 | globlastp |
| 1078 | LGD2 | soybean\|13v2\|GLYMA02G05350 | 4365 | 203 | 84.8 | globlastp |
| 1079 | LGD2 | watermelon\|11v1\|AM741926 | 4366 | 203 | 84.8 | globlastp |
| 1080 | LGD2 | cyclamen\|14v1\|B14ROOTK19C132272_P1 | 4367 | 203 | 84.7 | globlastp |
| 1081 | LGD2 | pineapple\|14v1\|ACOM14V1K19C1004165_P1 | 4367 | 203 | 84.7 | globlastp |
| 1082 | LGD2 | chelidonium\|11v1\|SRR084752X100055_P1 | 4368 | 203 | 84.7 | globlastp |
| 1083 | LGD2 | plantago\|11v2\|SRR066373X203509_P1 | 4369 | 203 | 84.7 | globlastp |
| 1084 | LGD2 | melon\|10v1\|AM741926_P1 | 4370 | 203 | 84.6 | globlastp |
| 1085 | LGD2 | parsley\|14v1\|BSS12K19C289667_P1 | 4371 | 203 | 84.5 | globlastp |
| 1086 | LGD2 | soybean\|13v2\|GLYMA16G23710 | 4372 | 203 | 84.5 | globlastp |
| 1087 | LGD2 | castorbean\|14v2\|XM_002533754_P1 | 4373 | 203 | 84.4 | globlastp |
| 1088 | LGD2 | cucurbita\|11v1\|SRR091276X103338_T1 | 4374 | 203 | 84.38 | glotblastn |
| 1089 | LGD2 | chickpea\|13v2\|SRR133517.119993_P1 | 4375 | 203 | 84.3 | globlastp |
| 1090 | LGD2 | gossypium_raimondii\|13v1\|CA993884_P1 | 4376 | 203 | 84.3 | globlastp |
| 1091 | LGD2 | scabiosa\|11v1\|SRR063723X101600 | 4377 | 203 | 84.3 | globlastp |
| 1092 | LGD2 | chickpea\|13v2\|DY475083_P1 | 4378 | 203 | 84.1 | globlastp |
| 1093 | LGD2 | chickpea\|13v2\|GW691637_P1 | 4378 | 203 | 84.1 | globlastp |
| 1094 | LGD2 | chickpea\|13v2\|SRR133517.100229_P1 | 4378 | 203 | 84.1 | globlastp |
| 1095 | LGD2 | lettuce\|12v1\|DW044783_P1 | 4379 | 203 | 84 | globlastp |
| 1096 | LGD2 | arnica\|11v1\|SRR099034X101599_P1 | 4380 | 203 | 83.9 | globlastp |
| 1097 | LGD2 | flax\|11v1\|GW864323XX1_P1 | 4381 | 203 | 83.9 | globlastp |
| 1098 | LGD2 | cyclamen\|14v1\|AJ886097_P1 | 4382 | 203 | 83.7 | globlastp |
| 1099 | LGD2 | cirsium\|11v1\|SRR346952.103971_P1 | 4383 | 203 | 83.7 | globlastp |
| 1100 | LGD2 | lotus\|09v1\|CN825342_P1 | 4384 | 203 | 83.7 | globlastp |
| 1101 | LGD2 | utricularia\|11v1\|SRR094438.100252 | 4385 | 203 | 83.7 | globlastp |
| 1102 | LGD2 | arnica\|11v1\|SRR099034X101811_P1 | 4386 | 203 | 83.6 | globlastp |
| 1103 | LGD2 | heritiera\|10v1\|SRR005795S0001233_P1 | 4387 | 203 | 83.6 | globlastp |
| 1104 | LGD2 | chickpea\|13v2\|SRR133517.101062_T1 | 4388 | 203 | 83.52 | glotblastn |
| 1105 | LGD2 | pineapple\|14v1\|ACOM14V1K19C1689824_P1 | 4389 | 203 | 83.5 | globlastp |
| 1106 | LGD2 | cacao\|13v1\|CU496808_P1 | 4390 | 203 | 83.5 | globlastp |
| 1107 | LGD2 | poplar\|13v1\|BI068634_P1 | 4391 | 203 | 83.5 | globlastp |
| 1108 | LGD2 | pea\|11v1\|PEAMNTFRC_P1 | 4392 | 203 | 83.4 | globlastp |
| 1109 | LGD2 | amaranthus\|13v1\|SRR172675X348791D1_T1 | 4393 | 203 | 83.33 | glotblastn |
| 1110 | LGD2 | nasturtium\|11v1\|SRR032558.168001_P1 | 4394 | 203 | 83.3 | globlastp |
| 1111 | LGD2 | medicago\|13v1\|AW127593_P1 | 4395 | 203 | 83.2 | globlastp |
| 1112 | LGD2 | poplar\|13v1\|BI068820_P1 | 4396 | 203 | 83.2 | globlastp |
| 1113 | LGD2 | tragopogon\|10v1\|SRR020205S0005528 | 4397 | 203 | 83.2 | globlastp |
| 1114 | LGD2 | echinacea\|13v1\|EPURP13V11199800_P1 | 4398 | 203 | 83 | globlastp |
| 1115 | LGD2 | flaveria\|11v1\|SRR149229.56980_P1 | 4399 | 203 | 83 | globlastp |
| 1116 | LGD2 | flaveria\|11v1\|SRR149232.100431_P1 | 4399 | 203 | 83 | globlastp |
| 1117 | LGD2 | flaveria\|11v1\|SRR149232.152081_P1 | 4400 | 203 | 83 | globlastp |
| 1118 | LGD2 | primula\|11v1\|SRR098679X100355_T1 | 4401 | 203 | 82.92 | glotblastn |
| 1119 | LGD2 | cichorium\|14v1\|EH682554_P1 | 4402 | 203 | 82.8 | globlastp |
| 1120 | LGD2 | oil_palm\|11v1\|SRR190698.134977_P1 | 4403 | 203 | 82.8 | globlastp |
| 1121 | LGD2 | sunflower\|12v1\|CD846663 | 4404 | 203 | 82.8 | globlastp |
| 1122 | LGD2 | beet\|12v1\|AW063024_P1 | 4405 | 203 | 82.7 | globlastp |
| 1123 | LGD2 | flaveria\|11v1\|SRR149229.104573_P1 | 4406 | 203 | 82.7 | globlastp |
| 1124 | LGD2 | ambrosia\|11v1\|SRR346935.1000_P1 | 4407 | 203 | 82.6 | globlastp |
| 1125 | LGD2 | ambrosia\|11v1\|SRR346935.100462_P1 | 4408 | 203 | 82.6 | globlastp |
| 1126 | LGD2 | flaveria\|11v1\|SRR149229.110544_P1 | 4409 | 203 | 82.6 | globlastp |
| 1127 | LGD2 | flaveria\|11v1\|SRR149229.148542_P1 | 4409 | 203 | 82.6 | globlastp |
| 1128 | LGD2 | peanut\|13v1\|CD037596_P1 | 4410 | 203 | 82.6 | globlastp |
| 1129 | LGD2 | platanus\|11v1\|SRR096786X10099_P1 | 4411 | 203 | 82.6 | globlastp |
| 1130 | LGD2 | sunflower\|12v1\|CF076517 | 4412 | 203 | 82.6 | globlastp |
| 1131 | LGD2 | chrysanthemum\|14v1\|DK940352_P1 | 4413 | 203 | 82.5 | globlastp |
| 1132 | LGD2 | cichorium\|14v1\|EL362434_P1 | 4414 | 203 | 82.5 | globlastp |
| 1133 | LGD2 | flaveria\|11v1\|SRR149232.105932_P1 | 4415 | 203 | 82.5 | globlastp |
| 1134 | LGD2 | flaveria\|11v1\|SRR149232.51064_P1 | 4416 | 203 | 82.5 | globlastp |
| 1135 | LGD2 | cassava\|09v1\|DV442057_T1 | 4417 | 203 | 82.32 | glotblastn |
| 1136 | LGD2 | centaurea\|11v1\|EH767420_P1 | 4418 | 203 | 82.3 | globlastp |
| 1137 | LGD2 | cirsium\|11v1\|SRR346952.1001277_P1 | 4419 | 203 | 82.3 | globlastp |
| 1138 | LGD2 | flaveria\|11v1\|SRR149232.100165_P1 | 4420 | 203 | 82.3 | globlastp |
| 1139 | LGD2 | sunflower\|12v1\|BU671956 | 4421 | 203 | 82.3 | globlastp |
| 1140 | LGD2 | coconut\|14v1\|COCOS14V1K19C1149307_P1 | 4422 | 203 | 82.2 | globlastp |
| 1141 | LGD2 | cleome_spinosa\|10v1\|SRR015531S0002387_P1 | 4423 | 203 | 82.2 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1142 | LGD2 | flaveria\|11v1\|SRR149241.108770_T1 | 4424 | 203 | 82.19 | glotblastn |
| 1143 | LGD2 | salvia\|10v1\|SRR014553S0002772 | 4425 | 203 | 82.19 | glotblastn |
| 1144 | LGD2 | clover\|14v1\|BB903834_P1 | 4426 | 203 | 82.1 | globlastp |
| 1145 | LGD2 | flaveria\|11v1\|SRR149229.353036_T1 | 4427 | 203 | 82.02 | glotblastn |
| 1146 | LGD2 | centaurea\|11v1\|EH725789_P1 | 4428 | 203 | 82 | globlastp |
| 1147 | LGD2 | flaveria\|11v1\|SRR149229.18990_P1 | 4429 | 203 | 82 | globlastp |
| 1148 | LGD2 | flaveria\|11v1\|SRR149229.23766XX2_P1 | 4430 | 203 | 82 | globlastp |
| 1149 | LGD2 | flaveria\|11v1\|SRR149232.135732_P1 | 4431 | 203 | 82 | globlastp |
| 1150 | LGD2 | flaveria\|11v1\|SRR149232.336022_P1 | 4432 | 203 | 82 | globlastp |
| 1151 | LGD2 | flaveria\|11v1\|SRR149238.175866_P1 | 4433 | 203 | 82 | globlastp |
| 1152 | LGD2 | flaveria\|11v1\|SRR149241.102804_P1 | 4434 | 203 | 82 | globlastp |
| 1153 | LGD2 | flaveria\|11v1\|SRR149241.120902_P1 | 4435 | 203 | 82 | globlastp |
| 1154 | LGD2 | strawberry\|11v1\|CX661492 | 4436 | 203 | 82 | globlastp |
| 1155 | LGD2 | tobacco\|gb162\|DV160073 | 4437 | 203 | 82 | globlastp |
| 1156 | LGD2 | cotton\|11v1\|BQ401882_P1 | 4438 | 203 | 81.8 | globlastp |
| 1157 | LGD2 | cotton\|11v1\|CO081230_P1 | 4438 | 203 | 81.8 | globlastp |
| 1158 | LGD2 | gossypium_raimondii\|13v1\|BQ401882_P1 | 4438 | 203 | 81.8 | globlastp |
| 1159 | LGD2 | thellungiella_halophilum\|13v1\|BI698466 | 4439 | 203 | 81.8 | globlastp |
| 1160 | LGD2 | thellungiella_parvulum\|13v1\|BM985809 | 4439 | 203 | 81.8 | globlastp |
| 1161 | LGD2 | amaranthus\|13v1\|SRR039408X1106D1_P1 | 4440 | 203 | 81.7 | globlastp |
| 1162 | LGD2 | ambrosia\|11v1\|SRR346935.194035_P1 | 4441 | 203 | 81.6 | globlastp |
| 1163 | LGD2 | vicia\|14v1\|VFU14956_P1 | 4442 | 203 | 81.5 | globlastp |
| 1164 | LGD2 | quinoa\|13v2\|GE746499 | 4443 | 203 | 81.5 | globlastp |
| 1165 | LGD2 | fagopyrum\|11v1\|SRR063689X108342_P1 | 4444 | 203 | 81.2 | globlastp |
| 1166 | LGD2 | flaveria\|11v1\|SRR149229.103686_T1 | 4445 | 203 | 81.2 | glotblastn |
| 1167 | LGD2 | flaveria\|11v1\|SRR149229.105761_P1 | 4446 | 203 | 81.2 | globlastp |
| 1168 | LGD2 | banana\|14v1\|DN239493_P1 | 4447 | 203 | 81.1 | globlastp |
| 1169 | LGD2 | onion\|14v1\|CF445107_P1 | 4448 | 203 | 81.1 | globlastp |
| 1170 | LGD2 | vinca\|11v1\|SRR098690X101317 | 4449 | 203 | 81.1 | globlastp |
| 1171 | LGD2 | poppy\|11v1\|SRR030264.231182_P1 | 4450 | 203 | 81 | globlastp |
| 1172 | LGD2 | chestnut\|14v1\|SRR006296X78520D1_T1 | 4451 | 203 | 80.94 | glotblastn |
| 1173 | LGD2 | chrysanthemum\|14v1\|SRR290491X101597D1_P1 | 4452 | 203 | 80.9 | globlastp |
| 1174 | LGD2 | banana\|14v1\|DN238988_P1 | 4453 | 203 | 80.8 | globlastp |
| 1175 | LGD2 | banana\|12v1\|DN238988 | 4453 | 203 | 80.8 | globlastp |
| 1176 | LGD2 | banana\|12v1\|DN239493 | 4454 | 203 | 80.8 | globlastp |
| 1177 | LGD2 | poppy\|11v1\|SRR030259.105413_P1 | 4455 | 203 | 80.8 | globlastp |
| 1178 | LGD2 | oak\|10v1\|DN950070_P1 | 4456 | 203 | 80.7 | globlastp |
| 1179 | LGD2 | radish\|gb164\|EV536591 | 4457 | 203 | 80.7 | globlastp |
| 1180 | LGD2 | phyla\|11v2\|SRR099037X109445_T1 | 4458 | 203 | 80.66 | glotblastn |
| 1181 | LGD2 | sunflower\|12v1\|CX944622 | 4459 | 203 | 80.65 | globlastp |
| 1182 | LGD2 | amaranthus\|13v1\|SRR039411X119681D1_P1 | 4460 | 203 | 80.6 | globlastp |
| 1183 | LGD2 | castorbean\|14v2\|EG661873_P1 | 4461 | 203 | 80.5 | globlastp |
| 1184 | LGD2 | b_juncea\|12v1\|E6ANDIZ01A7B5A_P1 | 4462 | 203 | 80.5 | globlastp |
| 1185 | LGD2 | castorbean\|12v1\|EG661873 | 4461 | 203 | 80.5 | globlastp |
| 1186 | LGD2 | poppy\|11v1\|SRR030259.105604_P1 | 4463 | 203 | 80.5 | globlastp |
| 1187 | LGD2 | flaveria\|11v1\|SRR149241.108496_T1 | 4464 | 203 | 80.49 | glotblastn |
| 1188 | LGD2 | pteridium\|11v1\|SRR043594X121427 | 4465 | 203 | 80.44 | glotblastn |
| 1189 | LGD2 | artemisia\|10v1\|EY031786_P1 | 4466 | 203 | 80.4 | globlastp |
| 1190 | LGD2 | banana\|12v1\|MAGEN2012011875 | 4467 | 203 | 80.4 | globlastp |
| 1191 | LGD2 | sesame\|12v1\|SESI12V1405849 | 4468 | 203 | 80.4 | globlastp |
| 1192 | LGD2 | arabidopsis\|13v2\|AT5G66190_P1 | 4469 | 203 | 80.3 | globlastp |
| 1193 | LGD2 | radish\|gb164\|EV566182 | 4470 | 203 | 80.3 | globlastp |
| 1194 | LGD2 | b_juncea\|12v1\|E6ANDIZ01A500M_T1 | 4471 | 203 | 80.27 | glotblastn |
| 1195 | LGD2 | castorbean\|12v1\|XM_002533754 | 4472 | 203 | 80.27 | glotblastn |
| 1196 | LGD2 | quinoa\|13v2\|GE746387 | 4473 | 203 | 80.27 | glotblastn |
| 1197 | LGD2 | banana\|14v1\|JK543985_P1 | 4474 | 203 | 80.2 | globlastp |
| 1198 | LGD2 | clover\|14v1\|ERR351507S19XK19C196840_P1 | 4475 | 203 | 80.2 | globlastp |
| 1199 | LGD2 | b_juncea\|12v1\|E6ANDIZ01AX65C_T1 | 4476 | 203 | 80.11 | glotblastn |
| 1200 | LGD2 | beech\|11v1\|SRR006293.11516_T1 | 4477 | 203 | 80.11 | glotblastn |
| 1201 | LGD2 | cacao\|13v1\|SRR531454.1005700_T1 | 4478 | 203 | 80.11 | glotblastn |
| 1202 | LGD2 | b_rapa\|11v1\|BQ704225_T1 | 4479 | 203 | 80 | glotblastn |
| 1203 | LGD2 | canola\|11v1\|DQ539647_T1 | 4480 | 203 | 80 | glotblastn |
| 1204 | LGD3 | pigeonpea\|11v1\|SRR054580X108950_P1 | 4481 | 204 | 96.7 | globlastp |
| 1205 | LGD3 | soybean\|13v2\|BU926798 | 4482 | 204 | 96.1 | globlastp |
| 1206 | LGD3 | soybean\|13v2\|GLYMA10G38770 | 4483 | 204 | 95.4 | globlastp |
| 1207 | LGD3 | lotus\|09v1\|AV779918_P1 | 4484 | 204 | 93 | globlastp |
| 1208 | LGD3 | chickpea\|13v2\|SRR133517.134840_P1 | 4485 | 204 | 91.7 | globlastp |
| 1209 | LGD3 | chickpea\|13v2\|FL512467_P1 | 4486 | 204 | 91.1 | globlastp |
| 1210 | LGD3 | bean\|13v1\|SRR001334X64774_P1 | 4487 | 204 | 91 | globlastp |
| 1211 | LGD3 | pigeonpea\|11v1\|SRR054580X111823_T1 | 4488 | 204 | 90.37 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1212 | LGD3 | medicago\|13v1\|BI271909_P1 | 4489 | 204 | 90.2 | globlastp |
| 1213 | LGD3 | medicago\|13v1\|BE204729_P1 | 4490 | 204 | 90.1 | globlastp |
| 1214 | LGD3 | soybean\|13v2\|GLYMA02G00510 | 4491 | 204 | 89.7 | globlastp |
| 1215 | LGD3 | clementine\|11v1\|AU186251_P1 | 4492 | 204 | 88.6 | globlastp |
| 1216 | LGD3 | orange\|11v1\|AU186251_P1 | 4493 | 204 | 88.6 | globlastp |
| 1217 | LGD3 | cassava\|09v1\|JGICASSAVA35367VALIDM1_P1 | 4494 | 204 | 88.5 | globlastp |
| 1218 | LGD3 | prunus_mume\|13v1\|DY653449 | 4495 | 204 | 88.1 | globlastp |
| 1219 | LGD3 | cassava\|09v1\|DR084500_P1 | 4496 | 204 | 88 | globlastp |
| 1220 | LGD3 | prunus\|10v1\|CN866241 | 4497 | 204 | 88 | globlastp |
| 1221 | LGD3 | cotton\|11v1\|AI054532_P1 | 4498 | 204 | 87.9 | globlastp |
| 1222 | LGD3 | grape\|13v1\|GSVIVT01018054001_P1 | 4499 | 204 | 87.9 | globlastp |
| 1223 | LGD3 | soybean\|13v2\|GLYMA10G00527 | 4500 | 204 | 87.63 | glotblastn |
| 1224 | LGD3 | castorbean\|14v2\|XM_002517014_P1 | 4501 | 204 | 87.6 | globlastp |
| 1225 | LGD3 | castorbean\|12v1\|XM_002517014 | 4501 | 204 | 87.6 | globlastp |
| 1226 | LGD3 | tripterygium\|11v1\|SRR098677X111318 | 4502 | 204 | 87.6 | globlastp |
| 1227 | LGD3 | cacao\|13v1\|CU488167_P1 | 4503 | 204 | 87.4 | globlastp |
| 1228 | LGD3 | cucumber\|09v1\|AM720342_P1 | 4504 | 204 | 87.4 | globlastp |
| 1229 | LGD3 | poplar\|13v1\|AI166030_P1 | 4505 | 204 | 87 | globlastp |
| 1230 | LGD3 | beech\|11v1\|SRR006293.28801_T1 | 4506 | 204 | 86.81 | glotblastn |
| 1231 | LGD3 | poplar\|13v1\|BI127913_P1 | 4507 | 204 | 86.8 | globlastp |
| 1232 | LGD3 | clover\|14v1\|BB915624_P1 | 4508 | 204 | 86.5 | globlastp |
| 1233 | LGD3 | sesame\|12v1\|SESI12V1404731 | 4509 | 204 | 86.5 | globlastp |
| 1234 | LGD3 | clover\|14v1\|ERR351507S19XK19C428695_P1 | 4510 | 204 | 86.4 | globlastp |
| 1235 | LGD3 | gossypium_raimondii\|13v1\|BF269617_P1 | 4511 | 204 | 86.2 | globlastp |
| 1236 | LGD3 | eucalyptus\|11v2\|SRR001659X130472_P1 | 4512 | 204 | 86.1 | globlastp |
| 1237 | LGD3 | euphorbia\|11v1\|SRR098678X100005_P1 | 4513 | 204 | 86 | globlastp |
| 1238 | LGD3 | strawberry\|11v1\|DY676103 | 4514 | 204 | 85.7 | globlastp |
| 1239 | LGD3 | gossypium_raimondii\|13v1\|AI054532_P1 | 4515 | 204 | 85.4 | globlastp |
| 1240 | LGD3 | apple\|11v1\|CN868660_P1 | 4516 | 204 | 84.9 | globlastp |
| 1241 | LGD3 | solanum_phureja\|09v1\|SPHAI490815 | 4517 | 204 | 84.51 | glotblastn |
| 1242 | LGD3 | thellungiella_halophilum\|13v1\|BM985717 | 4518 | 204 | 84.4 | globlastp |
| 1243 | LGD3 | apple\|11v1\|CN866241_P1 | 4519 | 204 | 84.3 | globlastp |
| 1244 | LGD3 | nicotiana_benthamiana\|12v1\|BP131190_P1 | 4520 | 204 | 84.2 | globlastp |
| 1245 | LGD3 | parsley\|14v1\|BSS12K19C454645_P1 | 4521 | 204 | 84.1 | globlastp |
| 1246 | LGD3 | tomato\|13v1\|AI490815 | 4522 | 204 | 84.1 | globlastp |
| 1247 | LGD3 | carrot\|14v1\|BSS11K19C103871_P1 | 4523 | 204 | 84 | globlastp |
| 1248 | LGD3 | parsley\|14v1\|BSS12K19C108996_P1 | 4524 | 204 | 84 | globlastp |
| 1249 | LGD3 | trigonella\|11v1\|SRR066194X221809 | 4525 | 204 | 83.81 | glotblastn |
| 1250 | LGD3 | parsley\|14v1\|BSS12K19C116574_P1 | 4526 | 204 | 83.7 | globlastp |
| 1251 | LGD3 | arabidopsis_lyrata\|13v1\|Z17976_P1 | 4527 | 204 | 83.4 | globlastp |
| 1252 | LGD3 | cotton\|11v1\|BF269617_P1 | 4528 | 204 | 83.4 | globlastp |
| 1253 | LGD3 | chestnut\|14v1\|SRR006296X10665D1_T1 | 4529 | 204 | 83.32 | glotblastn |
| 1254 | LGD3 | b_rapa\|11v1\|CD822925_P1 | 4530 | 204 | 83.2 | globlastp |
| 1255 | LGD3 | parsley\|14v1\|BSS12K19C1072602_T1 | 4531 | 204 | 82.9 | glotblastn |
| 1256 | LGD3 | aquilegia\|10v2\|DR942297_P1 | 4532 | 204 | 82.8 | globlastp |
| 1257 | LGD3 | arabidopsis\|13v2\|AT5G43810_P1 | 4533 | 204 | 82.4 | globlastp |
| 1258 | LGD3 | poppy\|11v1\|SRR030259.139371_P1 | 4534 | 204 | 82.4 | globlastp |
| 1259 | LGD3 | tabernaemontana\|11v1\|SRR098689X109015 | 4535 | 204 | 82.21 | glotblastn |
| 1260 | LGD3 | parsley\|14v1\|BSS12K19C139668_P1 | 4536 | 204 | 82.2 | globlastp |
| 1261 | LGD3 | watermelon\|11v1\|AM720342 | 4537 | 204 | 81.4 | globlastp |
| 1262 | LGD3 | canola\|11v1\|EE545517_P1 | 4538 | 204 | 80.9 | globlastp |
| 1263 | LGD3 | monkeyflower\|12v1\|DV208319_P1 | 4539 | 204 | 80.9 | globlastp |
| 1264 | LGD3 | cannabis\|12v1\|SOLX00027072_T1 | 4540 | 204 | 80.84 | glotblastn |
| 1265 | LGD3 | b_oleracea\|14v1\|EE517394_P1 | 4541 | 204 | 80.6 | globlastp |
| 1266 | LGD6 | arabidopsis_lyrata\|13v1\|T14139_P1 | 4542 | 205 | 98.7 | globlastp |
| 1267 | LGD6 | thellungiella_parvulum\|13v1\|DN773553 | 4543 | 205 | 92.6 | globlastp |
| 1268 | LGD6 | thellungiella_halophilum\|13v1\|DN773553 | 4544 | 205 | 92.3 | globlastp |
| 1269 | LGD6 | b_oleracea\|14v1\|DY015235_P1 | 4545 | 205 | 92 | globlastp |
| 1270 | LGD6 | b_rapa\|11v1\|DY015235_P1 | 4546 | 205 | 91.7 | globlastp |
| 1271 | LGD6 | canola\|11v1\|EE447906_P1 | 4547 | 205 | 91.7 | globlastp |
| 1272 | LGD6 | b_oleracea\|14v1\|CN736008_P1 | 4548 | 205 | 91.6 | globlastp |
| 1273 | LGD6 | b_oleracea\|gb161\|AM387130 | 4549 | 205 | 91.6 | globlastp |
| 1274 | LGD6 | canola\|11v1\|DY007243_P1 | 4549 | 205 | 91.6 | globlastp |
| 1275 | LGD6 | b_juncea\|12v1\|E6ANDIZ01B953W_P1 | 4550 | 205 | 91.3 | globlastp |
| 1276 | LGD6 | b_rapa\|11v1\|CB686156_P1 | 4551 | 205 | 91 | globlastp |
| 1277 | LGD6 | canola\|11v1\|CN736008XX1_P1 | 4551 | 205 | 91 | globlastp |
| 1278 | LGD6 | b_oleracea\|gb161\|DY015235 | 4552 | 205 | 90.7 | globlastp |
| 1279 | LGD6 | radish\|gb164\|EV545762 | 4553 | 205 | 90.6 | globlastp |
| 1280 | LGD6 | radish\|gb164\|EV548475 | 4554 | 205 | 90.6 | globlastp |
| 1281 | LGD6 | canola\|11v1\|EV100004_P1 | 4555 | 205 | 89.6 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1282 | LGD6 | canola\|11v1\|SRR019556.30411__T1 | 4556 | 205 | 88.63 | glotblastn |
| 1283 | LGD6 | cleome_gynandra\|10v1\|SRR015532S0033862__P1 | 4557 | 205 | 87.6 | globlastp |
| 1284 | LGD6 | clementine\|11v1\|BQ623267__P1 | 4558 | 205 | 84.7 | globlastp |
| 1284 | LGD6 | orange\|11v1\|BQ623267__P1 | 4558 | 205 | 84.7 | globlastp |
| 1285 | LGD6 | tabernaemontana\|11v1\|SRR098689X107583 | 4559 | 205 | 84.6 | globlastp |
| 1286 | LGD6 | eucalyptus\|11v2\|SRR001659X104464__P1 | 4560 | 205 | 84.1 | globlastp |
| 1287 | LGD6 | cacao\|13v1\|CF973656__P1 | 4561 | 205 | 83.6 | globlastp |
| 1288 | LGD6 | catharanthus\|11v1\|EG555296__P1 | 4562 | 205 | 83.6 | globlastp |
| 1289 | LGD6 | heritiera\|10v1\|SRR005795S0007654__P1 | 4563 | 205 | 83.6 | globlastp |
| 1290 | LGD6 | spurge\|gb161\|DV121881 | 4564 | 205 | 83.6 | globlastp |
| 1291 | LGD6 | castorbean\|14v2\|EE258567__P1 | 4565 | 205 | 83.3 | globlastp |
| 1292 | LGD6 | pepper\|14v1\|GD112451__P1 | 4566 | 205 | 83.3 | globlastp |
| 1293 | LGD6 | castorbean\|12v1\|EE258567 | 4565 | 205 | 83.3 | globlastp |
| 1294 | LGD6 | cotton\|11v1\|BE055295__P1 | 4567 | 205 | 83.3 | globlastp |
| 1295 | LGD6 | pepper\|12v1\|GD112451 | 4566 | 205 | 83.3 | globlastp |
| 1296 | LGD6 | amsonia\|11v1\|SRR098688X107221__P1 | 4568 | 205 | 82.9 | globlastp |
| 1297 | LGD6 | beech\|11v1\|FR612818__P1 | 4569 | 205 | 82.9 | globlastp |
| 1298 | LGD6 | centaurea\|11v1\|EH752610__P1 | 4570 | 205 | 82.9 | globlastp |
| 1299 | LGD6 | centaurea\|11v1\|EH764761__P1 | 4571 | 205 | 82.9 | globlastp |
| 1300 | LGD6 | cirsium\|11v1\|SRR346952.1015656__P1 | 4572 | 205 | 82.9 | globlastp |
| 1301 | LGD6 | sesame\|12v1\|JK084024 | 4573 | 205 | 82.9 | globlastp |
| 1302 | LGD6 | amaranthus\|13v1\|SRR039408X1760D1__P1 | 4574 | 205 | 82.7 | globlastp |
| 1303 | LGD6 | canola\|11v1\|EV071661__P1 | 4575 | 205 | 82.6 | globlastp |
| 1304 | LGD6 | cassava\|09v1\|CK644971__P1 | 4576 | 205 | 82.6 | globlastp |
| 1305 | LGD6 | centaurea\|11v1\|SRR346938.351159__P1 | 4577 | 205 | 82.6 | globlastp |
| 1306 | LGD6 | cirsium\|11v1\|SRR349641.118840__P1 | 4578 | 205 | 82.6 | globlastp |
| 1307 | LGD6 | cotton\|11v1\|BM357882XX2__P1 | 4579 | 205 | 82.6 | globlastp |
| 1308 | LGD6 | ginseng\|13v1\|SRR547977.196751__P1 | 4580 | 205 | 82.6 | globlastp |
| 1309 | LGD6 | gossypium_raimondii\|13v1\|AI055541__P1 | 4579 | 205 | 82.6 | globlastp |
| 1310 | LGD6 | prunus_mume\|13v1\|BU039592 | 4581 | 205 | 82.6 | globlastp |
| 1311 | LGD6 | prunus_mume\|13v1\|BU044002 | 4582 | 205 | 82.6 | globlastp |
| 1312 | LGD6 | strawberry\|11v1\|SRR034859S0010487 | 4583 | 205 | 82.6 | globlastp |
| 1313 | LGD6 | valeriana\|11v1\|SRR099039X106504 | 4584 | 205 | 82.6 | globlastp |
| 1314 | LGD6 | platanus\|11v1\|SRR096786X106942__P1 | 4585 | 205 | 82.4 | globlastp |
| 1315 | LGD6 | carrot\|14v1\|JG758464__P1 | 4586 | 205 | 82.3 | globlastp |
| 1316 | LGD6 | chrysanthemum\|14v1\|CCOR13V1K19C1529200__P1 | 4587 | 205 | 82.3 | globlastp |
| 1317 | LGD6 | cirsium\|11v1\|SRS346952.10607__P1 | 4588 | 205 | 82.3 | globlastp |
| 1318 | LGD6 | fagopyrum\|11v1\|SRR063689X11758__P1 | 4589 | 205 | 82.3 | globlastp |
| 1319 | LGD6 | ipomoea_nil\|10v1\|BJ560869__P1 | 4590 | 205 | 82.3 | globlastp |
| 1320 | LGD6 | oak\|10v1\|FN740472__P1 | 4591 | 205 | 82.3 | globlastp |
| 1321 | LGD6 | quinoa\|13v2\|SRR315568X275516 | 4592 | 205 | 82.3 | globlastp |
| 1322 | LGD6 | silene\|11v1\|GH294928 | 4593 | 205 | 82.3 | globlastp |
| 1323 | LGD6 | vinca\|11v1\|SRR098690X135514 | 4594 | 205 | 82.3 | globlastp |
| 1324 | LGD6 | watermelon\|11v1\|AM715048 | 4595 | 205 | 82.3 | globlastp |
| 1325 | LGD6 | carrot\|14v1\|JG753068__P1 | 4596 | 205 | 81.9 | globlastp |
| 1326 | LGD6 | chestnut\|14v1\|SRR006295X104531D1__P1 | 4597 | 205 | 81.9 | globlastp |
| 1327 | LGD6 | ambrosia\|11v1\|SRR346935.116866__P1 | 4598 | 205 | 81.9 | globlastp |
| 1328 | LGD6 | artemisia\|10v1\|EY046329__P1 | 4599 | 205 | 81.9 | globlastp |
| 1329 | LGD6 | cucurbita\|11v1\|SRR091276X111606__P1 | 4600 | 205 | 81.9 | globlastp |
| 1330 | LGD6 | eggplant\|10v1\|FS003376__P1 | 4601 | 205 | 81.9 | globlastp |
| 1331 | LGD6 | euphorbia\|11v1\|DV121881__P1 | 4602 | 205 | 81.9 | globlastp |
| 1332 | LGD6 | quinoa\|13v2\|SRR315568X235652 | 4603 | 205 | 81.9 | globlastp |
| 1333 | LGD6 | nasturtium\|11v1\|SRR032558.100047__P1 | 4604 | 205 | 81.7 | globlastp |
| 1334 | LGD6 | vinca\|11v1\|SRR098690X104715 | 4605 | 205 | 81.7 | globlastp |
| 1335 | LGD6 | chrysanthemum\|14v1\|SRR290491X10323D1__P1 | 4606 | 205 | 81.6 | globlastp |
| 1336 | LGD6 | chrysanthemum\|14v1\|SRR525216X64511D1__P1 | 4607 | 205 | 81.6 | globlastp |
| 1337 | LGD6 | parsley\|14v1\|BSS12K2C760585__P1 | 4608 | 205 | 81.6 | globlastp |
| 1338 | LGD6 | chestnut\|gb170\|SRR006295S0008116 | 4609 | 205 | 81.6 | globlastp |
| 1339 | LGD6 | melon\|10v1\|AM715048__P1 | 4610 | 205 | 81.6 | globlastp |
| 1340 | LGD6 | nicotiana_benthamiana\|12v1\|BP747854__P1 | 4611 | 205 | 81.6 | globlastp |
| 1341 | LGD6 | oak\|10v1\|SRR006307S0001679__P1 | 4612 | 205 | 81.6 | globlastp |
| 1342 | LGD6 | prunus\|10v1\|DY653470 | 4613 | 205 | 81.52 | glotblastn |
| 1343 | LGD6 | primula\|11v1\|SRR098679X133113__P1 | 4614 | 205 | 81.4 | globlastp |
| 1344 | LGD6 | chrysanthemum\|14v1\|SRR290491X107720D1__P1 | 4615 | 205 | 81.3 | globlastp |
| 1345 | LGD6 | cichorium\|14v1\|EH686559__P1 | 4616 | 205 | 81.3 | globlastp |
| 1346 | LGD6 | onion\|14v1\|CF434726__P1 | 4617 | 205 | 81.3 | globlastp |
| 1347 | LGD6 | onion\|14v1\|SRR073446X174514D1__P1 | 4618 | 205 | 81.3 | globlastp |
| 1348 | LGD6 | pineapple\|14v1\|ACOM14V1K19C1107366__P1 | 4619 | 205 | 81.3 | globlastp |
| 1349 | LGD6 | cichorium\|gb171\|EH672374 | 4616 | 205 | 81.3 | globlastp |
| 1350 | LGD6 | echinacea\|13v1\|EPURP13V11270407__P1 | 4620 | 205 | 81.3 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1351 | LGD6 | flaveria\|11v1\|SRR149232.165194_P1 | 4621 | 205 | 81.3 | globlastp |
| 1352 | LGD6 | nicotiana_benthamiana\|12v1\|EB425021_P1 | 4622 | 205 | 81.3 | globlastp |
| 1353 | LGD6 | nicotiana_benthamiana\|12v1\|EH365315_P1 | 4623 | 205 | 81.3 | globlastp |
| 1354 | LGD6 | onion\|12v1\|CF434726 | 4624 | 205 | 81.3 | globlastp |
| 1355 | LGD6 | poplar\|13v1\|AI164027_P1 | 4625 | 205 | 81.3 | globlastp |
| 1356 | LGD6 | poplar\|13v1\|BU878429_P1 | 4626 | 205 | 81.3 | globlastp |
| 1357 | LGD6 | radish\|gb164\|EV543854 | 4627 | 205 | 81.3 | globlastp |
| 1358 | LGD6 | tomato\|13v1\|BG132580 | 4628 | 205 | 81.3 | globlastp |
| 1359 | LGD6 | triphysaria\|13v1\|SRR023500X14360 | 4629 | 205 | 81.3 | globlastp |
| 1360 | LGD6 | flaveria\|11v1\|SRR149229.178418_T1 | 4630 | 205 | 81.27 | glotblastn |
| 1361 | LGD6 | beet\|12v1\|BQ586246_P1 | 4631 | 205 | 81.1 | globlastp |
| 1362 | LGD6 | flaveria\|11v1\|SRR149229.150395_P1 | 4632 | 205 | 80.9 | globlastp |
| 1363 | LGD6 | flaveria\|11v1\|SRR149232.179842_P1 | 4633 | 205 | 80.9 | globlastp |
| 1364 | LGD6 | flaveria\|11v1\|SRR149244.101566_P1 | 4634 | 205 | 80.9 | globlastp |
| 1365 | LGD6 | oil_palm\|11v1\|SRR190698.155573_P1 | 4635 | 205 | 80.9 | globlastp |
| 1366 | LGD6 | potato\|10v1\|BG095913_P1 | 4636 | 205 | 80.9 | globlastp |
| 1367 | LGD6 | solanum_phureja\|09v1\|SPHBG132580 | 4637 | 205 | 80.9 | globlastp |
| 1368 | LGD6 | triphysaria\|13v1\|EY135259 | 4638 | 205 | 80.9 | globlastp |
| 1369 | LGD6 | grape\|13v1\|GSVIVT01027967001_P1 | 4639 | 205 | 80.8 | globlastp |
| 1370 | LGD6 | prunus\|10v1\|BU039592 | 4640 | 205 | 80.8 | globlastp |
| 1371 | LGD6 | cyclamen\|14v1\|B14ROOTK19C114497_P1 | 4641 | 205 | 80.7 | globlastp |
| 1372 | LGD6 | coconut\|14v1\|COCOS14V1K19C1394037_P1 | 4642 | 205 | 80.6 | globlastp |
| 1373 | LGD6 | onion\|14v1\|SRR573713X158546D1_P1 | 4643 | 205 | 80.6 | globlastp |
| 1374 | LGD6 | ambrosia\|11v1\|SRR346935.541098_P1 | 4644 | 205 | 80.6 | globlastp |
| 1375 | LGD6 | ambrosia\|11v1\|SRR346943.222707_P1 | 4645 | 205 | 80.6 | globlastp |
| 1376 | LGD6 | arnica\|11v1\|SRR099034X100739_P1 | 4646 | 205 | 80.6 | globlastp |
| 1377 | LGD6 | tragopogon\|10v1\|SRR020205S0009357 | 4647 | 205 | 80.6 | glotblastn |
| 1378 | LGD6 | vinca\|11v1\|SRR098690X13614 | 4648 | 205 | 80.6 | glotblastn |
| 1379 | LGD6 | amorphophallus\|11v2\|SRR089351X109055_P1 | 4649 | 205 | 80.5 | globlastp |
| 1380 | LGD6 | chelidonium\|11v1\|SRR084752X105652_P1 | 4650 | 205 | 80.5 | globlastp |
| 1381 | LGD6 | fagopyrum\|11v1\|SRR063689X112848_P1 | 4651 | 205 | 80.3 | globlastp |
| 1382 | LGD6 | flaveria\|11v1\|SRR149229.102521_P1 | 4652 | 205 | 80.3 | globlastp |
| 1383 | LGD6 | phyla\|11v2\|SRR099037X306416_P1 | 4653 | 205 | 80.3 | globlastp |
| 1384 | LGD6 | plantago\|11v2\|SRR066373X101578_P1 | 4654 | 205 | 80.3 | globlastp |
| 1385 | LGD6 | sunflower\|12v1\|BQ910388 | 4655 | 205 | 80.3 | globlastp |
| 1386 | LGD6 | sunflower\|12v1\|CF081794 | 4655 | 205 | 80.3 | globlastp |
| 1387 | LGD6 | sunflower\|12v1\|CX944968 | 4656 | 205 | 80.3 | globlastp |
| 1388 | LGD6 | monkeyflower\|12v1\|DV210491_T1 | 4657 | 205 | 80.27 | glotblastn |
| 1389 | LGD6 | humulus\|11v1\|ES653329_P1 | 4658 | 205 | 80.1 | globlastp |
| 1390 | LGD6 | cannabis\|12v1\|SOLX00008562_T1 | 4659 | 205 | 80.07 | glotblastn |
| 1391 | LGD7 | thellungiella_parvulum\|13v1\|AK353351P1 | 4660 | 206 | 92 | globlastp |
| 1392 | LGD7 | thellungiella_halophilum\|13v1\|AK353351P1 | 4661 | 206 | 89.1 | globlastp |
| 1393 | LGD7 | arabidopsis\|13v2\|AT1G08550_P1 | 4662 | 206 | 87.7 | globlastp |
| 1394 | LGD7 | arabidopsis_lyrata\|13v1\|N37612_P1 | 4663 | 206 | 87.1 | globlastp |
| 1395 | LGD8 | pigeonpea\|11v1\|SRR054580X100418_P1 | 4664 | 207 | 93 | globlastp |
| 1396 | LGD8 | soybean\|13v2\|GLYMA07G11160 | 4665 | 207 | 92.3 | globlastp |
| 1397 | LGD8 | soybean\|13v2\|GLYMA09G31070 | 4666 | 207 | 90.9 | globlastp |
| 1398 | LGD8 | lotus\|09v1\|LLBI419193_P1 | 4667 | 207 | 83.6 | globlastp |
| 1399 | LGD8 | chickpea\|13v2\|SRR133517.137538_P1 | 4668 | 207 | 81.7 | globlastp |
| 1400 | LGD8 | trigonella\|11v1\|SRR066194X13354 | 4669 | 207 | 80.3 | globlastp |
| 1401 | LGD9 | pigeonpea\|11v1\|GR466371_P1 | 4670 | 208 | 90.2 | globlastp |
| 1402 | LGD9 | cowpea\|12v1\|FF382737_P1 | 4671 | 208 | 89 | globlastp |
| 1403 | LGD9 | soybean\|13v2\|GLYMA01G26300 | 4672 | 208 | 88.4 | globlastp |
| 1404 | LGD9 | soybean\|13v2\|GLYMA03G16510 | 4673 | 208 | 87.5 | globlastp |
| 1405 | LGD9 | lotus\|09v1\|LLBG662173_P1 | 4674 | 208 | 85.4 | globlastp |
| 1406 | LGD9 | cyamopsis\|10v1\|EG987749_P1 | 4675 | 208 | 84.8 | globlastp |
| 1407 | LGD9 | acacia\|10v1\|FS592559_P1 | 4676 | 208 | 83.3 | globlastp |
| 1408 | LGD9 | peanut\|13v1\|ES708101_P1 | 4677 | 208 | 82.9 | globlastp |
| 1409 | LGD9 | trigonella\|11v1\|SRR066194X100112 | 4678 | 208 | 82.9 | globlastp |
| 1410 | LGD9 | pea\|11v1\|AF396464_T1 | 4679 | 208 | 82.72 | glotblastn |
| 1411 | LGD9 | clover\|14v1\|ERR351507S19XK19C543920_P1 | 4680 | 208 | 82.4 | globlastp |
| 1412 | LGD9 | medicago\|13v1\|AW686866_P1 | 4681 | 208 | 82.4 | globlastp |
| 1413 | LGD9 | vicia\|14v1\|HX907657_P1 | 4682 | 208 | 81.8 | globlastp |
| 1414 | LGD9 | chickpea\|13v2\|ES560403_P1 | 4683 | 208 | 81.8 | globlastp |
| 1415 | LGD9 | chestnut\|14v1\|SRR006295X12169D1_T1 | 4684 | 208 | 81.48 | globlastp |
| 1416 | LGD9 | chestnut\|gb170\|SRR006295S0004245 | 4684 | 208 | 81.48 | glotblastn |
| 1417 | LGD9 | prunus\|10v1\|BF717143 | 4685 | 208 | 80.86 | glotblastn |
| 1418 | LGD9 | peanut\|13v1\|CX127946_P1 | 4686 | 208 | 80.4 | globlastp |
| 1419 | LGD9 | oak\|10v1\|FN708607_T1 | 4687 | 208 | 80.25 | glotblastn |
| 1420 | LGD9 | prunus_mume\|13v1\|BF717143 | 4688 | 208 | 80.25 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1421 | LGD9 | peanut|13v1|SRR042414X43901_T1 | 4689 | 208 | 80.12 | glotblastn |
| 1422 | LGD9 | cacao|13v1|CU478218_P1 | 4690 | 208 | 80 | globlastp |
| 1423 | LGD10 | pigeonpea|11v1|SRR054580X104440_P1 | 4691 | 209 | 86.5 | globlastp |
| 1424 | LGD11 | cowpea|12v1|FF383805_P1 | 4692 | 210 | 91.8 | globlastp |
| 1425 | LGD11 | soybean|13v2|GLYMA10G29890 | 4693 | 210 | 91.1 | globlastp |
| 1426 | LGD11 | soybean|13v2|GLYMA20G37450 | 4694 | 210 | 85.3 | globlastp |
| 1427 | LGD11 | pigeonpea|11v1|SRR054580X106095_P1 | 4695 | 210 | 84 | globlastp |
| 1428 | LGD11 | lupin|13v4|CA411332_P1 | 4696 | 210 | 83.2 | globlastp |
| 1429 | LGD11 | liquorice|gb171|FS249410_P1 | 4697 | 210 | 81.3 | globlastp |
| 1430 | LGD11 | lupin|13v4|SRR520490.377461_P1 | 4698 | 210 | 81.2 | globlastp |
| 1431 | LGD11 | cassava|09v1|DV444651_T1 | 4699 | 210 | 80.82 | glotblastn |
| 1432 | LGD12 | b_oleracea|14v1|BOU13630_P1 | 4700 | 211 | 99.5 | globlastp |
| 1433 | LGD12 | b_juncea|12v1|E6ANDIZ01A1VCL_P1 | 4701 | 211 | 99.3 | globlastp |
| 1434 | LGD12 | b_rapa|11v1|BOU13630_P1 | 4701 | 211 | 99.3 | globlastp |
| 1435 | LGD12 | canola|11v1|EE467553_P1 | 4702 | 211 | 99 | globlastp |
| 1436 | LGD12 | b_oleracea|gb161|BOU13630 | 4703 | 211 | 98.3 | globlastp |
| 1437 | LGD12 | b_juncea|12v1|E6ANDIZ01BADZS_P1 | 4704 | 211 | 96.6 | globlastp |
| 1438 | LGD12 | b_juncea|12v1|E6ANDIZ01A08CZ_P1 | 4705 | 211 | 95.3 | globlastp |
| 1439 | LGD12 | thellungiella_parvulum|13v1|EC599457 | 4706 | 211 | 94.8 | globlastp |
| 1440 | LGD12 | thellungiella_halophilum|13v1|EC599457 | 4707 | 211 | 94.1 | globlastp |
| 1441 | LGD12 | wheat|12v3|ERR125556X242496D1 | 4708 | 211 | 94.1 | glotblastn |
| 1442 | LGD12 | b_juncea|12v1|E6ANDIZ01A5JIL_P1 | 4709 | 211 | 93.6 | globlastp |
| 1443 | LGD12 | b_oleracea|14v1|BG544743_P1 | 4710 | 211 | 92.4 | globlastp |
| 1444 | LGD12 | b_rapa|11v1|BG544743_P1 | 4711 | 211 | 92.4 | globlastp |
| 1445 | LGD12 | canola|11v1|CN732288_P1 | 4712 | 211 | 92.4 | globlastp |
| 1446 | LGD12 | canola|11v1|CN728759_P1 | 4713 | 211 | 92.1 | globlastp |
| 1447 | LGD12 | radish|gb164|EV547050 | 4714 | 211 | 92.1 | globlastp |
| 1448 | LGD12 | canola|11v1|ES899281_T1 | 4715 | 211 | 91.67 | glotblastn |
| 1449 | LGD12 | canola|11v1|FG566657_T1 | 4716 | 211 | 91.67 | glotblastn |
| 1450 | LGD12 | arabidopsis_lyrata|13v1|Z33953_P1 | 4717 | 211 | 90.3 | globlastp |
| 1451 | LGD12 | arabidopsis|13v2|AT5G46110_P1 | 4718 | 211 | 89.8 | globlastp |
| 1452 | LGD12 | cleome_spinosa|10v1|SRR015531S0001442_P1 | 4719 | 211 | 82.7 | globlastp |
| 1453 | LGD12 | cotton|11v1|BF279392_P1 | 4720 | 211 | 82.7 | globlastp |
| 1454 | LGD12 | gossypium_raimondii|13v1|BF279392_P1 | 4720 | 211 | 82.7 | globlastp |
| 1455 | LGD12 | cacao|13v1|CF973561_P1 | 4721 | 211 | 82.4 | globlastp |
| 1456 | LGD12 | cassava|09v1|DV458094_P1 | 4722 | 211 | 82.4 | globlastp |
| 1457 | LGD12 | castorbean|14v2|EG658329_P1 | 4723 | 211 | 82.3 | globlastp |
| 1458 | LGD12 | castorbean|12v1|EG658329 | 4723 | 211 | 82.3 | globlastp |
| 1459 | LGD12 | cotton|11v1|CO069957_P1 | 4724 | 211 | 81.9 | globlastp |
| 1460 | LGD12 | cleome_spinosa|10v1|SRR015531S0001677_P1 | 4725 | 211 | 81.8 | globlastp |
| 1461 | LGD12 | euphorbia|11v1|DV125198_P1 | 4726 | 211 | 81.8 | globlastp |
| 1462 | LGD12 | gossypium_raimondii|13v1|BG440904_P1 | 4727 | 211 | 81.7 | globlastp |
| 1463 | LGD12 | cassava|09v1|BM260318_P1 | 4728 | 211 | 81.6 | globlastp |
| 1464 | LGD12 | chelidonium|11v1|SRR084752X104267XX1_P1 | 4729 | 211 | 81.6 | globlastp |
| 1465 | LGD12 | strawberry|11v1|CX309723 | 4730 | 211 | 81.6 | globlastp |
| 1466 | LGD12 | radish|gb164|EX746579 | 4731 | 211 | 81.57 | glotblastn |
| 1467 | LGD12 | beech|11v1|SRR006293.11076_P1 | 4732 | 211 | 81.5 | globlastp |
| 1468 | LGD12 | poplar|13v1|BI069510_P1 | 4733 | 211 | 81.5 | globlastp |
| 1469 | LGD12 | poplar|13v1|BI073107_P1 | 4734 | 211 | 81.5 | globlastp |
| 1470 | LGD12 | cotton|11v1|BG440904_P1 | 4735 | 211 | 81.4 | globlastp |
| 1471 | LGD12 | ginseng|13v1|JK988005_P1 | 4736 | 211 | 81.2 | globlastp |
| 1472 | LGD12 | euonymus|11v1|SRR070038X101744_P1 | 4737 | 211 | 81.1 | globlastp |
| 1473 | LGD12 | spurge|gb161|DV123642 | 4738 | 211 | 80.8 | globlastp |
| 1474 | LGD12 | oak|10v1|CU657900_P1 | 4739 | 211 | 80.6 | globlastp |
| 1475 | LGD12 | euphorbia|11v1|DV123642_P1 | 4740 | 211 | 80.5 | globlastp |
| 1476 | LGD12 | ginseng|13v1|SRR547984.112403_P1 | 4741 | 211 | 80.5 | globlastp |
| 1477 | LGD12 | iceplant|gb164|BE036020_P1 | 4742 | 211 | 80.4 | globlastp |
| 1478 | LGD12 | amsonia|11v1|SRR098688X102659_P1 | 4743 | 211 | 80.1 | globlastp |
| 1479 | LGD12 | grape|13v1|GSVIVT01021114001_P1 | 4744 | 211 | 80 | globlastp |
| 1480 | LGD14 | medicago|13v1|MT4_2013004779_P1 | 4745 | 212 | 91.6 | globlastp |
| 1481 | LGD14 | medicago|13v1|AW574030_P1 | 4746 | 212 | 91.4 | globlastp |
| 1482 | LGD14 | medicago|13v1|BF644444_P1 | 4747 | 212 | 91.2 | globlastp |
| 1483 | LGD14 | medicago|13v1|EX527915_P1 | 4748 | 212 | 90.4 | globlastp |
| 1484 | LGD14 | medicago|13v1|MT4_2013008160_P1 | 4749 | 212 | 87.9 | globlastp |
| 1485 | LGD14 | medicago|13v1|BG646946_P1 | 4750 | 212 | 86.6 | globlastp |
| 1486 | LGD14 | clover|14v1|ERR351508S19XK19C482422_P1 | 4751 | 212 | 85.4 | globlastp |
| 1487 | LGD14 | clover|14v1|ERR351507S19XK19C829798_P1 | 4752 | 212 | 85.1 | globlastp |
| 1488 | LGD14 | soybean|13v2|GLYMA06G06930 | 4753 | 212 | 84.1 | globlastp |
| 1489 | LGD14 | castorbean|14v2|XM_002519859_T1 | 4754 | 212 | 83.54 | glotblastn |
| 1490 | LGD14 | castorbean|12v1|XM_002519859 | 4755 | 212 | 83.4 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1491 | LGD14 | pigeonpea\|11v1\|SRR054581X442011_P1 | 4756 | 212 | 83.4 | globlastp |
| 1492 | LGD14 | cotton\|11v1\|DT463070_P1 | 4757 | 212 | 82.8 | globlastp |
| 1493 | LGD14 | gossypium_raimondii\|13v1\|DT463070_P1 | 4758 | 212 | 82.6 | globlastp |
| 1494 | LGD14 | lettuce\|12v1\|DY984191_P1 | 4759 | 212 | 82.2 | globlastp |
| 1495 | LGD14 | cacao\|13v1\|SRR850732.1028059_P1 | 4760 | 212 | 82 | globlastp |
| 1496 | LGD14 | prunus\|10v1\|CO903008 | 4761 | 212 | 81.9 | globlastp |
| 1497 | LGD14 | parsley\|14v1\|BSS12K19C1063148_P1 | 4762 | 212 | 81.5 | globlastp |
| 1498 | LGD14 | medicago\|13v1\|EX531027_T1 | 4763 | 212 | 81.42 | glotblastn |
| 1499 | LGD14 | cassava\|09v1\|JGICASSAVA11048M1_P1 | 4764 | 212 | 81.4 | globlastp |
| 1500 | LGD14 | poplar\|13v1\|BU824343_P1 | 4765 | 212 | 81.4 | globlastp |
| 1501 | LGD14 | poplar\|13v1\|XM_002309614_P1 | 4766 | 212 | 81.4 | globlastp |
| 1502 | LGD14 | prunus_mume\|13v1\|PMBJFU12004665 | 4767 | 212 | 81.4 | globlastp |
| 1503 | LGD14 | aquilegia\|10v2\|JGIAC026797_P1 | 4768 | 212 | 81.3 | globlastp |
| 1504 | LGD14 | trigonella\|11v1\|SRR066194X338510 | 4769 | 212 | 81.29 | glotblastn |
| 1505 | LGD14 | cucumber\|09v1\|BGI454G0138300_P1 | 4770 | 212 | 81.1 | globlastp |
| 1506 | LGD14 | apple\|11v1\|MDP0000405003_P1 | 4771 | 212 | 80.8 | globlastp |
| 1507 | LGD14 | bean\|13v1\|PHVUL009G090700_P1 | 4772 | 212 | 80.8 | globlastp |
| 1508 | LGD14 | watermelon\|11v1\|BTM04562632021998 | 4773 | 212 | 80.7 | globlastp |
| 1509 | LGD14 | chrysanthemum\|14v1\|SRR290491X119247D1_P1 | 4774 | 212 | 80.6 | globlastp |
| 1510 | LGD14 | chrysanthemum\|14v1\|SRR290491X127294D1_P1 | 4775 | 212 | 80.6 | globlastp |
| 1511 | LGD14 | sunflower\|12v1\|BU016762 | 4776 | 212 | 80.4 | globlastp |
| 1512 | LGD14 | prunus_mume\|13v1\|PMBJFU12004668 | 4777 | 212 | 80.1 | globlastp |
| 1513 | LGD14 | monkeyflower\|12v1\|MGJGI016314_T1 | 4778 | 212 | 80.08 | glotblastn |
| 1514 | LGD14 | nicotiana_benthamiana\|12v1\|FG166740_P1 | 4779 | 212 | 80 | globlastp |
| 1515 | LGD14 | prunus\|10v1\|PPA005113M | 4780 | 212 | 80 | globlastp |
| 1516 | LGD15 | clover\|14v1\|BB922999_P1 | 4781 | 213 | 94 | globlastp |
| 1517 | LGD15 | clover\|14v1\|ERR351507S19XK19C199724_P1 | 4782 | 213 | 93.7 | globlastp |
| 1518 | LGD15 | clover\|14v1\|BB907928_P1 | 4783 | 213 | 93 | globlastp |
| 1519 | LGD15 | clover\|gb162\|BB907928 | 4784 | 213 | 92.6 | globlastp |
| 1520 | LGD15 | chickpea\|13v2\|SRR133517.101387_P1 | 4785 | 213 | 91.5 | globlastp |
| 1521 | LGD15 | clover\|14v1\|FY461310_P1 | 4786 | 213 | 90.8 | globlastp |
| 1522 | LGD15 | bean\|13v1\|CA896594_P1 | 4787 | 213 | 84.3 | globlastp |
| 1523 | LGD15 | soybean\|13v2\|GLYMA02G36460 | 4788 | 213 | 84.3 | globlastp |
| 1524 | LGD15 | lotus\|09v1\|BP028972_P1 | 4789 | 213 | 83.6 | globlastp |
| 1525 | LGD15 | peanut\|13v1\|GO330186_P1 | 4790 | 213 | 83.6 | globlastp |
| 1526 | LGD15 | peanut\|13v1\|GO330186 | — | 213 | 83.6 | globlastp |
| 1527 | LGD15 | lupin\|13v4\|SRR520491.1117817_P1 | 4791 | 213 | 82.4 | globlastp |
| 1528 | LGD15 | pigeonpea\|11v1\|SRR054580X104780_P1 | 4792 | 213 | 80.8 | globlastp |
| 1529 | LGD16 | clover\|14v1\|ERR351507S29XK29C50393_P1 | 4793 | 214 | 86.3 | globlastp |
| 1530 | LGD16 | clover\|14v1\|ERR351507S19XK19C171202_P1 | 4794 | 214 | 80.2 | globlastp |
| 1531 | LGD17 | clover\|14v1\|ERR351507S19XK19C798198_P1 | 4795 | 215 | 87.4 | globlastp |
| 1532 | LGD17 | clover\|14v1\|ERR351507S19XK19C183734_P1 | 4796 | 215 | 86.2 | globlastp |
| 1533 | LGD17 | clover\|14v1\|ERR351507S19XK19C192138_P1 | 4797 | 215 | 85.4 | globlastp |
| 1534 | LGD17 | soybean\|13v2\|GLYMA13G42500T2 | 4798 | 215 | 81.9 | globlastp |
| 1535 | LGD17 | pigeonpea\|11v1\|SRR054580X101690_P1 | 4799 | 215 | 81 | globlastp |
| 1536 | LGD18 | soybean\|13v2\|GLYMA08G20610 | 4800 | 216 | 96.8 | globlastp |
| 1537 | LGD18 | bean\|13v1\|CA909055_P1 | 4801 | 216 | 91.7 | globlastp |
| 1538 | LGD18 | pigeonpea\|11v1\|SRR054580X11199_P1 | 4802 | 216 | 91.7 | globlastp |
| 1539 | LGD18 | lupin\|13v4\|FG094591_T1 | 4803 | 216 | 87.68 | glotblastn |
| 1540 | LGD18 | chickpea\|13v2\|CK148903_P1 | 4804 | 216 | 86.6 | globlastp |
| 1541 | LGD18 | medicago\|13v1\|CX541608_P1 | 4805 | 216 | 84.4 | globlastp |
| 1542 | LGD18 | trigonella\|11v1\|SRR066194X253352 | 4806 | 216 | 84.07 | glotblastn |
| 1543 | LGD18 | prunus_mume\|13v1\|CB819958 | 4807 | 216 | 82.3 | globlastp |
| 1544 | LGD18 | cacao\|13v1\|CU484590_P1 | 4808 | 216 | 81.8 | globlastp |
| 1545 | LGD18 | prunus\|10v1\|CB819958 | 4809 | 216 | 81.72 | glotblastn |
| 1546 | LGD18 | castorbean\|12v1\|EE257428 | 4810 | 216 | 81 | globlastp |
| 1547 | LGD18 | soybean\|13v2\|GLYMA15G02780 | 4811 | 216 | 80.9 | globlastp |
| 1548 | LGD18 | castorbean\|14v2\|EE257428_P1 | 4812 | 216 | 80.8 | globlastp |
| 1549 | LGD18 | poplar\|13v1\|BI130000_P1 | 4813 | 216 | 80.8 | globlastp |
| 1550 | LGD19 | peanut\|13v1\|CD037541_P1 | 217 | 217 | 100 | globlastp |
| 1551 | LGD19 | peanut\|13v1\|CX018034_P1 | 217 | 217 | 100 | globlastp |
| 1552 | LGD19 | peanut\|13v1\|EH043638_P1 | 217 | 217 | 100 | globlastp |
| 1553 | LGD19 | peanut\|13v1\|GO343046_P1 | 217 | 217 | 100 | globlastp |
| 1554 | LGD19 | cowpea\|12v1\|FC456845_P1 | 217 | 217 | 100 | globlastp |
| 1555 | LGD19 | peanut\|13v1\|CX018034 | — | 217 | 100 | globlastp |
| 1556 | LGD19 | peanut\|13v1\|EH043638 | — | 217 | 100 | globlastp |
| 1557 | LGD19 | peanut\|13v1\|SRR042421X194032_T1 | — | 217 | 98.44 | glotblastn |
| 1558 | LGD19 | clover\|14v1\|ERR351507S19XK19C237632_P1 | 4814 | 217 | 98.4 | globlastp |
| 1559 | LGD19 | clover\|14v1\|ERR351508S19XK19C466960_P1 | 4814 | 217 | 98.4 | globlastp |
| 1560 | LGD19 | peanut\|13v1\|SRR042421X110307_P1 | 4815 | 217 | 98.4 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1561 | LGD19 | peanut\|13v1\|SRR042421X110307 | — | 217 | 98.4 | globlastp |
| 1562 | LGD19 | vicia\|14v1\|FL503185_P1 | 4816 | 217 | 96.9 | globlastp |
| 1563 | LGD19 | chickpea\|13v2\|SRR133517.19305_P1 | 4817 | 217 | 96.9 | globlastp |
| 1564 | LGD19 | lupin\|13v4\|SRR520490.10776_P1 | 4818 | 217 | 96.9 | globlastp |
| 1565 | LGD19 | medicago\|13v1\|AW698603_P1 | 4816 | 217 | 96.9 | globlastp |
| 1566 | LGD19 | soybean\|13v2\|GLYMA07G00761 | 4819 | 217 | 96.9 | globlastp |
| 1567 | LGD19 | bean\|13v1\|CA899342_P1 | 4820 | 217 | 96.9 | globlastp |
| 1568 | LGD19 | chickpea\|13v2\|DY475173_P1 | 4817 | 217 | 96.9 | globlastp |
| 1569 | LGD19 | cowpea\|12v1\|FG891394_P1 | 4821 | 217 | 95.3 | globlastp |
| 1570 | LGD19 | lupin\|13v4\|CA410831_P1 | 4822 | 217 | 95.3 | globlastp |
| 1571 | LGD19 | soybean\|13v2\|GLYMA20G11122 | 4823 | 217 | 95.3 | globlastp |
| 1572 | LGD19 | cyamopsis\|10v1\|EG974920_T1 | 4824 | 217 | 93.75 | glotblastn |
| 1573 | LGD19 | peanut\|13v1\|SRR057709X28772_T1 | — | 217 | 93.75 | glotblastn |
| 1574 | LGD19 | lupin\|13v4\|FG090447_P1 | 4825 | 217 | 92.2 | globlastp |
| 1575 | LGD19 | cacao\|13v1\|CU474438_P1 | 4826 | 217 | 90.6 | globlastp |
| 1576 | LGD19 | melon\|10v1\|DV634392_P1 | 4827 | 217 | 90.6 | globlastp |
| 1577 | LGD19 | triphysaria\|13v1\|SRR023500X124220 | 4828 | 217 | 90.6 | globlastp |
| 1578 | LGD19 | triphysaria\|13v1\|SRR023500X132574 | 4828 | 217 | 90.6 | globlastp |
| 1579 | LGD19 | triphysaria\|13v1\|SRR023500X13372 | 4828 | 217 | 90.6 | globlastp |
| 1580 | LGD19 | triphysaria\|13v1\|DR171571 | 4828 | 217 | 90.6 | globlastp |
| 1581 | LGD19 | monkeyflower\|12v1\|DV209526_P1 | 4829 | 217 | 90.6 | globlastp |
| 1582 | LGD19 | phyla\|11v2\|SRR099038X76130_P1 | 4830 | 217 | 90.6 | globlastp |
| 1583 | LGD19 | b_oleracea\|14v1\|DW998592_P1 | 4831 | 217 | 89.1 | globlastp |
| 1584 | LGD19 | triphysaria\|13v1\|EX982507 | 4832 | 217 | 89.1 | globlastp |
| 1585 | LGD19 | thellungiella_halophilum\|13v1\|BY814668 | 4831 | 217 | 89.1 | globlastp |
| 1586 | LGD19 | soybean\|13v2\|GLYMA14G17863P1 | 4833 | 217 | 88.41 | glotblastn |
| 1587 | LGD19 | b_juncea\|12v1\|E6ANDIZ01AL5MQ_P1 | 4834 | 217 | 87.5 | globlastp |
| 1588 | LGD19 | blueberry\|12v1\|SRR353282X101719D1_P1 | 4835 | 217 | 87.5 | globlastp |
| 1589 | LGD19 | blueberry\|12v1\|SRR353282X11210D1_P1 | 4835 | 217 | 87.5 | globlastp |
| 1590 | LGD19 | blueberry\|12v1\|SRR353282X37151D1_P1 | 4835 | 217 | 87.5 | globlastp |
| 1591 | LGD19 | cucumber\|09v1\|CO996177_P1 | 4836 | 217 | 87.5 | globlastp |
| 1592 | LGD19 | papaya\|gb165\|EX252172_P1 | 4837 | 217 | 87.5 | globlastp |
| 1593 | LGD19 | peanut\|13v1\|SRR042419X207174_T1 | 4838 | 217 | 87.5 | glotblastn |
| 1594 | LGD19 | triphysaria\|13v1\|SRR023500X102562 | 4839 | 217 | 87.5 | globlastp |
| 1595 | LGD19 | triphysaria\|13v1\|SRR023500X118601 | 4840 | 217 | 87.5 | globlastp |
| 1596 | LGD19 | bruguiera\|gb166\|BP939355_P1 | 4841 | 217 | 87.5 | globlastp |
| 1597 | LGD19 | basilicum\|13v1\|DY325883_P1 | 4842 | 217 | 87.5 | globlastp |
| 1598 | LGD19 | onion\|14v1\|SRR073446X301055D1_T1 | 4843 | 217 | 85.94 | glotblastn |
| 1599 | LGD19 | b_juncea\|12v1\|E6ANDIZ01AK3SF_T1 | 4844 | 217 | 85.94 | glotblastn |
| 1600 | LGD19 | b_oleracea\|14v1\|CA991716_P1 | 4845 | 217 | 85.9 | globlastp |
| 1601 | LGD19 | b_oleracea\|14v1\|CN731983_P1 | 4845 | 217 | 85.9 | globlastp |
| 1602 | LGD19 | onion\|14v1\|ALLC13V1K19C774195_P1 | 4846 | 217 | 85.9 | globlastp |
| 1603 | LGD19 | onion\|14v1\|BQ580005_P1 | 4847 | 217 | 85.9 | globlastp |
| 1604 | LGD19 | onion\|14v1\|SRR073446X101146D1_P1 | 4847 | 217 | 85.9 | globlastp |
| 1605 | LGD19 | onion\|14v1\|SRR073446X101370D1_P1 | 4847 | 217 | 85.9 | globlastp |
| 1606 | LGD19 | onion\|14v1\|SRR073446X212927D1_P1 | 4847 | 217 | 85.9 | globlastp |
| 1607 | LGD19 | parsley\|14v1\|BSS12K19C1039218_P1 | 4848 | 217 | 85.9 | globlastp |
| 1608 | LGD19 | arabidopsis\|13v2\|AT1G15270_P1 | 4849 | 217 | 85.9 | globlastp |
| 1609 | LGD19 | b_juncea\|12v1\|E6ANDIZ01C9FTC_P1 | 4845 | 217 | 85.9 | globlastp |
| 1610 | LGD19 | cucurbita\|11v1\|SRR091277X110746_P1 | 4850 | 217 | 85.9 | globlastp |
| 1611 | LGD19 | cucurbita\|11v1\|SRR091277X111404_P1 | 4850 | 217 | 85.9 | globlastp |
| 1612 | LGD19 | cucurbita\|11v1\|SRR091277X125252_P1 | 4850 | 217 | 85.9 | globlastp |
| 1613 | LGD19 | gossypium_raimondii\|13v1\|AW187456_P1 | 4851 | 217 | 85.9 | globlastp |
| 1614 | LCD19 | momordica\|10v1\|SRR071315S0009253_P1 | 4852 | 217 | 85.9 | globlastp |
| 1615 | LGD19 | onion\|12v1\|BQ580005 | 4847 | 217 | 85.9 | globlastp |
| 1616 | LGD19 | onion\|12v1\|SRR073446X101146D1 | 4847 | 217 | 85.9 | globlastp |
| 1617 | LGD19 | onion\|12v1\|SRR073446X110129D1 | 4847 | 217 | 85.9 | globlastp |
| 1618 | LGD19 | onion\|12v1\|SRR073446X167044D1 | 4847 | 217 | 85.9 | globlastp |
| 1619 | LGD19 | onion\|12v1\|SRR073446X208382D1 | 4847 | 217 | 85.9 | globlastp |
| 1620 | LGD19 | platanus\|11v1\|SRR096786X122982_P1 | 4853 | 217 | 85.9 | globlastp |
| 1621 | LGD19 | prunus_mume\|13v1\|BU042914 | 4854 | 217 | 85.9 | globlastp |
| 1622 | LGD19 | thellungiella_parvulum\|13v1\|BY814668 | 4845 | 217 | 85.9 | globlastp |
| 1623 | LGD19 | watermelon\|11v1\|BTM04705034172358 | 4855 | 217 | 85.9 | globlastp |
| 1624 | LGD19 | arabidopsis_lyrata\|13v1\|AA720043_P1 | 4849 | 217 | 85.9 | globlastp |
| 1625 | LGD19 | radish\|gb164\|EV566491 | 4845 | 217 | 85.9 | globlastp |
| 1626 | LGD19 | radish\|gb164\|FD968152 | 4845 | 217 | 85.9 | globlastp |
| 1627 | LGD19 | sesame\|12v1\|BU668569 | 4856 | 217 | 85.9 | globlastp |
| 1628 | LGD19 | radish\|gb164\|EV528224 | 4857 | 217 | 85.9 | globlastp |
| 1629 | LGD19 | poplar\|13v1\|AI163654_P1 | 4858 | 217 | 85.9 | globlastp |
| 1630 | LGD19 | chestnut\|14v1\|SRR006295X103362D1_P1 | 4859 | 217 | 85.9 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1631 | LGD19 | carrot|14v1|BSS10K19C12663__P1 | 4860 | 217 | 84.4 | globlastp |
| 1632 | LGD19 | carrot|14v1|BSS10K19C18308__P1 | 4860 | 217 | 84.4 | globlastp |
| 1633 | LGD19 | carrot|14v1|BSS10K19C3530__P1 | 4860 | 217 | 84.4 | globlastp |
| 1634 | LGD19 | carrot|14v1|BSS10K19C56421__P1 | 4860 | 217 | 84.4 | globlastp |
| 1635 | LGD19 | carrot|14v1|BSS10K19C73540__P1 | 4860 | 217 | 84.4 | globlastp |
| 1636 | LGD19 | carrot|14v1|BSS11K35C73270__P1 | 4860 | 217 | 84.4 | globlastp |
| 1637 | LGD19 | carrot|14v1|BSS8K19C126995__P1 | 4860 | 217 | 84.4 | globlastp |
| 1638 | LGD19 | carrot|14v1|JG766866__P1 | 4860 | 217 | 84.4 | globlastp |
| 1639 | LGD19 | onion|14v1|SRR073446X110820D1__P1 | 4861 | 217 | 84.4 | globlastp |
| 1640 | LGD19 | parsley|14v1|BSS12K19C378673__P1 | 4860 | 217 | 84.4 | globlastp |
| 1641 | LGD19 | cucurbita|11v1|SRR091276X104877__P1 | 4862 | 217 | 84.4 | globlastp |
| 1642 | LGD19 | ginseng|13v1|SRR547977.121957__P1 | 4863 | 217 | 84.4 | globlastp |
| 1643 | LGD19 | monkeyflower|12v1|SRR037227.110601__P1 | 4864 | 217 | 84.4 | globlastp |
| 1644 | LGD19 | nasturtium|11v1|GH162110__P1 | 4865 | 217 | 84.4 | globlastp |
| 1645 | LGD19 | onion|12v1|SRR073446X110820D1 | 4861 | 217 | 84.4 | globlastp |
| 1646 | LGD19 | ginseng|13v1|GR873071__P1 | 4863 | 217 | 84.4 | globlastp |
| 1647 | LGD19 | basilicum|13v1|DY322210__P1 | 4866 | 217 | 84.4 | globlastp |
| 1648 | LGD19 | onion|14v1|SRR073446X172704D1__T1 | 4867 | 217 | 84.38 | glotblastn |
| 1649 | LGD19 | ginseng|13v1|SRR547977.282611__T1 | 4868 | 217 | 84.38 | glotblastn |
| 1650 | LGD19 | ginseng|13v1|SRR547977.112191__T1 | — | 217 | 84.38 | glotblastn |
| 1651 | LGD19 | onion|14v1|SRR073446X328558D1__T1 | 4869 | 217 | 82.81 | glotblastn |
| 1652 | LGD19 | spurge|gb161|DV146098 | 4870 | 217 | 82.81 | glotblastn |
| 1653 | LGD19 | banana|14v1|DN239162__P1 | 4871 | 217 | 82.8 | globlastp |
| 1654 | LGD19 | castorbean|14v2|EE260650__P1 | 4872 | 217 | 82.8 | globlastp |
| 1655 | LGD19 | cyclamen|14v1|B14ROOTK19C103714__P1 | 4873 | 217 | 82.8 | globlastp |
| 1656 | LGD19 | echinochloa|14v1|SRR522894X51844D1__P1 | 4874 | 217 | 82.8 | globlastp |
| 1657 | LGD19 | onion|14v1|ALLC13V1K19C678218__P1 | 4875 | 217 | 82.8 | globlastp |
| 1658 | LGD19 | pineapple|14v1|ACOM14V1K19C1451528__P1 | 4873 | 217 | 82.8 | globlastp |
| 1659 | LGD19 | cycas|gb166|CB089851__P1 | 4876 | 217 | 82.8 | globlastp |
| 1660 | LGD19 | echinacea|13v1|EPURP13V12497682__P1 | 4877 | 217 | 82.8 | globlastp |
| 1661 | LGD19 | eschscholzia|11v1|SRR014116.104612__P1 | 4878 | 217 | 82.8 | globlastp |
| 1662 | LGD19 | eschscholzia|11v1|SRR014116.114999__P1 | 4879 | 217 | 82.8 | globlastp |
| 1663 | LGD19 | ginseng|13v1|SRR547977.10373__P1 | 4880 | 217 | 82.8 | globlastp |
| 1664 | LGD19 | ginseng|13v1|SRR547985.441654__P1 | 4880 | 217 | 82.8 | globlastp |
| 1665 | LGD19 | oil_palm|11v1|EL691353__P1 | 4881 | 217 | 82.8 | globlastp |
| 1666 | LGD19 | watermelon|11v1|CO996177 | 4882 | 217 | 82.8 | globlastp |
| 1667 | LGD19 | walnuts|gb166|CV195464 | 4883 | 217 | 82.8 | globlastp |
| 1668 | LGD19 | banana|12v1|DN239342 | 4884 | 217 | 82.8 | globlastp |
| 1669 | LGD19 | lettuce|12v1|DW049157__P1 | 4885 | 217 | 82.8 | globlastp |
| 1670 | LGD19 | tamarix|gb166|EG967706 | 4886 | 217 | 82.8 | globlastp |
| 1671 | LGD19 | banana|12v1|DN239162 | 4871 | 217 | 82.8 | globlastp |
| 1672 | LGD19 | olea|13v1|SRR014463X10998D1__P1 | 4887 | 217 | 82.8 | globlastp |
| 1673 | LGD19 | lettuce|12v1|DW045542__P1 | 4885 | 217 | 82.8 | globlastp |
| 1674 | LGD19 | coconut|14v1|JG390744__T1 | 4888 | 217 | 81.25 | glotblastn |
| 1675 | LGD19 | humulus|11v1|CO653667__T1 | 4889 | 217 | 81.25 | glotblastn |
| 1676 | LGD19 | onion|12v1|SRR073446X155731D1 | 4890 | 217 | 81.25 | glotblastn |
| 1677 | LGD19 | onion|12v1|SRR073446X440569D1 | 4891 | 217 | 81.25 | glotblastn |
| 1678 | LGD19 | sarracenia|11v1|SRR192669.157242 | 4892 | 217 | 81.25 | glotblastn |
| 1679 | LGD19 | chrysanthemum|14v1|SRR290491X101293D1__P1 | 4893 | 217 | 81.2 | globlastp |
| 1680 | LGD19 | chichorium|14v1|EH698997__P1 | 4894 | 217 | 81.2 | globlastp |
| 1681 | LGD19 | coconut|14v1|COCOS14V1K19C1291288__P1 | 4895 | 217 | 81.2 | globlastp |
| 1682 | LGD19 | coconut|14v1|COCOS14V1K19C685497__P1 | 4896 | 217 | 81.2 | globlastp |
| 1683 | LGD19 | echinochloa|14v1|SRR522894X15704D1__P1 | 4897 | 217 | 81.2 | globlastp |
| 1684 | LGD19 | echinochloa|14v1|SRR522894X176D1__P1 | 4897 | 217 | 81.2 | globlastp |
| 1685 | LGD19 | foxtail_millet|14v1|JK564661__P1 | 4898 | 217 | 81.2 | globlastp |
| 1686 | LGD19 | arabidopsis|13v2|AT3G16040__P1 | 4899 | 217 | 81.2 | globlastp |
| 1687 | LGD19 | echinacea|13v1|EPURP13V11448437__P1 | 4900 | 217 | 81.2 | globlastp |
| 1688 | LGD19 | euphorbia|11v1|DV146098__P1 | 4901 | 217 | 81.2 | globlastp |
| 1689 | LGD19 | ginseng|13v1|GR873371__P1 | 4902 | 217 | 81.2 | globlastp |
| 1690 | LGD19 | grape|13v1|GSVIVT01017091001__P1 | 4903 | 217 | 81.2 | globlastp |
| 1691 | LGD19 | hevea|10v1|EC608031__P1 | 4904 | 217 | 81.2 | globlastp |
| 1692 | LGD19 | maize|13v2|AI901386__P1 | 4898 | 217 | 81.2 | globlastp |
| 1693 | LGD19 | olea|13v1|SRR014463X10408D1__P1 | 4905 | 217 | 81.2 | globlastp |
| 1694 | LGD19 | olea|13v1|SRR014463X10553D1__P1 | 4905 | 217 | 81.2 | globlastp |
| 1695 | LGD19 | olea|13v1|SRR014463X10772D1__P1 | 4905 | 217 | 81.2 | globlastp |
| 1696 | LGD19 | olea|13v1|SRR014464X14768D1__P1 | 4906 | 217 | 81.2 | globlastp |
| 1697 | LGD19 | olea|13v1|SRR592583X104042D1__P1 | 4906 | 217 | 81.2 | globlastp |
| 1698 | LGD19 | maize|13v2|T18674__P1 | 4897 | 217 | 81.2 | globlastp |
| 1699 | LGD19 | foxtail_millet|13v2|SRR350548X100110 | 4898 | 217 | 81.2 | globlastp |
| 1700 | LGD19 | lovegrass|gb167|EH186316__P1 | 4907 | 217 | 81.2 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1701 | LGD19 | sorghum\|13v2\|BE364183 | 4898 | 217 | 81.2 | globlastp |
| 1702 | LGD19 | switchgrass\|12v1\|FE622613 | 4908 | 217 | 81.2 | globlastp |
| 1703 | LGD19 | switchgrass\|12v1\|FL710955 | 4909 | 217 | 81.2 | globlastp |
| 1704 | LGD19 | zostera\|12v1\|AM766369 | 4910 | 217 | 81.2 | globlastp |
| 1705 | LGD19 | spurge\|gb161\|DV119597 | 4911 | 217 | 81.2 | globlastp |
| 1706 | LGD19 | cichorium\|14v1\|DT212035_P1 | 4894 | 217 | 81.2 | globlastp |
| 1707 | LGD19 | banana\|14v1\|DN239342_P1 | 4912 | 217 | 81.2 | globlastp |
| 1708 | LGD19 | pineapple\|14v1\|CO731246_P1 | 4913 | 217 | 81.2 | globlastp |
| 1709 | LGD19 | cichorium\|14v1\|FL679916_P1 | 4894 | 217 | 81.2 | globlastp |
| 1710 | LGD20 | soybean\|13v2\|GLYMA18G01580 | 4914 | 218 | 99.8 | globlastp |
| 1711 | LGD20 | bean\|13v1\|CA898352_P1 | 4915 | 218 | 97 | globlastp |
| 1712 | LGD20 | peanut\|13v1\|EE126045_P1 | 4916 | 218 | 96.1 | globlastp |
| 1713 | LGD20 | peanut\|13v1\|GO330342_T1 | 4917 | 218 | 95.7 | glotblastn |
| 1714 | LGD20 | clover\|14v1\|ERR351507S19XK19C166176_P1 | 4918 | 218 | 94.8 | globlastp |
| 1715 | LGD20 | clover\|14v1\|ERR351507S19XK19C769668_P1 | 4918 | 218 | 94.8 | globlastp |
| 1716 | LGD20 | clover\|14v1\|ERR351507S29XK29C114203_P1 | 4918 | 218 | 94.8 | globlastp |
| 1717 | LGD20 | lupin\|13v4\|SRR520491.1026651_P1 | 4919 | 218 | 94.6 | globlastp |
| 1718 | LGD20 | tomato\|13v1\|BG129608 | 4920 | 218 | 94.2 | globlastp |
| 1719 | LGD20 | medicago\|13v1\|AW256519_P1 | 4921 | 218 | 93.8 | globlastp |
| 1720 | LGD20 | lupin\|13v4\|FG093478_P1 | 4922 | 218 | 93.6 | globlastp |
| 1721 | LGD20 | cacao\|13v1\|CA796831_P1 | 4923 | 218 | 93.3 | globlastp |
| 1722 | LGD20 | pepper\|14v1\|BM061690_P1 | 4924 | 218 | 93.1 | globlastp |
| 1723 | LGD20 | gossypium_raimondii\|13v1\|AI054652_P1 | 4925 | 218 | 93.1 | globlastp |
| 1724 | LGD20 | chestnut\|14v1\|SRR006295X100414D1_P1 | 4926 | 218 | 92.9 | globlastp |
| 1725 | LGD20 | grape\|13v1\|GSVIVT01020856001_P1 | 4927 | 218 | 92.9 | globlastp |
| 1726 | LGD20 | castorbean\|14v2\|T15265_P1 | 4928 | 218 | 92.7 | globlastp |
| 1727 | LGD20 | ginseng\|13v1\|JK985176_P1 | 4929 | 218 | 92.7 | globlastp |
| 1728 | LGD20 | basilicum\|13v1\|DY340253_P1 | 4930 | 218 | 92.5 | globlastp |
| 1729 | LGD20 | ginseng\|13v1\|CN846371_P1 | 4931 | 218 | 92.5 | globlastp |
| 1730 | LGD20 | ginseng\|13v1\|ES673143_P1 | 4932 | 218 | 92.5 | globlastp |
| 1731 | LGD20 | liriodendron\|gb166\|CK755344_P1 | 4933 | 218 | 92.5 | globlastp |
| 1732 | LGD20 | gossypium_raimondii\|13v1\|AI725994_P1 | 4934 | 218 | 92.5 | globlastp |
| 1733 | LGD20 | gossypium_raimondii\|13v1\|DT557120_P1 | 4935 | 218 | 92.3 | globlastp |
| 1734 | LGD20 | coconut\|14v1\|COCOS14V1K19C1293463_P1 | 4936 | 218 | 92.1 | globlastp |
| 1735 | LGD20 | lupin\|13v4\|SRR520490.65646_P1 | 4937 | 218 | 92.1 | globlastp |
| 1736 | LGD20 | carrot\|14v1\|BSS10K19C121718_P1 | 4938 | 218 | 91.8 | globlastp |
| 1737 | LGD20 | pineapple\|14v1\|ACOM14V1K19C1635019_P1 | 4939 | 218 | 91.8 | globlastp |
| 1738 | LGD20 | pineapple\|14v1\|ACOM14V1K40C113933_P1 | 4939 | 218 | 91.8 | globlastp |
| 1739 | LGD20 | centaurea\|11v1\|EH715275_P1 | 4940 | 218 | 91.8 | globlastp |
| 1740 | LGD20 | centaurea\|11v1\|EH755528_P1 | 4940 | 218 | 91.8 | globlastp |
| 1741 | LGD20 | parsley\|14v1\|BSS12K19C1057878_P1 | 4941 | 218 | 91.6 | globlastp |
| 1742 | LGD20 | sorghum\|13v2\|AW282750 | 4942 | 218 | 91.6 | globlastp |
| 1743 | LGD20 | foxtail_millet\|13v2\|SRR350548X105913 | 4943 | 218 | 91.6 | globlastp |
| 1744 | LGD20 | foxtail_millet\|14v1\|JK553283_P1 | 4943 | 218 | 91.6 | globlastp |
| 1745 | LGD20 | triphysaria\|13v1\|BM357149 | 4944 | 218 | 91.6 | globlastp |
| 1746 | LGD20 | coconut\|14v1\|COCOS14V1K23C319676_P1 | 4945 | 218 | 91.4 | globlastp |
| 1747 | LGD20 | triphysaria\|13v1\|EX988460 | 4946 | 218 | 91.4 | glotblastn |
| 1748 | LGD20 | safflower\|gb162\|EL375744 | 4947 | 218 | 91.4 | globlastp |
| 1749 | LGD20 | amaranthus\|13v1\|SRR039408X10628D1_P1 | 4948 | 218 | 91.2 | globlastp |
| 1750 | LGD20 | rice\|13v2\|AA753506 | 4949 | 218 | 91.2 | globlastp |
| 1751 | LGD20 | cichorium\|14v1\|EL364327_P1 | 4950 | 218 | 91 | globlastp |
| 1752 | LGD20 | echinochloa\|14v1\|SRR522894X128078D1_P1 | 4951 | 218 | 91 | globlastp |
| 1753 | LGD20 | echinochloa\|14v1\|SRR522894X1456D1_P1 | 4952 | 218 | 91 | globlastp |
| 1754 | LGD20 | echinochloa\|14v1\|SRR522894X161593D1_P1 | 4952 | 218 | 91 | globlastp |
| 1755 | LGD20 | cenchrus\|13v1\|EB653919_P1 | 4953 | 218 | 91 | globlastp |
| 1756 | LGD20 | foxtail_millet\|13v2\|SRR350548X10524 | 4954 | 218 | 91 | globlastp |
| 1757 | LGD20 | foxtail_millet\|14v1\|JK565335_P1 | 4954 | 218 | 91 | globlastp |
| 1758 | LGD20 | cichorium\|14v1\|CII14V1K19C156791_P1 | 4955 | 218 | 90.8 | globlastp |
| 1759 | LGD20 | b_oleracea\|14v1\|DY006806_P1 | 4956 | 218 | 90.7 | globlastp |
| 1760 | LGD20 | brachypodium\|13v2\|BRADI3G33860 | 4957 | 218 | 90.7 | globlastp |
| 1761 | LGD20 | brachypodium\|14v1\|DV484754_P1 | 4957 | 218 | 90.7 | globlastp |
| 1762 | LGD20 | maize\|13v2\|AA979999_P1 | 4958 | 218 | 90.7 | globlastp |
| 1763 | LGD20 | thellungiella_parvulum\|13v1\|DN774318 | 4959 | 218 | 90.7 | globlastp |
| 1764 | LGD20 | sorghum\|13v2\|AI724638 | 4960 | 218 | 90.7 | globlastp |
| 1765 | LGD20 | thellungiella_halophilum\|13v1\|DN774318 | 4959 | 218 | 90.7 | globlastp |
| 1766 | LGD20 | radish\|gb164\|EW731499 | 4961 | 218 | 90.5 | globlastp |
| 1767 | LGD20 | b_oleracea\|14v1\|CN735656_P1 | 4962 | 218 | 90.3 | globlastp |
| 1768 | LGD20 | banana\|14v1\|BBS440T3_P1 | 4963 | 218 | 90.3 | globlastp |
| 1769 | LGD20 | arabidopsis\|13v2\|AT1G24510_P1 | 4964 | 218 | 90.3 | globlastp |
| 1770 | LGD20 | b_oleracea\|14v1\|EE518468_P1 | 4965 | 218 | 90.1 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1771 | LGD20 | cichorium\|14v1\|EH673881_P1 | 4966 | 218 | 90.1 | globlastp |
| 1772 | LGD20 | maize\|13v2\|AI932058_P1 | 4967 | 218 | 90.1 | globlastp |
| 1773 | LGD20 | cichorium\|14v1\|CII14V1K19S003069_P1 | 4966 | 218 | 90.1 | globlastp |
| 1774 | LGD20 | chrysanthemum\|14v1\|CCOR13V1K19C1518012_P1 | 4968 | 218 | 89.9 | globlastp |
| 1775 | LGD20 | chrysanthemum\|14v1\|SRR525216X66257D1_P1 | 4968 | 218 | 89.9 | globlastp |
| 1776 | LGD20 | chrysanthemum\|14v1\|SRR797216S19XK19C110181_P1 | 4969 | 218 | 89.7 | globlastp |
| 1777 | LGD20 | echinacea\|13v1\|EPURP13V12186867_P1 | 4970 | 218 | 89.6 | globlastp |
| 1778 | LGD20 | chrysanthemum\|14v1\|SRR290491X105177D1_P1 | 4971 | 218 | 89.5 | globlastp |
| 1779 | LGD20 | brachypodium\|13v2\|BRADI1G37790 | 4972 | 218 | 89.5 | globlastp |
| 1780 | LGD20 | brachypodium\|14v1\|DV475418_P1 | 4972 | 218 | 89.5 | globlastp |
| 1781 | LGD20 | banana\|14v1\|FF558852_P1 | 4973 | 218 | 89.3 | globlastp |
| 1782 | LGD20 | echinacea\|13v1\|EPURP13V1451162_P1 | 4974 | 218 | 89.3 | globlastp |
| 1783 | LGD20 | quinoa\|13v2\|SRR315568X493052 | 4975 | 218 | 89.3 | globlastp |
| 1784 | LGD20 | chrysanthemum\|14v1\|SRR525216X19569D1_P1 | 4976 | 218 | 89.2 | globlastp |
| 1785 | LGD20 | onion\|14v1\|SRR073446X106322D1_P1 | 4977 | 218 | 89.2 | globlastp |
| 1786 | LGD20 | onion\|14v1\|SRR073446X113582D1_P1 | 4978 | 218 | 89.2 | globlastp |
| 1787 | LGD20 | fescue\|13v1\|CK801053_P1 | 4979 | 218 | 89.2 | globlastp |
| 1788 | LGD20 | cichorium\|14v1\|EH703370_P1 | 4980 | 218 | 88.6 | globlastp |
| 1789 | LGD20 | oat\|14v1\|CN815217_P1 | 4981 | 218 | 88.6 | globlastp |
| 1790 | LGD20 | vicia\|14v1\|HX905681_P1 | 4982 | 218 | 88.6 | globlastp |
| 1791 | LGD20 | fescue\|13v1\|DT686392_P1 | 4983 | 218 | 88.6 | globlastp |
| 1792 | LGD20 | lolium\|13v1\|DT669600_P1 | 4983 | 218 | 88.6 | globlastp |
| 1793 | LGD20 | quinoa\|13v2\|SRR315568X11981 | 4984 | 218 | 88.6 | globlastp |
| 1794 | LGD20 | onion\|14v1\|SRR073446X237373D1_T1 | 4985 | 218 | 88.41 | glotblastn |
| 1795 | LGD20 | centaurea\|11v1\|EH743369_T1 | 4986 | 218 | 88.41 | glotblastn |
| 1796 | LGD20 | onion\|14v1\|SRR073446X113522D1_P1 | 4987 | 218 | 88.4 | globlastp |
| 1797 | LGD20 | onion\|14v1\|SRR073446X133866D1_P1 | 4988 | 218 | 88.4 | globlastp |
| 1798 | LGD20 | oat\|14v1\|GR334940_T1 | 4989 | 218 | 88.22 | glotblastn |
| 1799 | LGD20 | onion\|14v1\|SRR073446X462890D1_P1 | 4990 | 218 | 88.2 | globlastp |
| 1800 | LGD20 | oat\|14v1\|CN817660_P1 | 4991 | 218 | 88 | globlastp |
| 1801 | LGD20 | oat\|14v1\|SRR020744X169055D1_P1 | 4991 | 218 | 88 | globlastp |
| 1802 | LGD20 | oat\|14v1\|X75777_P1 | 4991 | 218 | 88 | globlastp |
| 1803 | LGD20 | oat\|14v1\|GR334939_P1 | 4992 | 218 | 87.9 | globlastp |
| 1804 | LGD20 | onion\|14v1\|SRR073446X15985D1_P1 | 4993 | 218 | 87.9 | globlastp |
| 1805 | LGD20 | onion\|14v1\|SRR073446X163151D1_P1 | 4994 | 218 | 87.9 | globlastp |
| 1806 | LGD20 | onion\|14v1\|SRR073446X858383D1_P1 | 4995 | 218 | 87.7 | globlastp |
| 1807 | LGD20 | chrysanthemum\|14v1\|SRR525216X89879D1_P1 | 4996 | 218 | 87.5 | globlastp |
| 1808 | LGD20 | centaurea\|11v1\|EH713231_P1 | 4997 | 218 | 85.4 | globlastp |
| 1809 | LGD20 | physcomitrella\|13v1\|AW145268_P1 | 4998 | 218 | 84.9 | globlastp |
| 1810 | LGD20 | chrysanthemum\|14v1\|SRR525216X13493D1_P1 | 4999 | 218 | 84 | globlastp |
| 1811 | LGD20 | pineapple\|14v1\|ACOM14V1K19C148090_T1 | 5000 | 218 | 82.24 | glotblastn |
| 1812 | LGD20 | oat\|14v1\|GR364981_P1 | 5001 | 218 | 82.2 | globlastp |
| 1813 | LGD20 | cichorium\|14v1\|CII14V1K29C37161_P1 | 5002 | 218 | 81.9 | globlastp |
| 1814 | LGD20 | pineapple\|14v1\|ACOM14V1K19C150252_T1 | 5003 | 218 | 80.56 | glotblastn |
| 1815 | LGD20 | chrysanthemum\|14v1\|SRR525216X25571D1_P1 | 5004 | 218 | 80.2 | globlastp |
| 1816 | LGD21 | pigeonpea\|11v1\|SRR054580X10842_P1 | 5005 | 219 | 90.6 | globlastp |
| 1817 | LGD21 | bean\|13v1\|FG233192_P1 | 5006 | 219 | 88.3 | globlastp |
| 1818 | LGD21 | medicago\|13v1\|AW559710_P1 | 5007 | 219 | 85.4 | globlastp |
| 1819 | LGD21 | chickpea\|13v2\|GR394709_P1 | 5008 | 219 | 85.3 | globlastp |
| 1820 | LGD21 | clover\|14v1\|ERR351507S40XK40C78732_P1 | 5009 | 219 | 85 | globlastp |
| 1821 | LGD21 | clover\|14v1\|ERR351507S19XK19C658311_P1 | 5010 | 219 | 82.5 | globlastp |
| 1822 | LGD21 | lupin\|13v4\|SRR520490.102106_T1 | 5011 | 219 | 80.74 | glotblastn |
| 1823 | LGD23 | soybean\|13v2\|GLYMA10G23790 | 5012 | 220 | 95.8 | globlastp |
| 1824 | LGD23 | bean\|13v1\|PVU72663_P1 | 5013 | 220 | 94.2 | globlastp |
| 1825 | LGD23 | cowpea\|12v1\|FF382994_P1 | 5014 | 220 | 94.2 | globlastp |
| 1826 | LGD23 | pigeonpea\|11v1\|SRR054580X128588_P1 | 5015 | 220 | 90.7 | globlastp |
| 1827 | LGD23 | lotus\|09v1\|AW720314_P1 | 5016 | 220 | 83.5 | globlastp |
| 1828 | LGD23 | chickpea\|13v2\|AJ133715_P1 | 5017 | 220 | 82.3 | globlastp |
| 1829 | LGD23 | clover\|14v1\|ERR351507S23XK23C143808_P1 | 5018 | 220 | 81.3 | globlastp |
| 1830 | LGD23 | clover\|14v1\|ERR351507S19XK19C220874_P1 | 5019 | 220 | 81 | globlastp |
| 1831 | LGD23 | clover\|14v1\|ERR351507S19XK19C223734_P1 | 5020 | 220 | 81 | globlastp |
| 1832 | LGD23 | clover\|14v1\|FY455481_T1 | 5021 | 220 | 80.65 | glotblastn |
| 1833 | LGD23 | medicago\|13v1\|AB028149_P1 | 5022 | 220 | 80.6 | globlastp |
| 1834 | LGD23 | peanut\|13v1\|EE126217_P1 | 5023 | 220 | 80.6 | globlastp |
| 1835 | LGD23 | peanut\|13v1\|ES706929_P1 | 5024 | 220 | 80.6 | globlastp |
| 1836 | LGD23 | peanut\|13v1\|ES710706_P1 | 5023 | 220 | 80.6 | globlastp |
| 1837 | LGD23 | trigonella\|11v1\|SRR066194X443474 | 5025 | 220 | 80.32 | glotblastn |
| 1838 | LGD23 | lupin\|13v4\|DT454378_P1 | 5026 | 220 | 80.3 | globlastp |
| 1839 | LGD24 | potato\|10v1\|BE922423_P1 | 5027 | 221 | 96.8 | globlastp |
| 1840 | LGD24 | solanum_phureja\|09v1\|SPHAF233745 | 5027 | 221 | 96.8 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1841 | LGD24 | eggplant\|10v1\|FS070678_P1 | 5028 | 221 | 93.7 | globlastp |
| 1842 | LGD24 | pepper\|12v1\|CA517600 | 5029 | 221 | 92.1 | globlastp |
| 1843 | LGD24 | tobacco\|gb162\|EB424667 | 5030 | 221 | 91.3 | globlastp |
| 1844 | LGD24 | nicotiana_benthamiana\|12v1\|CN747852_P1 | 5031 | 221 | 89.3 | globlastp |
| 1845 | LGD24 | pepper\|14v1\|CA517600_P1 | 5032 | 221 | 86 | globlastp |
| 1846 | LGD24 | petunia\|gb171\|CV296341_P1 | 5033 | 221 | 85 | globlastp |
| 1847 | LGD24 | nicotiana_benthamiana\|12v1\|CN742228_P1 | 5034 | 221 | 84.2 | globlastp |
| 1848 | LGD24 | nicotiana_benthamiana\|12v1\|BP535443_P1 | 5035 | 221 | 83 | globlastp |
| 1849 | LGD24 | nicotiana_benthamiana\|12v1\|BP745706_P1 | 5036 | 221 | 83 | globlastp |
| 1850 | LGD24 | potato\|10v1\|AJ487439_P1 | 5037 | 221 | 82.6 | globlastp |
| 1851 | LGD24 | solanum_phureja\|09v1\|SPHBG125297 | 5038 | 221 | 81.8 | globlastp |
| 1852 | LGD24 | tomato\|13v1\|BG125297 | 5039 | 221 | 81.4 | globlastp |
| 1853 | LGD24 | tabernaemontana\|11v1\|SRR098689X101263 | 5040 | 221 | 81.2 | globlastp |
| 1854 | LGD24 | amsonia\|11v1\|SRR098688X105569_P1 | 5041 | 221 | 80.1 | globlastp |
| 1855 | LGD24 | sarracenia\|11v1\|SRR192669.102079 | 5042 | 221 | 80 | globlastp |
| 1856 | LGD26 | potato\|10v1\|BQ512820_P1 | 5043 | 223 | 97.8 | globlastp |
| 1857 | LGD26 | solanum_phureja\|09v1\|SPHAW219459 | 5044 | 223 | 96.3 | globlastp |
| 1858 | LGD26 | eggplant\|10v1\|FS013685_P1 | 5045 | 223 | 88.9 | globlastp |
| 1859 | LGD26 | petunia\|gb171\|FN000755_P1 | 5046 | 223 | 86.8 | globlastp |
| 1860 | LGD26 | tobacco\|gb162\|CV020977 | 5047 | 223 | 86 | globlastp |
| 1861 | LGD26 | nicotiana_benthamiana\|12v1\|CV020977_P1 | 5048 | 223 | 84.6 | globlastp |
| 1862 | LGD26 | nicotiana_benthamiana\|12v1\|EB444991_P1 | 5049 | 223 | 84.6 | globlastp |
| 1863 | LGD26 | pepper\|14v1\|CA516618_P1 | 5050 | 223 | 83.7 | globlastp |
| 1864 | LGD26 | pepper\|12v1\|CA516618 | 5050 | 223 | 83.7 | globlastp |
| 1867 | LGM4 | sorghum\|13v2\|CF487357 | 5053 | 225 | 98.9 | globlastp |
| 1868 | LGM4 | maize\|13v2\|AW017599_P1 | 5054 | 225 | 97.8 | globlastp |
| 1869 | LGM4 | switchgrass\|12v1\|FE636390 | 5055 | 225 | 97.2 | globlastp |
| 1870 | LGM4 | foxtail_millet\|13v2\|SRR350548X103618 | 5056 | 225 | 96.6 | globlastp |
| 1871 | LGM4 | foxtail_millet\|14v1\|JK594703_P1 | 5056 | 225 | 96.6 | globlastp |
| 1872 | LGM4 | echinochloa\|14v1\|SRR522894X115159D1_P1 | 5057 | 225 | 96.1 | globlastp |
| 1873 | LGM4 | sugarcane\|10v1\|CA077612 | 5058 | 225 | 95.51 | glotblastn |
| 1874 | LGM4 | echinochloa\|14v1\|SRR522894X229200D1_P1 | 5059 | 225 | 94.9 | globlastp |
| 1875 | LGM4 | rice\|13v2\|BE228750 | 5060 | 225 | 92.7 | globlastp |
| 1876 | LGM4 | millet\|10v1\|EVO454PM058815_P1 | 5061 | 225 | 90.4 | globlastp |
| 1877 | LGM4 | switchgrass\|12v1\|FL717785 | 5062 | 225 | 88.2 | globlastp |
| 1878 | LGM4 | brachypodium\|13v2\|BRADI2G07490 | 5063 | 225 | 87.6 | globlastp |
| 1879 | LGM4 | brachypodium\|14v1\|XM_003565776_P1 | 5063 | 225 | 87.6 | globlastp |
| 1880 | LGM4 | rye\|12v1\|DRR001012.10524 | 5064 | 225 | 86.5 | globlastp |
| 1881 | LGM4 | oat\|14v1\|CN817000_P1 | 5065 | 225 | 86 | globlastp |
| 1882 | LGM4 | oat\|14v1\|SRR020742X3530D1_P1 | 5066 | 225 | 86 | globlastp |
| 1883 | LGM4 | lolium\|13v1\|SRR029312X10533_P1 | 5067 | 225 | 86 | globlastp |
| 1884 | LGM4 | wheat\|12v3\|AW448835 | 5068 | 225 | 86 | globlastp |
| 1885 | LGM4 | switchgrass\|12v1\|DN142669 | 5069 | 225 | 84.8 | globlastp |
| 1886 | LGM4 | echinochloa\|14v1\|ECHC14V1K23C368882_P1 | 5070 | 225 | 82 | globlastp |
| 1887 | LGM5 | foxtail_millet\|13v2\|SRR350548X140521 | 5071 | 226 | 99.5 | globlastp |
| 1888 | LGM5 | foxtail_millet\|14v1\|JK580260_P1 | 5071 | 226 | 99.5 | globlastp |
| 1889 | LGM5 | millet\|10v1\|EVO454PM127880_P1 | 5071 | 226 | 99.5 | globlastp |
| 1890 | LGM5 | sorghum\|13v2\|BE919023 | 5072 | 226 | 99.5 | globlastp |
| 1891 | LGM5 | sugarcane\|10v1\|CA124005 | 5073 | 226 | 99.5 | globlastp |
| 1892 | LGM5 | switchgrass\|12v1\|FL731202 | 5071 | 226 | 99.5 | globlastp |
| 1893 | LGM5 | brachypodium\|13v2\|BRADI4G19670 | 5074 | 226 | 99 | globlastp |
| 1894 | LGM5 | brachypodium\|14v1\|GT776458_P1 | 5074 | 226 | 99 | globlastp |
| 1895 | LGM5 | sorghum\|13v2\|EH411931 | 5075 | 226 | 99 | globlastp |
| 1896 | LGM5 | sugarcane\|10v1\|BQ530095 | 5076 | 226 | 99 | globlastp |
| 1897 | LGM5 | switchgrass\|12v1\|DN143807 | 5077 | 226 | 99 | globlastp |
| 1898 | LGM5 | oat\|14v1\|GO587242_P1 | 5078 | 226 | 98.5 | globlastp |
| 1899 | LGM5 | fescue\|13v1\|GO796661_P1 | 5078 | 226 | 98.5 | globlastp |
| 1900 | LGM5 | lolium\|13v1\|SRR029311X6608_P1 | 5078 | 226 | 98.5 | globlastp |
| 1901 | LGM5 | pineapple\|14v1\|CO731497_P1 | 5079 | 226 | 97.9 | globlastp |
| 1902 | LGM5 | cynodon\|10v1\|ES292627_P1 | 5080 | 226 | 97.9 | globlastp |
| 1903 | LGM5 | oat\|11v1\|GO587242 | 5081 | 226 | 97.9 | globlastp |
| 1904 | LGM5 | pineapple\|10v1\|CO731497 | 5079 | 226 | 97.9 | globlastp |
| 1905 | LGM5 | rye\|12v1\|DRR001012.278993 | 5082 | 226 | 97.42 | glotblastn |
| 1906 | LGM5 | barley\|12v1\|BF259026_P1 | 5083 | 226 | 97.4 | globlastp |
| 1907 | LGM5 | pseudoroegneria\|gb167\|FF340470 | 5084 | 226 | 97.4 | globlastp |
| 1908 | LGM5 | rice\|13v2\|AU173173 | 5085 | 226 | 97.4 | globlastp |
| 1909 | LGM5 | rye\|12v1\|DRR001012.147425 | 5083 | 226 | 97.4 | globlastp |
| 1910 | LGM5 | rye\|12v1\|DRR001012.403462 | 5086 | 226 | 97.4 | globlastp |
| 1911 | LGM5 | wheat\|12v3\|BE400964 | 5087 | 226 | 96.9 | globlastp |
| 1912 | LGM5 | banana\|14v1\|FF557605_P1 | 5088 | 226 | 96.4 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1913 | LGM5 | banana\|12v1\|FF557605 | 5088 | 226 | 96.4 | globlastp |
| 1914 | LGM5 | rye\|12v1\|DRR001012.105745 | 5089 | 226 | 96.4 | globlastp |
| 1915 | LGM5 | wheat\|12v3\|AL819796 | 5090 | 226 | 96.4 | globlastp |
| 1916 | LGM5 | wheat\|12v3\|CA602332 | 5091 | 226 | 95.4 | globlastp |
| 1917 | LGM5 | phyla\|11v2\|SRR099035X101851_P1 | 5092 | 226 | 94.8 | globlastp |
| 1918 | LGM5 | centaurea\|11v1\|SRR346941.103112_T1 | 5093 | 226 | 94.33 | glotblastn |
| 1919 | LGM5 | coconut\|14v1\|COCOS14V1K19C1742349_P1 | 5094 | 226 | 94.3 | globlastp |
| 1920 | LGM5 | cassava\|09v1\|JGICASSAVA38046VALIDM1_P1 | 5095 | 226 | 94.3 | globlastp |
| 1921 | LGM5 | centaurea\|11v1\|EH716322_P1 | 5096 | 226 | 94.3 | globlastp |
| 1922 | LGM5 | centaurea\|11v1\|EH750899_P1 | 5096 | 226 | 94.3 | globlastp |
| 1923 | LGM5 | centaurea\|11v1\|EH778876_P1 | 5096 | 226 | 94.3 | globlastp |
| 1924 | LGM5 | cirsium\|11v1\|SRR346952.1015362_P1 | 5096 | 226 | 94.3 | globlastp |
| 1925 | LGM5 | cynara\|gb167\|GE586252_P1 | 5097 | 226 | 94.3 | globlastp |
| 1926 | LGM5 | oil_palm\|11v1\|EL688624_P1 | 5094 | 226 | 94.3 | globlastp |
| 1927 | LGM5 | sesame\|12v1\|SESI12V1400035 | 5098 | 226 | 94.3 | globlastp |
| 1928 | LGM5 | cichorium\|14v1\|CII14V1K19C851803_P1 | 5099 | 226 | 93.8 | globlastp |
| 1929 | LGM5 | echinochloa\|14v1\|SRR522894X135194D1_P1 | 5100 | 226 | 93.8 | globlastp |
| 1930 | LGM5 | aristolochia\|10v1\|FD757924_P1 | 5101 | 226 | 93.8 | globlastp |
| 1931 | LGM5 | cassava\|09v1\|JGICASSAVA12198VALIDM1_P1 | 5102 | 226 | 93.8 | globlastp |
| 1932 | LGM5 | euonymus\|11v1\|SRR070038X191565_P1 | 5103 | 226 | 93.8 | globlastp |
| 1933 | LGM5 | euphorbia\|11v1\|DV120773_P1 | 5104 | 226 | 93.8 | globlastp |
| 1934 | LGM5 | ginger\|gb164\|DY357861_P1 | 5105 | 226 | 93.8 | globlastp |
| 1935 | LGM5 | humulus\|11v1\|EX517172_P1 | 5106 | 226 | 93.8 | globlastp |
| 1936 | LGM5 | scabiosa\|11v1\|SRR063723X104109 | 5107 | 226 | 93.8 | globlastp |
| 1937 | LGM5 | carrot\|14v1\|JG753197_P1 | 5108 | 226 | 93.3 | globlastp |
| 1938 | LGM5 | castorbean\|14v2\|XM_002523451_P1 | 5109 | 226 | 93.3 | globlastp |
| 1939 | LGM5 | cichorium\|14v1\|EH696095_P1 | 5110 | 226 | 93.3 | globlastp |
| 1940 | LGM5 | cichorium\|14v1\|EL354803_P1 | 5110 | 226 | 93.3 | globlastp |
| 1941 | LGM5 | parsley\|14v1\|BSS12K19C1075142_P1 | 5111 | 226 | 93.3 | globlastp |
| 1942 | LGM5 | ambrosia\|11v1\|SRR346935.192781_P1 | 5112 | 226 | 93.3 | globlastp |
| 1943 | LGM5 | b_juncea\|12v1\|BJUN12V11066861_P1 | 5113 | 226 | 93.3 | globlastp |
| 1944 | LGM5 | beech\|11v1\|FR595200_P1 | 5114 | 226 | 93.3 | globlastp |
| 1945 | LGM5 | castorbean\|12v1\|XM_002523451 | 5109 | 226 | 93.3 | globlastp |
| 1946 | LGM5 | clementine\|11v1\|BQ622925_P1 | 5115 | 226 | 93.3 | globlastp |
| 1947 | LGM5 | cowpea\|12v1\|FC460654_P1 | 5116 | 226 | 93.3 | globlastp |
| 1948 | LGM5 | cucumber\|09v1\|CK755581_P1 | 5117 | 226 | 93.3 | globlastp |
| 1949 | LGM5 | cucurbita\|11v1\|FG227206XX1_P1 | 5118 | 226 | 93.3 | globlastp |
| 1950 | LGM5 | eucalyptus\|11v2\|SRR001658X12387_P1 | 5119 | 226 | 93.3 | globlastp |
| 1951 | LGM5 | flaveria\|11v1\|SRR149229.122999_P1 | 5120 | 226 | 93.3 | globlastp |
| 1952 | LGM5 | ginseng\|13v1\|CN847404_P1 | 5121 | 226 | 93.3 | globlastp |
| 1953 | LGM5 | ipomoea_nil\|10v1\|BJ553333_P1 | 5122 | 226 | 93.3 | globlastp |
| 1954 | LGM5 | monkeyflower\|12v1\|SRR037227.123728_P1 | 5123 | 226 | 93.3 | globlastp |
| 1955 | LGM5 | oak\|10v1\|FP030884_P1 | 5124 | 226 | 93.3 | globlastp |
| 1956 | LGM5 | orange\|11v1\|BQ622925_P1 | 5115 | 226 | 93.3 | globlastp |
| 1957 | LGM5 | papaya\|gb165\|EX245826_P1 | 5125 | 226 | 93.3 | globlastp |
| 1958 | LGM5 | poppy\|11v1\|FE965330_P1 | 5126 | 226 | 93.3 | globlastp |
| 1959 | LGM5 | prunus_mume\|13v1\|BU039273 | 5127 | 226 | 93.3 | globlastp |
| 1960 | LGM5 | prunus\|10v1\|BU039273 | 5127 | 226 | 93.3 | globlastp |
| 1961 | LGM5 | safflower\|gb162\|EL399163 | 5128 | 226 | 93.3 | globlastp |
| 1962 | LGM5 | sarracenia\|11v1\|SRR192669.101796 | 5129 | 226 | 93.3 | globlastp |
| 1963 | LGM5 | triphysaria\|13v1\|SRR023500X154059 | 5130 | 226 | 93.3 | globlastp |
| 1964 | LGM5 | tripterygium\|11v1\|SRR098677X103382 | 5131 | 226 | 93.3 | globlastp |
| 1965 | LGM5 | valeriana\|11v1\|SRR099079X118253 | 5132 | 226 | 93.3 | globlastp |
| 1966 | LGM5 | watermelon\|11v1\|CK755581 | 5133 | 226 | 93.3 | globlastp |
| 1967 | LGM5 | b_oleracea\|14v1\|CA992329_P1 | 5134 | 226 | 92.8 | globlastp |
| 1968 | LGM5 | b_oleracea\|14v1\|CN736779_P1 | 5135 | 226 | 92.8 | globlastp |
| 1969 | LGM5 | chrysanthemum\|14v1\|CCOR13V1K19C1351748_P1 | 5136 | 226 | 92.8 | globlastp |
| 1970 | LGM5 | chrysanthemum\|14v1\|SRR525216X64809D1_P1 | 5137 | 226 | 92.8 | globlastp |
| 1971 | LGM5 | echinochloa\|14v1\|SRR522894X143658D1_P1 | 5138 | 226 | 92.8 | globlastp |
| 1972 | LGM5 | onion\|14v1\|FS214306_P1 | 5139 | 226 | 92.8 | globlastp |
| 1973 | LGM5 | onion\|14v1\|SRR073446X100617D1_P1 | 5139 | 226 | 92.8 | globlastp |
| 1974 | LGM5 | apple\|11v1\|CN916898_P1 | 5140 | 226 | 92.8 | globlastp |
| 1975 | LGM5 | arabidopsis_lyrata\|13v1\|AA394695_P1 | 5141 | 226 | 92.8 | globlastp |
| 1976 | LGM5 | b_juncea\|12v1\|E6ANDIZ02HJHE5_P1 | 5135 | 226 | 92.8 | globlastp |
| 1977 | LGM5 | b_rapa\|11v1\|CA992329_P1 | 5134 | 226 | 92.8 | globlastp |
| 1978 | LGM5 | b_rapa\|11v1\|CD825800_P1 | 5142 | 226 | 92.8 | globlastp |
| 1979 | LGM5 | blueberry\|12v1\|CF811679_P1 | 5143 | 226 | 92.8 | globlastp |
| 1980 | LGM5 | cacao\|13v1\|CA795065_P1 | 5144 | 226 | 92.8 | globlastp |
| 1981 | LGM5 | canola\|11v1\|CN736779_P1 | 5135 | 226 | 92.8 | globlastp |
| 1982 | LGM5 | canola\|11v1\|DY024097_P1 | 5135 | 226 | 92.8 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 1983 | LGM5 | canola\|11v1\|EE456190_P1 | 5134 | 226 | 92.8 | globlastp |
| 1984 | LGM5 | canola\|11v1\|ES959696_P1 | 5134 | 226 | 92.8 | globlastp |
| 1985 | LGM5 | centaurea\|11v1\|EH779348_P1 | 5145 | 226 | 92.8 | globlastp |
| 1986 | LGM5 | cichorium\|gb171\|EH696095 | 5146 | 226 | 92.8 | globlastp |
| 1987 | LGM5 | cirsium\|11v1\|SRR346952.1018218_P1 | 5147 | 226 | 92.8 | globlastp |
| 1988 | LGM5 | cirsium\|11v1\|SRR346952.856095_P1 | 5147 | 226 | 92.8 | globlastp |
| 1989 | LGM5 | echinacea\|13v1\|EPURP13V11520403_P1 | 5147 | 226 | 92.8 | globlastp |
| 1990 | LGM5 | eggplant\|10v1\|FS013736_P1 | 5148 | 226 | 92.8 | globlastp |
| 1991 | LGM5 | ginseng\|13v1\|SRR547977.137173_P1 | 5149 | 226 | 92.8 | globlastp |
| 1992 | LGM5 | grape\|13v1\|GSVIVT01023596001_P1 | 5150 | 226 | 92.8 | globlastp |
| 1993 | LGM5 | hornbeam\|12v1\|SRR364455.104382_P1 | 5151 | 226 | 92.8 | globlastp |
| 1994 | LGM5 | onion\|12v1\|SRR073446X100617D1 | 5139 | 226 | 92.8 | globlastp |
| 1995 | LGM5 | phyla\|11v2\|SRR099037X167282_P1 | 5152 | 226 | 92.8 | globlastp |
| 1996 | LGM5 | plantago\|11v2\|SRR066373X128810_P1 | 5153 | 226 | 92.8 | globlastp |
| 1997 | LGM5 | platanus\|11v1\|SRR096786X113399_P1 | 5154 | 226 | 92.8 | globlastp |
| 1998 | LGM5 | poplar\|13v1\|BI129981_P1 | 5155 | 226 | 92.8 | globlastp |
| 1999 | LGM5 | radish\|gb164\|EV528928 | 5134 | 226 | 92.8 | globlastp |
| 2000 | LGM5 | radish\|gb164\|EX757476 | 5134 | 226 | 92.8 | globlastp |
| 2001 | LGM5 | rose\|12v1\|SRR397984.132568 | 5156 | 226 | 92.8 | globlastp |
| 2002 | LGM5 | sunflower\|12v1\|CD858397 | 5147 | 226 | 92.8 | globlastp |
| 2003 | LGM5 | tabernaemontana\|11v1\|SRR098689X122772 | 5157 | 226 | 92.8 | globlastp |
| 2004 | LGM5 | thellungiella_halophilum\|13v1\|SRR487818.143789 | 5158 | 226 | 92.8 | globlastp |
| 2005 | LGM5 | thellungiella_parvulum\|13v1\|SRR487818.412753 | 5158 | 226 | 92.8 | globlastp |
| 2006 | LGM5 | tripterygium\|11v1\|SRR098677X170735 | 5159 | 226 | 92.8 | globlastp |
| 2007 | LGM5 | vinca\|11v1\|SRR098690X16162 | 5160 | 226 | 92.8 | globlastp |
| 2008 | LGM5 | walnuts\|gb166\|CV198344 | 5161 | 226 | 92.8 | globlastp |
| 2009 | LGM5 | zostera\|12v1\|AM767880 | 5162 | 226 | 92.8 | globlastp |
| 2010 | LGM5 | dandelion\|10v1\|DR402561_T1 | 5163 | 226 | 92.78 | glotblastn |
| 2011 | LGM5 | chrysanthemum\|14v1\|SRR290491X154988D1_P1 | 5164 | 226 | 92.3 | globlastp |
| 2012 | LGM5 | chrysanthemum\|14v1\|SRR290491X438138D1_P1 | 5165 | 226 | 92.3 | globlastp |
| 2013 | LGM5 | chrysanthemum\|14v1\|SRR525216X68511D1_P1 | 5166 | 226 | 92.3 | globlastp |
| 2014 | LGM5 | amsonia\|11v1\|SRR098688X137677_P1 | 5167 | 226 | 92.3 | globlastp |
| 2015 | LGM5 | arabidopsis\|13v2\|AT5G58030_P1 | 5168 | 226 | 92.3 | globlastp |
| 2016 | LGM5 | artemisia\|10v1\|EY032703_P1 | 5169 | 226 | 92.3 | globlastp |
| 2017 | LGM5 | banana\|12v1\|ES437114 | 5170 | 226 | 92.3 | globlastp |
| 2018 | LGM5 | bean\|13v1\|CA898948_P1 | 5171 | 226 | 92.3 | globlastp |
| 2019 | LGM5 | catharanthus\|11v1\|SRR098691X102061_P1 | 5172 | 226 | 92.3 | globlastp |
| 2020 | LGM5 | chickpea\|13v2\|GR407657_P1 | 5173 | 226 | 92.3 | globlastp |
| 2021 | LGM5 | cotton\|11v1\|AI726598_P1 | 5174 | 226 | 92.3 | globlastp |
| 2022 | LGM5 | flax\|11v1\|JG093615_P1 | 5175 | 226 | 92.3 | globlastp |
| 2023 | LGM5 | fraxinus\|11v1\|SRR058827.124739_P1 | 5176 | 226 | 92.3 | globlastp |
| 2024 | LGM5 | gossypium_raimondii\|13v1\|AI726598_P1 | 5174 | 226 | 92.3 | globlastp |
| 2025 | LGM5 | iceplant\|gb164\|BE035515_P1 | 5177 | 226 | 92.3 | globlastp |
| 2026 | LGM5 | nicotiana_benthamiana\|12v1\|DV158661_P1 | 5178 | 226 | 92.3 | globlastp |
| 2027 | LGM5 | pigeonpea\|11v1\|SRR054580X112087_P1 | 5179 | 226 | 92.3 | globlastp |
| 2028 | LGM5 | quinoa\|13v2\|SRR315568X132338 | 5180 | 226 | 92.3 | globlastp |
| 2029 | LGM5 | quinoa\|13v2\|SRR315568X135121 | 5180 | 226 | 92.3 | globlastp |
| 2030 | LGM5 | quinoa\|13v2\|SRR315568X262795 | 5180 | 226 | 92.3 | globlastp |
| 2031 | LGM5 | safflower\|gb162\|EL379225 | 5181 | 226 | 92.3 | globlastp |
| 2032 | LGM5 | soybean\|13v2\|GLYMA11G34840 | 5182 | 226 | 92.3 | globlastp |
| 2033 | LGM5 | tobacco\|gb162\|DV158661 | 5183 | 226 | 92.3 | globlastp |
| 2034 | LGM5 | trigonella\|11v1\|SRR066194X159411 | 5184 | 226 | 92.3 | globlastp |
| 2035 | LGM5 | trigonella\|11v1\|SRR066198X1005715 | 5184 | 226 | 92.3 | globlastp |
| 2036 | LGM5 | melon\|10v1\|AM721207_T1 | 5185 | 226 | 92.27 | glotblastn |
| 2037 | LGM5 | tragopogon\|10v1\|SRR020205S0020605 | 5186 | 226 | 92.27 | glotblastn |
| 2038 | LGM5 | amaranthus\|13v1\|SRR039408X8935D1_P1 | 5187 | 226 | 91.8 | globlastp |
| 2039 | LGM5 | chrysanthemum\|14v1\|CCOR13V1K19C712461_P1 | 5188 | 226 | 91.8 | globlastp |
| 2040 | LGM5 | chrysanthemum\|14v1\|SRR290491X165328D1_P1 | 5189 | 226 | 91.8 | globlastp |
| 2041 | LGM5 | chrysanthemum\|14v1\|SRR797216S19XK19C135809_P1 | 5188 | 226 | 91.8 | globlastp |
| 2042 | LGM5 | clover\|14v1\|ERR351507S19XK19C353036_P1 | 5190 | 226 | 91.8 | globlastp |
| 2043 | LGM5 | clover\|14v1\|ERR351507S19XK19C543836_P1 | 5190 | 226 | 91.8 | globlastp |
| 2044 | LGM5 | clover\|14v1\|ERR351508S29XK29C20418_P1 | 5190 | 226 | 91.8 | globlastp |
| 2045 | LGM5 | clover\|14v1\|FY463974_P1 | 5190 | 226 | 91.8 | globlastp |
| 2046 | LGM5 | vicia\|14v1\|HX911086_P1 | 5190 | 226 | 91.8 | globlastp |
| 2047 | LGM5 | beet\|12v1\|BQ589788_P1 | 5191 | 226 | 91.8 | globlastp |
| 2048 | LGM5 | lotus\|09v1\|LLCN825623_P1 | 5192 | 226 | 91.8 | globlastp |
| 2049 | LGM5 | lupin\|13v4\|SRR520490.400996_P1 | 5193 | 226 | 91.8 | globlastp |
| 2050 | LGM5 | medicago\|13v1\|AW257063_P1 | 5194 | 226 | 91.8 | globlastp |
| 2051 | LGM5 | olea\|13v1\|SRR014463X20346D1_P1 | 5195 | 226 | 91.8 | globlastp |
| 2052 | LGM5 | orobanche\|10v1\|SRR023189S0002969_P1 | 5196 | 226 | 91.8 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2053 | LGM5 | phalaenopsis\|11v1\|SRR125771.102497_P1 | 5197 | 226 | 91.8 | globlastp |
| 2054 | LGM5 | poplar\|13v1\|AI162891_P1 | 5198 | 226 | 91.8 | globlastp |
| 2055 | LGM5 | potato\|10v1\|BG594512_P1 | 5199 | 226 | 91.8 | globlastp |
| 2056 | LGM5 | soybean\|13v2\|GLYMA18G03480T2 | 5200 | 226 | 91.8 | globlastp |
| 2057 | LGM5 | chestnut\|14v1\|SRR006295X107848D1_P1 | 5201 | 226 | 91.2 | globlastp |
| 2058 | LGM5 | chrysanthemum\|14v1\|CCOR13V1K23C860424_P1 | 5202 | 226 | 91.2 | globlastp |
| 2059 | LGM5 | cichorium\|14v1\|EH703501_P1 | 5203 | 226 | 91.2 | globlastp |
| 2060 | LGM5 | amborella\|12v3\|CK766552_P1 | 5204 | 226 | 91.2 | globlastp |
| 2061 | LGM5 | aquilegia\|10v2\|DR931387_P1 | 5205 | 226 | 91.2 | globlastp |
| 2062 | LGM5 | centaurea\|11v1\|EH721907_P1 | 5206 | 226 | 91.2 | globlastp |
| 2063 | LGM5 | centaurea\|11v1\|EH730414_P1 | 5206 | 226 | 91.2 | globlastp |
| 2064 | LGM5 | chelidonium\|11v1\|SRR084752X254676XX1_P1 | 5207 | 226 | 91.2 | globlastp |
| 2065 | LGM5 | cichorium\|gb171\|EH703501 | 5203 | 226 | 91.2 | globlastp |
| 2066 | LGM5 | guizotia\|10v1\|GE576219_P1 | 5208 | 226 | 91.2 | globlastp |
| 2067 | LGM5 | heritiera\|10v1\|SRR005795S0006295_P1 | 5209 | 226 | 91.2 | globlastp |
| 2068 | LGM5 | lettuce\|12v1\|DW070380_P1 | 5210 | 226 | 91.2 | globlastp |
| 2069 | LGM5 | nicotiana_benthamiana\|12v1\|BP749279_P1 | 5211 | 226 | 91.2 | globlastp |
| 2070 | LGM5 | solanum_phureja\|09v1\|SPHAF136010 | 5212 | 226 | 91.2 | globlastp |
| 2071 | LGM5 | tomato\|13v1\|BG132496 | 5213 | 226 | 91.2 | globlastp |
| 2072 | LGM5 | fagopyram\|11v1\|SRR063689X108773_T1 | 5214 | 226 | 90.72 | glotblastn |
| 2073 | LGM5 | cirsium\|11v1\|SRR346952.103847_P1 | 5215 | 226 | 90.7 | globlastp |
| 2074 | LGM5 | b_oleracea\|gb161\|AM061768 | 5216 | 226 | 90.3 | globlastp |
| 2075 | LGM5 | fagopyrum\|11v1\|SRR063703X106967_T1 | 5217 | 226 | 90.21 | glotblastn |
| 2076 | LGM5 | centaurea\|11v1\|SRR346940.12608_P1 | 5218 | 226 | 90.2 | globlastp |
| 2077 | LGM5 | nasturtium\|11v1\|GH169501_P1 | 5219 | 226 | 90.2 | globlastp |
| 2078 | LGM5 | centaurea\|11v1\|SRR346938.116780_P1 | 5220 | 226 | 89.7 | globlastp |
| 2079 | LGM5 | chestnut\|gb170\|SRR006295S0047423 | 5221 | 226 | 89.7 | globlastp |
| 2080 | LGM5 | cleome_spinosa\|10v1\|GR931906_P1 | 5222 | 226 | 89.7 | globlastp |
| 2081 | LGM5 | cotton\|11v1\|BE054721XX1_P1 | 5223 | 226 | 89.7 | globlastp |
| 2082 | LGM5 | gossypium_raimondii\|13v1\|AI731408_P1 | 5223 | 226 | 89.7 | globlastp |
| 2083 | LGM5 | arnica\|11v1\|SRR099034X124304_P1 | 5224 | 226 | 89.2 | globlastp |
| 2084 | LGM5 | cotton\|11v1\|AI731408_P1 | 5225 | 226 | 89.2 | globlastp |
| 2085 | LGM5 | silene\|11v1\|SRR096785X104013 | 5226 | 226 | 89.2 | globlastp |
| 2086 | LGM5 | utricularia\|11v1\|SRR094438.113173 | 5227 | 226 | 89.2 | globlastp |
| 2087 | LGM5 | cephalotaxus\|11v1\|SRR064395X102181_P1 | 5228 | 226 | 88.7 | globlastp |
| 2088 | LGM5 | cryptomeria\|gb166\|BY888802_P1 | 5229 | 226 | 88.7 | globlastp |
| 2089 | LGM5 | taxus\|10v1\|SRR032523S0008292 | 5230 | 226 | 88.7 | globlastp |
| 2090 | LGM5 | amaranthus\|13v1\|SRR039411X156859D1_T1 | 5231 | 226 | 88.66 | glotblastn |
| 2091 | LGM5 | eschscholzia\|11v1\|SRR014116.133813_P1 | 5232 | 226 | 88.6 | globlastp |
| 2092 | LGM5 | amaranthus\|13v1\|SRR039411X186191D1_T1 | 5231 | 226 | 88.24 | glotblastn |
| 2093 | LGM5 | maritime_pine\|10v1\|SRR073317S0117912_T1 | 5233 | 226 | 88.14 | glotblastn |
| 2094 | LGM5 | platanus\|11v1\|SRR096786X150136_T1 | 5234 | 226 | 88.14 | glotblastn |
| 2095 | LGM5 | kiwi\|gb166\|FG409059_P1 | 5235 | 226 | 88.1 | globlastp |
| 2096 | LGM5 | podocarpus\|10v1\|SRR065014S0103673_P1 | 5236 | 226 | 88.1 | globlastp |
| 2097 | LGM5 | spruce\|11v1\|ES670285 | 5237 | 226 | 88.1 | globlastp |
| 2098 | LGM5 | lotus\|09v1\|BW599020_P1 | 5238 | 226 | 88 | globlastp |
| 2099 | LGM5 | amaranthus\|10v1\|SRR039411S0024897 | 5231 | 226 | 87.75 | glotblastn |
| 2100 | LGM5 | pine\|10v2\|BM903468_T1 | 5239 | 226 | 87.63 | glotblastn |
| 2101 | LGM5 | cedrus\|11v1\|SRR065007X162660_P1 | 5240 | 226 | 87.6 | globlastp |
| 2102 | LGM5 | parthenium\|10v1\|GW778447_P1 | 5241 | 226 | 87.6 | globlastp |
| 2103 | LGM5 | basilicum\|13v1\|B10LEAF674401_P1 | 5242 | 226 | 86.6 | globlastp |
| 2104 | LGM5 | gnetum\|10v1\|SRR064399S0023628_P1 | 5243 | 226 | 86.6 | globlastp |
| 2105 | LGM5 | abies\|11v2\|SRR098676X100078_T1 | 5244 | 226 | 86.08 | glotblastn |
| 2106 | LGM5 | nicotiana_benthamiana\|12v1\|BP748537_P1 | 5245 | 226 | 84.8 | globlastp |
| 2107 | LGM5 | phalaenopsis\|11v1\|SRR125771.1173944_T1 | 5246 | 226 | 84.62 | glotblastn |
| 2108 | LGM5 | pseudotsuga\|10v1\|SRR065119S0022897 | 5247 | 226 | 84.1 | globlastp |
| 2109 | LGM5 | flaveria\|11v1\|SRR149229.134082_P1 | 5248 | 226 | 83.5 | globlastp |
| 2110 | LGM5 | pea\|11v1\|FG529571_P1 | 5249 | 226 | 83.5 | globlastp |
| 2111 | LGM5 | sequoia\|10v1\|SRR065044S0013282 | 5250 | 226 | 82.99 | glotblastn |
| 2112 | LGM5 | banana\|14v1\|ES437114_P1 | 5251 | 226 | 82.6 | globlastp |
| 2113 | LGM5 | amorphophallus\|11v2\|SRR089351X156796_P1 | 5252 | 226 | 82.5 | globlastp |
| 2114 | LGM5 | fern\|gb171\|BP918439_P1 | 5253 | 226 | 82.5 | globlastp |
| 2115 | LGM5 | liquorice\|gb171\|FS244601_P1 | 5254 | 226 | 82.5 | globlastp |
| 2116 | LGM5 | strawberry\|11v1\|DY674690 | 5255 | 226 | 82.47 | glotblastn |
| 2117 | LGM5 | pteridium\|11v1\|SRR043594X101338 | 5256 | 226 | 82 | globlastp |
| 2118 | LGM5 | ceratodon\|10v1\|SRR074890S0076556_P1 | 5257 | 226 | 81.4 | globlastp |
| 2119 | LGM5 | physcomitrella\|13v1\|AW496908_P1 | 5258 | 226 | 80.4 | globlastp |
| 2120 | LGM7 | sorghum\|13v2\|CD209253 | — | 227 | 89.11 | glotblastn |
| 2121 | LGM8 | maize\|13v2\|BE055938_P1 | 5259 | 228 | 94.7 | globlastp |
| 2122 | LGM8 | sorghum\|13v2\|BE364594 | 5260 | 228 | 91.7 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2123 | LGM8 | switchgrass\|12v1\|FL730647 | 5261 | 228 | 91.5 | globlastp |
| 2124 | LGM8 | switchgrass\|12v1\|FL787511 | 5262 | 228 | 90.6 | globlastp |
| 2125 | LGM8 | foxtail_millet\|14v1\|JK549278_P1 | 5263 | 228 | 90.3 | globlastp |
| 2126 | LGM8 | foxtail_millet\|13v2\|SRR350548X106187 | 5263 | 228 | 90.3 | globlastp |
| 2127 | LGM8 | oat\|14v1\|CN818654_P1 | 5264 | 228 | 88.2 | globlastp |
| 2128 | LGM8 | rice\|13v2\|BI812205 | 5265 | 228 | 88.2 | globlastp |
| 2129 | LGM8 | oat\|11v1\|CN818654 | 5266 | 228 | 87.5 | globlastp |
| 2130 | LGM8 | brachypodium\|14v1\|GT758991_T1 | 5267 | 228 | 85.58 | glotblastn |
| 2131 | LGM8 | brachypodium\|13v2\|BRADI2G15980 | 5268 | 228 | 85 | globlastp |
| 2132 | LGM8 | echinochloa\|14v1\|SRR522894X167722D1_P1 | 5269 | 228 | 84.9 | globlastp |
| 2133 | LGM8 | wheat\|12v3\|BE412386 | 5270 | 228 | 82.7 | globlastp |
| 2134 | LGM8 | oat\|14v1\|SRR020741X108053D1_P1 | 5271 | 228 | 80.7 | globlastp |
| 2135 | LGM8 | oat\|14v1\|SRR020741X108928D1_P1 | 5272 | 228 | 80.5 | globlastp |
| 2136 | LGM9 | echinochloa\|14v1\|SRR522894X106175D1_P1 | 5273 | 229 | 94.5 | globlastp |
| 2137 | LGM9 | echinochloa\|14v1\|SRR522894X153750D1_P1 | 5274 | 229 | 93.S | globlastp |
| 2138 | LGM9 | sorghum\|13v2\|BM323765 | 5275 | 229 | 93.4 | globlastp |
| 2139 | LGM9 | foxtail_millet\|13v2\|SRR350548X118658 | 5276 | 229 | 93.2 | globlastp |
| 2140 | LGM9 | foxtail_millet\|14v1\|JK550277_P1 | 5276 | 229 | 93.2 | globlastp |
| 2141 | LGM9 | rice\|13v2\|BE229933 | 5277 | 229 | 89.3 | globlastp |
| 2142 | LGM9 | wheat\|12v3\|BE412022 | 5278 | 229 | 87.8 | globlastp |
| 2143 | LGM9 | brachypodium\|13v2\|BRADI2G17660 | 5279 | 229 | 87.7 | globlastp |
| 2144 | LGM9 | brachypodium\|14v1\|DV474668_P1 | 5279 | 229 | 87.7 | globlastp |
| 2145 | LGM9 | oat\|14v1\|GR315799_P1 | 5280 | 229 | 86.7 | globlastp |
| 2146 | LGM9 | oat\|14v1\|GR325305_T1 | 5281 | 229 | 86.3 | globlastp |
| 2147 | LGM9 | oat\|14v1\|GR315687_T1 | 5282 | 229 | 86.12 | glotblastn |
| 2148 | LGM9 | oat\|11v1\|GR315687 | 5282 | 229 | 86.12 | glotblastn |
| 2149 | LGM9 | lolium\|13v1\|EB709566_T1 | 5283 | 229 | 84.7 | glotblastn |
| 2150 | LGM11 | switchgrass\|12v1\|FE639570 | 5284 | 231 | 93.7 | globlastp |
| 2151 | LGM11 | rice\|13v2\|BM038301 | 5285 | 231 | 88.1 | globlastp |
| 2152 | LGM11 | brachypodium\|14v1\|GT761231_P1 | 5286 | 231 | 86 | globlastp |
| 2153 | LGM11 | brachypodium\|13v2\|BRADI3G19100 | 5286 | 231 | 86 | globlastp |
| 2154 | LGM11 | leymus\|gb166\|CD808754_P1 | 5287 | 231 | 85.3 | globlastp |
| 2155 | LGM11 | wheat\|12v3\|CA605240 | 5288 | 231 | 85.3 | globlastp |
| 2156 | LGM11 | oat\|14v1\|GR326295_P1 | 5289 | 231 | 84.9 | globlastp |
| 2157 | LGM11 | oat\|11v1\|GO593287 | 5290 | 231 | 84.56 | glotblastn |
| 2158 | LGM11 | millet\|10v1\|EVO454PM001708_P1 | 5291 | 231 | 83.1 | globlastp |
| 2159 | LGM12 | sugarcane\|10v1\|CA066454 | 5292 | 232 | 93.8 | globlastp |
| 2160 | LGM12 | maize\|13v2\|AB024293_P1 | 5293 | 232 | 86.1 | globlastp |
| 2161 | LGM12 | maize\|13v2\|BG836938_P1 | 5294 | 232 | 83.3 | globlastp |
| 2162 | LGM12 | maize\|13v2\|CD446274_P1 | 5294 | 232 | 83.3 | globlastp |
| 2163 | LGM12 | foxtail_millet\|13v2\|SRR350548X134530 | 5295 | 232 | 81.2 | globlastp |
| 2164 | LGM12 | foxtail_millet\|14v1\|JK582820_P1 | 5295 | 232 | 81.2 | globlastp |
| 2165 | LGM12 | fescue\|13v1\|DT688239_P1 | 5296 | 232 | 80 | globlastp |
| 2166 | LGM12 | lolium\|13v1\|AU251179_P1 | 5296 | 232 | 80 | globlastp |
| 2167 | LGM13 | maize\|13v2\|AW054234_P1 | 5297 | 233 | 90.2 | globlastp |
| 2168 | LGM13 | foxtail_millet\|14v1\|XM_004966622_P1 | 5298 | 233 | 89.8 | globlastp |
| 2169 | LGM13 | foxtail_millet\|13v2\|SRR350548X364414 | 5299 | 233 | 89.7 | globlastp |
| 2170 | LGM13 | sorghum\|13v2\|XM_002437913 | 5300 | 233 | 88.8 | globlastp |
| 2171 | LGM13 | maize\|13v2\|AW054321_T1 | 5301 | 233 | 86.4 | glotblastn |
| 2172 | LGM13 | sorghum\|13v2\|BG159406 | 5302 | 233 | 86.05 | glotblastn |
| 2173 | LGM13 | rice\|13v2\|C71746 | 5303 | 233 | 85.91 | glotblastn |
| 2174 | LGM13 | brachypodium\|14v1\|XM_003570258_P1 | 5304 | 233 | 85.7 | globlastp |
| 2175 | LGM13 | foxtail_millet\|13v2\|SRR30548X177236 | 5305 | 233 | 85.7 | globlastp |
| 2176 | LGM13 | foxtail_millet\|14v1\|XM_004954174_T1 | 5305 | 233 | 85.7 | glotblastn |
| 2177 | LGM13 | switchgrass\|12v1\|FL765378 | 5306 | 233 | 83.9 | globlastp |
| 2178 | LGM13 | brachypodium\|14v1\|XM_003564157_P1 | 5307 | 233 | 83.7 | globlastp |
| 2179 | LGM13 | banana\|14v1\|MAGEN2012001893_T1 | 5308 | 233 | 83.49 | glotblastn |
| 2180 | LGM13 | switchgrass\|12v1\|FL756342 | 5309 | 233 | 82.7 | globlastp |
| 2181 | LGM13 | banana\|14v1\|MAGEN2012016584_T1 | 5310 | 233 | 82.54 | glotblastn |
| 2182 | LGM13 | banana\|14v1\|ES434766_T1 | 5311 | 233 | 82.41 | glotblastn |
| 2183 | LGM13 | banana\|12v1\|ES434766 | 5311 | 233 | 82.41 | glotblastn |
| 2184 | LGM13 | pineapple\|14v1\|ACOM14V1K19C2358254_T1 | 5312 | 233 | 82.11 | glotblastn |
| 2185 | LGM13 | coconut\|14v1\|COCOS14V1K19C1344950_T1 | 5313 | 233 | 81.74 | glotblastn |
| 2186 | LGM13 | banana\|14v1\|MAGEN2012010618_T1 | 5314 | 233 | 81.58 | glotblastn |
| 2187 | LGM13 | cyclamen\|14v1\|B14ROOTK35C40103_T1 | 5315 | 233 | 81.4 | glotblastn |
| 2188 | LGM13 | grape\|13v1\|GSVIVT01001052001_T1 | 5316 | 233 | 81.3 | glotblastn |
| 2189 | LGM13 | arabidopsis_lyrata\|13v1\|CD531364_T1 | 5317 | 233 | 81.28 | glotblastn |
| 2190 | LGM13 | banana\|12v1\|MAGEN2012010618 | 5318 | 233 | 81.23 | glotblastn |
| 2191 | LGM13 | rye\|12v1\|DRR001012.112249 | 5319 | 233 | 81.2 | globlastp |
| 2192 | LGM13 | chickpea\|13v2\|SRR133517.243753_T1 | 5320 | 233 | 81.16 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2193 | LGM13 | banana\|14v1\|MAGEN2012004462_T1 | 5321 | 233 | 80.95 | glotblastn |
| 2194 | LGM13 | banana\|12v1\|MAGEN2012004462 | 5321 | 233 | 80.95 | glotblastn |
| 2195 | LGM13 | arabidopsis\|13v2\|AT3G42640_T1 | 5322 | 233 | 80.93 | glotblastn |
| 2196 | LGM13 | b_rapa\|11v1\|CN727820_T1 | 5323 | 233 | 80.93 | glotblastn |
| 2197 | LGM13 | canola\|11v1\|EE550344_T1 | 5324 | 233 | 80.93 | glotblastn |
| 2198 | LGM13 | monkeyflower\|12v1\|SRR037227.107031_T1 | 5325 | 233 | 80.93 | glotblastn |
| 2199 | LGM13 | pigeonpea\|11v1\|CCIIPG11001382_T1 | 5326 | 233 | 80.93 | glotblastn |
| 2200 | LGM13 | castorbean\|14v2\|XM_002527276_T1 | 5327 | 233 | 80.84 | glotblastn |
| 2201 | LGM13 | b_oleracea\|14v1\|EE550344_T1 | 5328 | 233 | 80.81 | glotblastn |
| 2202 | LGM13 | soybean\|13v2\|GLYMA06G07990 | 5329 | 233 | 80.81 | glotblastn |
| 2203 | LGM13 | eucalyptus\|11v2\|JGIEG035498_T1 | 5330 | 233 | 80.74 | glotblastn |
| 2204 | LGM13 | monkeyflower\|12v1\|GO981272_T1 | 5331 | 233 | 80.72 | glotblastn |
| 2205 | LGM13 | bean\|13v1\|SRR090491X470031_T1 | 5332 | 233 | 80.7 | glotblastn |
| 2206 | LGM13 | soybean\|13v2\|GLYMA17G11190 | 5333 | 233 | 80.7 | glotblastn |
| 2207 | LGM13 | thellungiella_parvulum\|13v1\|EP13V1RP013389 | 5334 | 233 | 80.7 | glotblastn |
| 2208 | LGM13 | poplar\|13v1\|BI069047_T1 | 5335 | 233 | 80.63 | glotblastn |
| 2209 | LGM13 | gossypium_raimondii\|13v1\|GRJGIV8002945_T1 | 5336 | 233 | 80.6 | glotblastn |
| 2210 | LGM13 | cyclamen\|14v1\|B14ROOTK19C144142_T1 | 5337 | 233 | 80.58 | glotblastn |
| 2211 | LGM13 | soybean\|13v2\|GLYMA13G22370 | 5338 | 233 | 80.58 | glotblastn |
| 2212 | LGM13 | thellungiella_halophilum\|13v1\|EHJGI11016856 | 5339 | 233 | 80.58 | glotblastn |
| 2213 | LGM13 | tomato\|13v1\|TOMTRALTBL | 5340 | 233 | 80.58 | glotblastn |
| 2214 | LGM13 | bean\|13v1\|AY338228_T1 | 5341 | 233 | 80.58 | glotblastn |
| 2215 | LGM13 | arabidopsis\|13v2\|AT2G07560_T1 | 5342 | 233 | 80.56 | glotblastn |
| 2216 | LGM13 | aquilegia\|10v2\|DR920154_T1 | 5343 | 233 | 80.51 | glotblastn |
| 2217 | LGM13 | pepper\|14v1\|BM061822_T1 | 5344 | 233 | 80.47 | glotblastn |
| 2218 | LGM13 | cucumber\|09v1\|BGI454G0031717_T1 | 5345 | 233 | 80.47 | glotblastn |
| 2219 | LGM13 | flaveria\|11v1\|SRR149229.151157_T1 | 5346 | 233 | 80.47 | glotblastn |
| 2220 | LGM13 | poplar\|13v1\|DT509422_T1 | 5347 | 233 | 80.47 | glotblastn |
| 2221 | LGM13 | soybean\|13v2\|GLYMA14G17360 | 5348 | 233 | 80.47 | glotblastn |
| 2222 | LGM13 | cacao\|13v1\|CA796153_T1 | 5349 | 233 | 80.47 | glotblastn |
| 2223 | LGM13 | arabidopsis_lyrata\|13v1\|Z18449_T1 | 5350 | 233 | 80.44 | glotblastn |
| 2224 | LGM13 | valeriana\|11v1\|SRR099039X10218 | 5351 | 233 | 80.42 | glotblastn |
| 2225 | LGM13 | chrysanthemum\|14v1\|SRR290491X103896D1_T1 | 5352 | 233 | 80.35 | glotblastn |
| 2226 | LGM13 | lotus\|09v1\|BP075137_T1 | 5353 | 233 | 80.35 | glotblastn |
| 2227 | LGM13 | silene\|11v1\|SRR096785X101816 | 5354 | 233 | 80.35 | glotblastn |
| 2228 | LGM13 | soybean\|13v2\|GLYMA04G07950 | 5355 | 233 | 80.35 | glotblastn |
| 2229 | LGM13 | watermelon\|11v1\|VMEL05509039111143 | 5356 | 233 | 80.35 | glotblastn |
| 2230 | LGM13 | soybean\|13v2\|GLYMA17G29370 | 5357 | 233 | 80.35 | glotblastn |
| 2231 | LGM13 | gossypium_raimondii\|13v1\|GRJGIV8006598_T1 | 5358 | 233 | 80.3 | glotblastn |
| 2232 | LGM13 | castorbean\|14v2\|EG674264_T1 | 5359 | 233 | 80.28 | glotblastn |
| 2233 | LGM13 | gossypium_raimondii\|13v1\|DW234677_T1 | 5360 | 233 | 80.28 | glotblastn |
| 2234 | LGM13 | pineapple\|14v1\|ACOM14V1K19C1206618_T1 | 5361 | 233 | 80.26 | glotblastn |
| 2235 | LGM13 | gossypium_raimondii\|13v1\|CO103188_T1 | 5362 | 233 | 80.26 | glotblastn |
| 2236 | LGM13 | chrysanthemum\|14v1\|SRR290491X106018D1_T1 | 5363 | 233 | 80.23 | glotblastn |
| 2237 | LGM13 | chrysanthemum\|14v1\|SRR290491X121735D1_T1 | 5363 | 233 | 80.23 | glotblastn |
| 2238 | LGM13 | chrysanthemum\|14v1\|SRR290491X597716D1_T1 | 5363 | 233 | 80.23 | glotblastn |
| 2239 | LGM13 | cyclamen\|14v1\|B14ROOTK19C93482_T1 | 5364 | 233 | 80.23 | glotblastn |
| 2240 | LGM13 | ambrosia\|11v1\|SRR346935.221588_T1 | 5365 | 233 | 80.23 | glotblastn |
| 2241 | LGM13 | apple\|11v1\|CN921617_T1 | 5366 | 233 | 80.23 | glotblastn |
| 2242 | LGM13 | arnica\|11v1\|SRR099034X101901_T1 | 5367 | 233 | 80.23 | glotblastn |
| 2243 | LGM13 | flaveria\|11v1\|SRR149229.102942_T1 | 5368 | 233 | 80.23 | glotblastn |
| 2244 | LGM13 | medicago\|13v1\|MT4_2013011930_T1 | 5369 | 233 | 80.23 | glotblastn |
| 2245 | LGM13 | pigeonpea\|11v1\|GW355448_T1 | 5370 | 233 | 80.23 | glotblastn |
| 2246 | LGM13 | tabernaemontana\|11v1\|SRR098689X100886 | 5371 | 233 | 80.23 | glotblastn |
| 2247 | LGM13 | triphysaria\|13v1\|SRR023501X106912 | 5372 | 233 | 80.23 | glotblastn |
| 2248 | LGM13 | cacao\|13v1\|SRR850732.1022254_T1 | 5373 | 233 | 80.19 | glotblastn |
| 2249 | LGM13 | banana\|14v1\|MAGEN2012007669_T1 | 5374 | 233 | 80.12 | glotblastn |
| 2250 | LGM13 | parsley\|14v1\|BSS12K19C139710_T1 | 5375 | 233 | 80.12 | glotblastn |
| 2251 | LGM13 | banana\|12v1\|MAGEN2012007669 | 5374 | 233 | 80.12 | glotblastn |
| 2252 | LGM13 | chickpea\|13v2\|SRR133517.100922_T1 | 5376 | 233 | 80.12 | glotblastn |
| 2253 | LGM13 | lupin\|13v4\|SRR520491.100366_T1 | 5377 | 233 | 80.12 | glotblastn |
| 2254 | LGM13 | lupin\|13v4\|SRR520491.1197400_T1 | 5378 | 233 | 80.12 | glotblastn |
| 2255 | LGM13 | peanut\|13v1\|EH044764_T1 | 5379 | 233 | 80.12 | glotblastn |
| 2256 | LGM13 | poppy\|11v1\|SRR030259.120563_T1 | 5380 | 233 | 80.12 | glotblastn |
| 2257 | LGM13 | sunflower\|12v1\|DY908811 | 5381 | 233 | 80.12 | glotblastn |
| 2258 | LGM13 | pineapple\|14v1\|ACOM14V1K19C1014231_T1 | 5382 | 233 | 80.05 | glotblastn |
| 2259 | LGM13 | onion\|14v1\|SRR073446X121154D1_T1 | 5383 | 233 | 80.02 | glotblastn |
| 2260 | LGM13 | tobacco\|gb162\|AY383599 | 5384 | 233 | 80.02 | glotblastn |
| 2261 | LGM13 | coconut\|14v1\|COCOS14V1K19C1289124_T1 | 5385 | 233 | 80 | glotblastn |
| 2262 | LGM13 | coconut\|14v1\|COCOS14V1K19C173691_T1 | 5386 | 233 | 80 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2263 | LGM13 | onion\|14v1\|CF440648_T1 | 5387 | 233 | 80 | glotblastn |
| 2264 | LGM13 | arnica\|11v1\|SRR099034X102444_T1 | 5388 | 233 | 80 | glotblastn |
| 2265 | LGM13 | cotton\|11v1\|CO071267_T1 | 5389 | 233 | 80 | glotblastn |
| 2266 | LGM13 | gossypium_raimondii\|13v1\|DT527163_T1 | 5390 | 233 | 80 | glotblastn |
| 2267 | LGM13 | lupin\|13v4\|SRR520490.103160_T1 | 5391 | 233 | 80 | glotblastn |
| 2268 | LGM13 | lupin\|13v4\|SRR520490.143280_T1 | 5392 | 233 | 80 | glotblastn |
| 2269 | LGM13 | medicago\|13v1\|BF640720_T1 | 5393 | 233 | 80 | glotblastn |
| 2270 | LGM13 | poplar\|13v1\|XM_002309285_T1 | 5394 | 233 | 80 | glotblastn |
| 2271 | LGM13 | strawberry\|11v1\|CO381475 | 5395 | 233 | 80 | glotblastn |
| 2272 | LGM14 | sorghum\|13v2\|AW676925 | 5396 | 234 | 96.6 | globlastp |
| 2273 | LGM14 | echinochloa\|14v1\|SRR522894X152899D1_P1 | 5397 | 234 | 96.3 | globlastp |
| 2274 | LGM14 | foxtail_millet\|14v1\|JK579588_P1 | 5398 | 234 | 95.5 | globlastp |
| 2275 | LGM14 | foxtail_millet\|13v2\|SRR350548X10154 | 5398 | 234 | 95.5 | globlastp |
| 2276 | LGM14 | switchgrass\|12v1\|FE611046 | 5399 | 234 | 95.2 | globlastp |
| 2277 | LGM14 | foxtail_millet\|13v2\|SRR350548X118503 | 5400 | 234 | 94.1 | globlastp |
| 2278 | LGM14 | foxtail_millet\|14v1\|JK577335_P1 | 5400 | 234 | 94.1 | globlastp |
| 2279 | LGM14 | switchgrass\|12v1\|DN146456 | 5401 | 234 | 93.8 | globlastp |
| 2280 | LGM14 | rice\|13v2\|AA751646 | 5402 | 234 | 92.7 | globlastp |
| 2281 | LGM14 | pseudoroegneria\|gb167\|FF342064 | 5403 | 234 | 92.4 | globlastp |
| 2282 | LGM14 | oat\|14v1\|GO593334_P1 | 5404 | 234 | 91.8 | globlastp |
| 2283 | LGM14 | oat\|14v1\|SRR020741X224144D1_P1 | 5404 | 234 | 91.8 | globlastp |
| 2284 | LGM14 | oat\|14v1\|SRR020741X137507D1_P1 | 5405 | 234 | 91.3 | globlastp |
| 2285 | LGM14 | brachypodium\|13v2\|BRADI1G75150 | 5406 | 234 | 91.3 | globlastp |
| 2286 | LGM14 | brachypodium\|14v1\|DV471229_P1 | 5406 | 234 | 91.3 | globlastp |
| 2287 | LGM14 | fescue\|13v1\|GO799068_P1 | 5407 | 234 | 91 | globlastp |
| 2288 | LGM14 | fescue\|13v1\|DT680911_P1 | 5408 | 234 | 90.7 | globlastp |
| 2289 | LGM14 | oat\|14v1\|GR349063_P1 | 5409 | 234 | 86.2 | globlastp |
| 2290 | LGM14 | switchgrass\|12v1\|FL982427 | 5410 | 234 | 84.2 | globlastp |
| 2291 | LGM14 | barley\|12v1\|BG299277_P1 | 5411 | 234 | 82.4 | globlastp |
| 2292 | LGM14 | pineapple\|14v1\|ACOM14V1K19C1888797_T1 | 5412 | 234 | 82.02 | glotblastn |
| 2293 | LGM14 | pineapple\|14v1\|ACOM14V1K19C1363310_P1 | 5413 | 234 | 82 | globlastp |
| 2294 | LGM14 | oil_palm\|11v1\|SRR190698.150211_T1 | 5414 | 234 | 80.06 | glotblastn |
| 2295 | LGM15 | foxtail_millet\|13v2\|GT091038 | 5415 | 235 | 80.8 | globlastp |
| 2296 | LGM15 | foxtail_millet\|14v1\|GT091038_P1 | 5415 | 235 | 80.8 | globlastp |
| 2297 | LGM15 | switchgrass\|12v1\|FL749806 | 5416 | 235 | 80.8 | globlastp |
| 2298 | LGM15 | switchgrass\|12v1\|SRR187769.1049218 | 5417 | 235 | 80.5 | globlastp |
| 2299 | LGM16 | sorghum\|13v2\|BF586044 | 5418 | 236 | 95.5 | globlastp |
| 2300 | LGM16 | sugarcane\|10v1\|CA080976 | 5419 | 236 | 95.5 | globlastp |
| 2301 | LGM16 | echinochloa\|14v1\|SRR522894X107795D1_P1 | 5420 | 236 | 93.9 | globlastp |
| 2302 | LGM16 | foxtail_millet\|13v2\|SRR350548X100214 | 5421 | 236 | 92.1 | globlastp |
| 2303 | LGM16 | foxtail_millet\|14v1\|JK586238_P1 | 5421 | 236 | 92.1 | globlastp |
| 2304 | LGM16 | millet\|10v1\|CD725157_P1 | 5422 | 236 | 91.7 | globlastp |
| 2305 | LGM16 | brachypodium\|13v2\|BRADI1G76520 | 5423 | 236 | 84.9 | globlastp |
| 2306 | LGM16 | brachypodium\|14v1\|GT787070_P1 | 5423 | 236 | 84.9 | globlastp |
| 2307 | LGM16 | oat\|14v1\|GO590938_P1 | 5424 | 236 | 83.9 | globlastp |
| 2308 | LGM16 | oat\|14v1\|CN815186_P1 | 5425 | 236 | 83.8 | globlastp |
| 2309 | LGM16 | rice\|13v2\|BI805923 | 5426 | 236 | 83.3 | globlastp |
| 2310 | LGM16 | fescue\|13v1\|DT689483_P1 | 5427 | 236 | 82.5 | globlastp |
| 2311 | LGM16 | lolium\|13v1\|ES700335_P1 | 5428 | 236 | 81.5 | globlastp |
| 2312 | LGM16 | wheat\|12v3\|BE415113 | 5429 | 236 | 80.3 | globlastp |
| 2313 | LGM17 | foxtail_millet\|13v2\|SRR350548X134445 | 5430 | 237 | 96.7 | globlastp |
| 2314 | LGM17 | foxtail_millet\|14v1\|JK591234_P1 | 5430 | 237 | 96.7 | globlastp |
| 2315 | LGM17 | maize\|13v2\|AI901650_P1 | 5431 | 237 | 95.4 | globlastp |
| 2316 | LGM17 | foxtail_millet\|13v2\|SRR350548X209906 | 5432 | 237 | 95.4 | globlastp |
| 2317 | LGM17 | foxtail_millet\|14v1\|JK555631_P1 | 5432 | 237 | 95.4 | globlastp |
| 2318 | LGM17 | maize\|13v2\|W49427_P1 | 5433 | 237 | 91.9 | globlastp |
| 2319 | LGM17 | fescue\|13v1\|CK801247_P1 | 5434 | 237 | 90.8 | globlastp |
| 2320 | LGM17 | oat\|14v1\|GR346796_P1 | 5435 | 237 | 90.2 | globlastp |
| 2321 | LGM17 | rice\|13v2\|BM038723 | 5436 | 237 | 89.4 | globlastp |
| 2322 | LGM17 | oat\|14v1\|GR346797_P1 | 5437 | 237 | 88.9 | globlastp |
| 2323 | LGM17 | oat\|14v1\|SRR020741X26880D1_P1 | 5438 | 237 | 88.3 | globlastp |
| 2324 | LGM17 | lolium\|13v1\|ERR246395S19461_P1 | 5439 | 237 | 85.8 | globlastp |
| 2325 | LGM17 | brachypodium\|13v2\|BRADI4G07810 | 5440 | 237 | 83.9 | globlastp |
| 2326 | LGM17 | brachypodium\|14v1\|GT804793_P1 | 5440 | 237 | 83.9 | globlastp |
| 2327 | LGM17 | rice\|13v2\|CB631895 | 5441 | 237 | 83.3 | globlastp |
| 2328 | LGM17 | coconut\|14v1\|COCOS14V1K19C1112181_P1 | 5442 | 237 | 81.7 | globlastp |
| 2329 | LGM17 | echinochloa\|14v1\|SRR522894X151488D1_P1 | 5443 | 237 | 81.2 | globlastp |
| 2330 | LGM17 | coconut\|14v1\|COCOS14V1K23C155049_P1 | 5444 | 237 | 81 | globlastp |
| 2331 | LGM17 | coconut\|14v1\|COCOS14V1K19C1151663_P1 | 5445 | 237 | 80.4 | globlastp |
| 2332 | LGM17 | pineapple\|14v1\|ACOM14V1K19C1385749_P1 | 5446 | 237 | 80.2 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2333 | LGM17 | pineapple|14v1|ACOM14V1K19C1432945_P1 | 5446 | 237 | 80.2 | globlastp |
| 2334 | LGM18 | maize|13v2|CF043821_P1 | 5447 | 238 | 86.5 | globlastp |
| 2335 | LGM18 | sorghum|13v2|AW284333 | 5448 | 238 | 86.4 | globlastp |
| 2336 | LGM18 | switchgrass|12v1|DN142367 | 5449 | 238 | 86.1 | globlastp |
| 2337 | LGM18 | foxtail_millet|13v2|SRR350548X114235 | 5450 | 238 | 85.8 | globlastp |
| 2338 | LGM18 | foxtail_millet|14v1|JK561597_P1 | 5450 | 238 | 85.8 | globlastp |
| 2339 | LGM18 | switchgrass|12v1|FL706315 | 5451 | 238 | 85.5 | globlastp |
| 2340 | LGM18 | maize|13v2|CO455501_P1 | 5452 | 238 | 85.3 | globlastp |
| 2341 | LGM18 | rye|12v1|DRR001012.139301 | 5453 | 238 | 84.2 | globlastp |
| 2342 | LGM18 | oat|14v1|SRR020741X155500D1_P1 | 5454 | 238 | 84 | globlastp |
| 2343 | LGM18 | wheat|12v3|AJ614742 | 5455 | 238 | 83 | globlastp |
| 2344 | LGM18 | fescue|13v1|DT685890_P1 | 5456 | 238 | 82.5 | globlastp |
| 2354 | LGM21 | sorghum|13v2|CF427857 | 5465 | 240 | 98.6 | globlastp |
| 2355 | LGM21 | maize|13v2|CD965228_P1 | 5466 | 240 | 97.9 | globlastp |
| 2356 | LGM21 | switchgrass|12v1|FL740950 | 5467 | 240 | 97.9 | globlastp |
| 2357 | LGM21 | foxtail_millet|13v2|SRR350548X422447 | 5468 | 240 | 97.2 | globlastp |
| 2358 | LGM21 | foxtail_millet|14v1|JK590448_P1 | 5468 | 240 | 97.2 | globlastp |
| 2359 | LGM21 | sugarcane|10v1|CA143570 | 5469 | 240 | 97.2 | globlastp |
| 2360 | LGM21 | echinochloa|14v1|ECHC14V1K19C119845_P1 | 5470 | 240 | 96.5 | globlastp |
| 2361 | LGM21 | millet|10v1|EVO454PM048685_P1 | 5471 | 240 | 96.5 | globlastp |
| 2362 | LGM21 | switchgrass|12v1|FE601199 | 5472 | 240 | 96.5 | globlastp |
| 2363 | LGM21 | foxtail_millet|13v2|SRR350548X123946 | 5473 | 240 | 93.7 | globlastp |
| 2364 | LGM21 | foxtail_millet|14v1|XM_004975560_P1 | 5473 | 240 | 93.7 | globlastp |
| 2365 | LGM21 | switchgrass|12v1|GR878391 | 5474 | 240 | 93.7 | globlastp |
| 2366 | LGM21 | rice|13v2|BI811700 | 5475 | 240 | 93 | globlastp |
| 2367 | LGM21 | switchgrass|12v1|GD007879 | 5476 | 240 | 92.31 | glotblastn |
| 2368 | LGM21 | barley|12v1|AV833687_P1 | 5477 | 240 | 92.3 | globlastp |
| 2369 | LGM21 | barley|12v1|AV916171_P1 | 5477 | 240 | 92.3 | globlastp |
| 2370 | LGM21 | brachypodium|13v2|BRADI1G54910 | 5477 | 240 | 92.3 | globlastp |
| 2371 | LGM21 | brachypodium|14v1|DV472924_P1 | 5477 | 240 | 92.3 | globlastp |
| 2372 | LGM21 | brachypodium|13v2|BRADI1G56290 | 5477 | 240 | 92.3 | globlastp |
| 2373 | LGM21 | brachypodium|14v1|DV489387_P1 | 5477 | 240 | 92.3 | globlastp |
| 2374 | LGM21 | oat|14v1|GO594575_P1 | 5478 | 240 | 91.6 | globlastp |
| 2375 | LGM21 | oat|11v1|GO596154 | 5478 | 240 | 91.6 | globlastp |
| 2376 | LGM21 | rice|13v2|CF295801 | 5479 | 240 | 91.6 | globlastp |
| 2377 | LGM21 | rye|12v1|DRR001012.336282 | 5480 | 240 | 91.6 | globlastp |
| 2378 | LGM21 | rye|12v1|DRR001012.519286 | 5480 | 240 | 91.6 | globlastp |
| 2379 | LGM21 | rye|12v1|DRR001013.1473 | 5480 | 240 | 91.6 | globlastp |
| 2380 | LGM21 | wheat|12v3|BM136725 | 5480 | 240 | 91.6 | globlastp |
| 2381 | LGM21 | fescue|13v1|GO797518_P1 | 5481 | 240 | 90.9 | globlastp |
| 2382 | LGM21 | lolium|13v1|GR523252_P1 | 5482 | 240 | 90.9 | globlastp |
| 2383 | LGM21 | wheat|12v3|BQ901445 | 5483 | 240 | 90.9 | globlastp |
| 2384 | LGM21 | oat|14v1|SRR346072X4884D1_P1 | 5484 | 240 | 90.2 | globlastp |
| 2385 | LGM21 | oat|11v1|CN815728 | 5485 | 240 | 90.2 | globlastp |
| 2386 | LGM21 | oat|11v1|GO594575 | 5486 | 240 | 90.2 | globlastp |
| 2387 | LGM21 | rye|12v1|DRR001015.326363 | 5487 | 240 | 90.2 | globlastp |
| 2388 | LGM21 | oat|14v1|SRR020741X224099D1_T1 | 5488 | 240 | 89.51 | glotblastn |
| 2389 | LGM21 | oat|14v1|ASTE13V1K19C739127_P1 | 5489 | 240 | 89.5 | globlastp |
| 2390 | LGM21 | banana|14v1|FL661672_P1 | 5490 | 240 | 87.4 | globlastp |
| 2391 | LGM21 | banana|12v1|FL661672 | 5490 | 240 | 87.4 | globlastp |
| 2392 | LGM21 | aquilegia|10v2|DR937485_P1 | 5491 | 240 | 86.7 | globlastp |
| 2393 | LGM21 | pineapple|14v1|ACOM14V1K19C1508498_P1 | 5492 | 240 | 86 | globlastp |
| 2394 | LGM21 | oil_palm|11v1|EY401455_P1 | 5493 | 240 | 86 | globlastp |
| 2395 | LGM21 | oil_palm|11v1|SRR190699.435253_P1 | 5493 | 240 | 86 | globlastp |
| 2396 | LGM21 | phyla|11v2|SRR099035X56157_T1 | 5494 | 240 | 85.31 | glotblastn |
| 2397 | LGM21 | coconut|14v1|COCOS14V1K19C1740067_P1 | 5495 | 240 | 85.3 | globlastp |
| 2398 | LGM21 | zostera|12v1|SRR057351X141935D1 | 5496 | 240 | 85.3 | globlastp |
| 2399 | LGM21 | onion|14v1|CF445736_P1 | 5497 | 240 | 84.6 | globlastp |
| 2400 | LGM21 | amsonia|11v1|SRR098688X186353_P1 | 5498 | 240 | 84.6 | globlastp |
| 2401 | LGM21 | aristolochia|10v1|SRR039082S0013029_P1 | 5499 | 240 | 84.6 | globlastp |
| 2402 | LGM21 | cassava|09v1|JGICASSAVA30881VALIDM1_P1 | 5500 | 240 | 84.6 | globlastp |
| 2403 | LGM21 | grape|13v1|GSVIVT01031287001_P1 | 5501 | 240 | 84.6 | globlastp |
| 2404 | LGM21 | poppy|11v1|SRR030260.379131_P1 | 5502 | 240 | 84.6 | globlastp |
| 2405 | LGM21 | sesame|12v1|BU668838 | 5503 | 240 | 84.6 | globlastp |
| 2406 | LGM21 | tabernaemontana|11v1|SRR098689X200726 | 5504 | 240 | 84.6 | globlastp |
| 2407 | LGM21 | watermelon|11v1|AM716572 | 5505 | 240 | 84.6 | globlastp |
| 2408 | LGM21 | amorphophallus|11v2|SRR346501.346667_T1 | 5506 | 240 | 83.92 | glotblastn |
| 2409 | LGM21 | onion|12v1|SRR073446X102349D1 | 5507 | 240 | 83.92 | glotblastn |
| 2410 | LGM21 | poppy|11v1|SRR030261.17010_T1 | 5508 | 240 | 83.92 | glotblastn |
| 2411 | LGM21 | tripterygium|11v1|SRR098677X104658 | 5509 | 240 | 83.92 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2412 | LGM21 | utricularia\|11v1\|SRR094438.114689 | 5510 | 240 | 83.92 | glotblastn |
| 2413 | LGM21 | castorbean\|14v2\|XM_002534261_P1 | 5511 | 240 | 83.9 | globlastp |
| 2414 | LGM21 | parsley\|14v1\|BSS12K19C1064786_P1 | 5512 | 240 | 83.9 | globlastp |
| 2415 | LGM21 | castorbean\|12v1\|XM_002534261 | 5511 | 240 | 83.9 | globlastp |
| 2416 | LGM21 | cotton\|11v1\|SRR032367.1120737_P1 | 5513 | 240 | 83.9 | globlastp |
| 2417 | LGM21 | gossypium_raimondii\|13v1\|SRR278711.213817_P1 | 5513 | 240 | 83.9 | globlastp |
| 2418 | LGM21 | liquorice\|gb171\|FS244723_P1 | 5514 | 240 | 83.9 | globlastp |
| 2419 | LGM21 | monkeyflower\|12v1\|GR013887_P1 | 5515 | 240 | 83.9 | globlastp |
| 2420 | LGM21 | nicotiana_benthamiana\|12v1\|EB428295_P1 | 5516 | 240 | 83.9 | globlastp |
| 2421 | LGM21 | oil_palm\|11v1\|EL681798_P1 | 5517 | 240 | 83.9 | globlastp |
| 2422 | LGM21 | peanut\|13v1\|SRR042413X72388_P1 | 5518 | 240 | 83.9 | globlastp |
| 2423 | LGM21 | poplar\|13v1\|BI128942_P1 | 5519 | 240 | 83.9 | globlastp |
| 2424 | LGM21 | tobacco\|gb162\|EB428295 | 5520 | 240 | 83.9 | globlastp |
| 2425 | LGM21 | utricularia\|11v1\|SRR094438.115834 | 5521 | 240 | 83.9 | globlastp |
| 2426 | LGM21 | amaranthus\|13v1\|SRR172677X298686D1_T1 | 5522 | 240 | 83.22 | glotblastn |
| 2427 | LGM21 | amaranthus\|13v1\|SRR039411X130892D1_P1 | 5523 | 240 | 83.2 | globlastp |
| 2428 | LGM21 | acacia\|10v1\|FS588684_P1 | 5524 | 240 | 83.2 | globlastp |
| 2429 | LGM21 | aquilegia\|10v2\|DR932041_P1 | 5525 | 240 | 83.2 | globlastp |
| 2430 | LGM21 | basilicum\|13v1\|DY332868_P1 | 5526 | 240 | 83.2 | globlastp |
| 2431 | LGM21 | cowpea\|12v1\|FF383498_P1 | 5527 | 240 | 83.2 | globlastp |
| 2432 | LGM21 | cucumber\|09v1\|AM716572_P1 | 5528 | 240 | 83.2 | globlastp |
| 2433 | LGM21 | dandelion\|10v1\|DR401258_P1 | 5529 | 240 | 83.2 | globlastp |
| 2434 | LGM21 | eucalyptus\|11v2\|CD668064_P1 | 5530 | 240 | 83.2 | globlastp |
| 2435 | LGM21 | heritiera\|10v1\|SRR005795S0006349_P1 | 5531 | 240 | 83.2 | globlastp |
| 2436 | LGM21 | lupin\|13v4\|SRR520491.279506_P1 | 5532 | 240 | 83.2 | globlastp |
| 2437 | LGM21 | medicago\|13v1\|BI269948_P1 | 5533 | 240 | 83.2 | globlastp |
| 2438 | LGM21 | orange\|11v1\|EB686972_P1 | 5534 | 240 | 83.2 | globlastp |
| 2439 | LGM21 | pigeonpea\|11v1\|SRR054580X10043_P1 | 5535 | 240 | 83.2 | globlastp |
| 2440 | LGM21 | potato\|10v1\|BG886794_P1 | 5536 | 240 | 83.2 | globlastp |
| 2441 | LGM21 | silene\|11v1\|SRR096785X222618 | 5537 | 240 | 83.2 | globlastp |
| 2442 | LGM21 | solanum_phureja\|09v1\|SPHAI782474 | 5536 | 240 | 83.2 | globlastp |
| 2443 | LGM21 | vinca\|11v1\|SRR098690X207685 | 5538 | 240 | 83.2 | globlastp |
| 2444 | LGM21 | bupleurum\|11v1\|SRR301254.111782_T1 | 5539 | 240 | 82.52 | glotblastn |
| 2445 | LGM21 | tomato\|13v1\|AI782474 | — | 240 | 82.52 | glotblastn |
| 2446 | LGM21 | amborella\|12v3\|CK757480_P1 | 5540 | 240 | 82.5 | globlastp |
| 2447 | LGM21 | bean\|13v1\|CB540717_P1 | 5541 | 240 | 82.5 | globlastp |
| 2448 | LGM21 | cacao\|13v1\|CF974229_P1 | 5542 | 240 | 82.5 | globlastp |
| 2449 | LGM21 | cassava\|09v1\|CK649783_P1 | 5543 | 240 | 82.5 | globlastp |
| 2450 | LGM21 | cotton\|11v1\|BG446435_P1 | 5544 | 240 | 82.5 | globlastp |
| 2451 | LGM21 | eggplant\|10v1\|FS067153_P1 | 5545 | 240 | 82.5 | globlastp |
| 2452 | LGM21 | euonymus\|11v1\|SRR070038X181362_P1 | 5546 | 240 | 82.5 | globlastp |
| 2453 | LGM21 | fagopyrum\|11v1\|SRR063689X100287_P1 | 5547 | 240 | 82.5 | globlastp |
| 2454 | LGM21 | flaveria\|11v1\|SRR149229.157535_P1 | 5548 | 240 | 82.5 | globlastp |
| 2455 | LGM21 | flaveria\|11v1\|SRR149229.376367_P1 | 5548 | 240 | 82.5 | globlastp |
| 2456 | LGM21 | gossypium_raimondii\|13v1\|BG446435_P1 | 5544 | 240 | 82.5 | globlastp |
| 2457 | LGM21 | melon\|10v1\|AM716572_P1 | 5549 | 240 | 82.5 | globlastp |
| 2458 | LGM21 | prunus_mume\|13v1\|AJ826365 | 5550 | 240 | 82.5 | globlastp |
| 2459 | LGM21 | prunus\|10v1\|CK900631 | 5550 | 240 | 82.5 | globlastp |
| 2460 | LGM21 | sarracenia\|11v1\|SRR192669.107715 | 5551 | 240 | 82.5 | globlastp |
| 2461 | LGM21 | spurge\|gb161\|DV156350 | 5552 | 240 | 82.5 | globlastp |
| 2462 | LGM21 | strawberry\|11v1\|EX667033 | 5553 | 240 | 82.5 | globlastp |
| 2463 | LGM21 | tripterygium\|11v1\|SRR098677X182510 | 5554 | 240 | 82.5 | globlastp |
| 2464 | LGM21 | onion\|14v1\|SRR073446X498773D1_P1 | 5555 | 240 | 82.1 | globlastp |
| 2465 | LGM21 | cirsium\|11v1\|SRR346952.1026977_T1 | 5556 | 240 | 81.82 | glotblastn |
| 2466 | LGM21 | sarracenia\|11v1\|SRR192669.197189 | 5557 | 240 | 81.82 | glotblastn |
| 2467 | LGM21 | chestnut\|14v1\|SRR006295X99572D1_P1 | 5558 | 240 | 81.8 | globlastp |
| 2468 | LGM21 | chestnut\|14v1\|SRR006297X53816D1_P1 | 5559 | 240 | 81.8 | globlastp |
| 2469 | LGM21 | chrysanthemum\|14v1\|SRR290491X107192D1_P1 | 5560 | 240 | 81.8 | globlastp |
| 2470 | LGM21 | chrysanthemum\|14v1\|SRR525216X69552D1_P1 | 5560 | 240 | 81.8 | globlastp |
| 2471 | LGM21 | cichorium\|14v1\|EH702384_P1 | 5561 | 240 | 81.8 | globlastp |
| 2472 | LGM21 | centaurea\|11v1\|EH771715_P1 | 5562 | 240 | 81.8 | globlastp |
| 2473 | LGM21 | centaurea\|11v1\|SRR346938.158575_P1 | 5562 | 240 | 81.8 | globlastp |
| 2474 | LGM21 | centaurea\|11v1\|SRR346941.206096_P1 | 5562 | 240 | 81.8 | globlastp |
| 2475 | LGM21 | cirsium\|11v1\|SRR346952.131101_P1 | 5563 | 240 | 81.8 | globlastp |
| 2476 | LGM21 | clementine\|11v1\|EB686972_P1 | 5564 | 240 | 81.8 | globlastp |
| 2477 | LGM21 | cotton\|11v1\|CO127373_P1 | 5565 | 240 | 81.8 | globlastp |
| 2478 | LGM21 | cucurbita\|11v1\|SRR091276X132116_P1 | 5566 | 240 | 81.8 | globlastp |
| 2479 | LGM21 | euonymus\|11v1\|SRR070038X154489_P1 | 5567 | 240 | 81.8 | globlastp |
| 2480 | LGM21 | ginseng\|13v1\|SRR547977.311680_P1 | 5568 | 240 | 81.8 | globlastp |
| 2482 | LGM21 | gnetum\|10v1\|SRR064399S0007956_P1 | 5569 | 240 | 81.8 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2482 | LGM21 | guizotia\|10v1\|GE552075_P1 | 5570 | 240 | 81.8 | globlastp |
| 2483 | LGM21 | lettuce\|12v1\|DW048509_P1 | 5561 | 240 | 81.8 | globlastp |
| 2484 | LGM21 | lotus\|09v1\|LLGO031650_P1 | 5571 | 240 | 81.8 | globlastp |
| 2485 | LGM21 | nasturtium\|11v1\|GH163708_P1 | 5572 | 240 | 81.8 | globlastp |
| 2486 | LGM21 | oak\|10v1\|FP036963_P1 | 5558 | 240 | 81.8 | globlastp |
| 2487 | LGM21 | oak\|10v1\|FP050198_P1 | 5559 | 240 | 81.8 | globlastp |
| 2488 | LGM21 | primula\|11v1\|SRR098679X111361_P1 | 5573 | 240 | 81.8 | globlastp |
| 2489 | LGM21 | quinoa\|13v2\|SRR315569X167153 | 5574 | 240 | 81.8 | globlastp |
| 2490 | LGM21 | safflower\|gb162\|EL403279 | 5575 | 240 | 81.8 | globlastp |
| 2491 | LGM21 | soybean\|13v2\|GLYMA09G41140T2 | 5576 | 240 | 81.8 | globlastp |
| 2492 | LGM21 | onion\|12v1\|FS216857 | 5577 | 240 | 81.4 | globlastp |
| 2493 | LGM21 | blueberry\|12v1\|SRR353283X34092D1_T1 | 5578 | 240 | 81.12 | glotblastn |
| 2494 | LGM21 | flaveria\|11v1\|SRR149232.197232_T1 | 5579 | 240 | 81.12 | glotblastn |
| 2495 | LGM21 | ginseng\|13v1\|CN846687_T1 | 5580 | 240 | 81.12 | glotblastn |
| 2496 | LGM21 | humulus\|11v1\|SRR098684X183820_T1 | 5581 | 240 | 81.12 | glotblastn |
| 2497 | LGM21 | carrot\|14v1\|JG758214_P1 | 5582 | 240 | 81.1 | globlastp |
| 2498 | LGM21 | cichorium\|14v1\|EL366038_P1 | 5583 | 240 | 81.1 | globlastp |
| 2499 | LGM21 | apple\|11v1\|CK900631_P1 | 5584 | 240 | 81.1 | globlastp |
| 2500 | LGM21 | artemisia\|10v1\|SRR019254S0012319_P1 | 5585 | 240 | 81.1 | globlastp |
| 2501 | LGM21 | cannabis\|12v1\|JK493582_P1 | 5586 | 240 | 81.1 | globlastp |
| 2502 | LGM21 | cynara\|gb167\|GE588067_P1 | 5587 | 240 | 81.1 | globlastp |
| 2503 | LGM21 | echinacea\|13v1\|EPURP13V11027001_P1 | 5588 | 240 | 81.1 | globlastp |
| 2504 | LGM21 | echinacea\|13v1\|EPURP13V11875768_P1 | 5588 | 240 | 81.1 | globlastp |
| 2505 | LGM21 | echinacea\|13v1\|SRR315735S237953_P1 | 5588 | 240 | 81.1 | globlastp |
| 2506 | LGM21 | eschscholzia\|11v1\|SRR014116.105608_P1 | 5589 | 240 | 81.1 | globlastp |
| 2507 | LGM21 | fagopyrum\|11v1\|SRR063703X107943_P1 | 5590 | 240 | 81.1 | globlastp |
| 2508 | LGM21 | flax\|11v1\|JG110297_P1 | 5591 | 240 | 81.1 | globlastp |
| 2509 | LGM21 | ginseng\|13v1\|SRR547977.113601_P1 | 5592 | 240 | 81.1 | globlastp |
| 2510 | LGM21 | liriodendron\|gb166\|FD488199_P1 | 5593 | 240 | 81.1 | globlastp |
| 2511 | LGM21 | lotus\|09v1\|LLBW598945_P1 | 5594 | 240 | 81.1 | globlastp |
| 2512 | LGM21 | lupin\|13v4\|SRR520491.1020888_P1 | 5595 | 240 | 81.1 | globlastp |
| 2513 | LGM21 | nasturtium\|11v1\|SRR032558.142199XX1_P1 | 5596 | 240 | 81.1 | globlastp |
| 2514 | LGM21 | papaya\|gb165\|EX235814_P1 | 5597 | 240 | 81.1 | globlastp |
| 2515 | LGM21 | soybean\|13v2\|GLYMA11G26250 | 5598 | 240 | 81.1 | globlastp |
| 2516 | LGM21 | soybean\|13v2\|GLYMA18G06050 | 5599 | 240 | 81.1 | globlastp |
| 2517 | LGM21 | zinnia\|gb171\|AU291978 | 5600 | 240 | 81.1 | globlastp |
| 2518 | LGM21 | nicotiana_benthamiana\|12v1\|BP130291_P1 | 5601 | 240 | 80.8 | globlastp |
| 2519 | LGM21 | cucurbita\|11v1\|SRR091276X101343_T1 | 5602 | 240 | 80.42 | glotblastn |
| 2520 | LGM21 | ginseng\|13v1\|SRR547977.299289_T1 | 5603 | 240 | 80.42 | glotblastn |
| 2521 | LGM21 | clover\|14v1\|ERR351507S19XK19C285377_P1 | 5604 | 240 | 80.4 | globlastp |
| 2522 | LGM21 | cephalotaxus\|11v1\|SRR064395X398877_P1 | 5605 | 240 | 80.4 | globlastp |
| 2523 | LGM21 | radish\|gb164\|EX754201 | 5606 | 240 | 80.4 | globlastp |
| 2524 | LGM21 | sunflower\|12v1\|DY915727 | 5607 | 240 | 80.4 | globlastp |
| 2525 | LGM21 | sunflower\|12v1\|DY919507 | 5607 | 240 | 80.4 | globlastp |
| 2526 | LGM21 | sunflower\|12v1\|EE605865 | 5607 | 240 | 80.4 | globlastp |
| 2527 | LGM21 | valeriana\|11v1\|SRR099039X122782 | 5608 | 240 | 80.4 | globlastp |
| 2528 | LGM23 | foxtail_millet\|13v2\|SRR350548X138711 | 5609 | 242 | 87.6 | globlastp |
| 2529 | LGM23 | foxtail_millet\|14v1\|XM_004961679_P1 | 5609 | 242 | 87.6 | globlastp |
| 2530 | LGM23 | switchgrass\|12v1\|HO303762 | 5610 | 242 | 86.2 | globlastp |
| 2531 | LGM23 | switchgrass\|12v1\|DN143147 | 5611 | 242 | 85.4 | globlastp |
| 2532 | MGP15 | wheat\|12v3\|BE403709 | 5612 | 244 | 98.44 | glotblastn |
| 2533 | MGP15 | wheat\|12v3\|BE423525 | 5613 | 244 | 98.4 | globlastp |
| 2534 | MGP15 | wheat\|12v3\|CA693491 | 5614 | 244 | 98.4 | globlastp |
| 2535 | MGP15 | rye\|12v1\|DRR001012.104707 | 5615 | 244 | 97.9 | globlastp |
| 2536 | MGP15 | lolium\|13v1\|EL738032_P1 | 5616 | 244 | 94.6 | globlastp |
| 2537 | MGP15 | brachypodium\|13v2\|BRADI2G41610 | 5617 | 244 | 93.2 | globlastp |
| 2538 | MGP15 | brachypodium\|14v1\|GT760733_T1 | — | 244 | 93.19 | glotblastn |
| 2539 | MGP15 | foxtail_millet\|13v2\|SRR350548X120368 | 5618 | 244 | 88 | globlastp |
| 2540 | MGP15 | foxtail_millet\|14v1\|JK559155_P1 | 5618 | 244 | 88 | globlastp |
| 2541 | MGP15 | rice\|13v2\|BI118621 | 5619 | 244 | 88 | globlastp |
| 2542 | MGP15 | sorghum\|13v2\|BF421870 | 5620 | 244 | 87.8 | globlastp |
| 2543 | MGP15 | sugarcane\|10v1\|CA069567 | 5621 | 244 | 87.5 | globlastp |
| 2544 | MGP15 | maize\|13v2\|AI783334_P1 | 5622 | 244 | 85.2 | globlastp |
| 2545 | MGP15 | maize\|13v2\|AI891193_P1 | 5623 | 244 | 85.2 | globlastp |
| 2546 | MGP15 | switchgrass\|12v1\|FE602502 | 5624 | 244 | 84.67 | glotblastn |
| 2547 | MGP15 | rice\|13v2\|BM422183 | 5625 | 244 | 82.7 | globlastp |
| 2548 | MGP15 | rye\|12v1\|DRR001012.119075 | 5626 | 244 | 81.4 | globlastp |
| 2549 | MGP15 | wheat\|12v3\|BQ241004 | 5627 | 244 | 80.8 | globlastp |
| 2550 | MGP15 | wheat\|12v3\|CA500750 | 5628 | 244 | 80.8 | globlastp |
| 2551 | MGP15 | pineapple\|14v1\|ACOM14V1K19C2179980_T1 | 5629 | 244 | 80.79 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2552 | MGP15 | banana\|12v1\|ES433045 | 5630 | 244 | 80.42 | glotblastn |
| 2553 | MGP15 | coconut\|14v1\|COCOS14V1K19C1464096_P1 | 5631 | 244 | 80.3 | globlastp |
| 2554 | MGP15 | coconut\|14v1\|COCOS14V1K35C781277_P1 | 5632 | 244 | 80.3 | globlastp |
| 2555 | MGP15 | coconut\|14v1\|COCOS14V1K19C1283446_P1 | 5633 | 244 | 80.2 | globlastp |
| 2556 | MGP15 | banana\|12v1\|ES435470 | 5634 | 244 | 80.2 | globlastp |
| 2557 | MGP15 | foxtail_millet\|13v2\|SRR350548X155294 | 5635 | 244 | 80.06 | glotblastn |
| 2558 | MGP15 | foxtail_millet\|14v1\|JK583976_T1 | 5635 | 244 | 80.06 | glotblastn |
| 2559 | MGP16 | wheat\|12v3\|BE470804 | 5636 | 245 | 93.3 | globlastp |
| 2560 | MGP16 | pseudoroegneria\|gb167\|FF354406 | 5637 | 245 | 92.2 | globlastp |
| 2561 | MGP16 | rye\|12v1\|DRR001012.119714 | 5638 | 245 | 92.2 | globlastp |
| 2562 | MGP16 | leymus\|gb166\|EG395558_P1 | 5639 | 245 | 91.7 | globlastp |
| 2563 | MGP16 | rye\|12v1\|BE586272 | 5640 | 245 | 90.5 | glotblastn |
| 2564 | MGP16 | rye\|12v1\|DRR001012.118764 | 5641 | 245 | 87.22 | glotblastn |
| 2565 | MGP17 | wheat\|12v3\|CA653944 | 5642 | 246 | 95.9 | globlastp |
| 2566 | MGP17 | oat\|14v1\|SRR020741X110705D1_P1 | 5643 | 246 | 88 | globlastp |
| 2567 | MGP17 | brachypodium\|14v1\|DV483487_P1 | 5644 | 246 | 84.2 | globlastp |
| 2568 | MGP18 | gossypium_raimondii\|13v1\|DT457651_P1 | 5645 | 247 | 99.7 | globlastp |
| 2569 | MGP19 | maize\|13v2\|BE997261_P1 | 5646 | 248 | 84.7 | globlastp |
| 2570 | MGP19 | brachypodium\|13v2\|BRADI1G09537 | 5647 | 248 | 81.1 | globlastp |
| 2571 | MGP19 | brachypodium\|14v1\|GT789777_P1 | 5647 | 248 | 81.1 | globlastp |
| 2572 | MGP19 | rice\|13v2\|BI799956 | 5648 | 248 | 80.3 | globlastp |
| 2573 | MGP19 | oat\|14v1\|GO596907_T1 | 5649 | 248 | 80.11 | glotblastn |
| 2574 | MGP19 | oat\|14v1\|GR331245_T1 | 5650 | 248 | 80.07 | glotblastn |
| 2575 | MGP20 | sugarcane\|10v1\|AA525654 | 5651 | 249 | 96.8 | globlastp |
| 2576 | MGP20 | sorghum\|13v2\|CD430637 | 5652 | 249 | 96.4 | globlastp |
| 2577 | MGP20 | millet\|10v1\|EVO454PM000705_P1 | 5653 | 249 | 94 | globlastp |
| 2578 | MGP20 | foxtail_millet\|13v2\|SRR350548X17296 | 5654 | 249 | 93.5 | globlastp |
| 2579 | MGP20 | foxtail_millet\|14v1\|XM_004981485_P1 | 5654 | 249 | 93.5 | globlastp |
| 2580 | MGP20 | switchgrass\|12v1\|GD008884 | 5655 | 249 | 93.5 | globlastp |
| 2581 | MGP20 | switchgrass\|12v1\|HO302009 | 5656 | 249 | 89.52 | glotblastn |
| 2582 | MGP20 | rice\|13v2\|BF475213 | 5657 | 249 | 88.3 | globlastp |
| 2583 | MGP20 | echinochloa\|14v1\|ECHC14V1K19C539357_P1 | 5658 | 249 | 84.7 | globlastp |
| 2584 | MGP21 | sorghum\|13v2\|BE597965 | 5659 | 250 | 98.4 | globlastp |
| 2585 | MGP21 | switchgrass\|12v1\|DN143877 | 5660 | 250 | 95.8 | globlastp |
| 2586 | MGP21 | switchgrass\|12v1\|FE657974 | 5661 | 250 | 95.8 | globlastp |
| 2587 | MGP21 | foxtail_millet\|13v2\|SRR350548X164234 | 5662 | 250 | 95.4 | globlastp |
| 2588 | MGP21 | foxtail_millet\|14v1\|JK586035_P1 | 5662 | 250 | 95.4 | globlastp |
| 2589 | MGP21 | rice\|13v2\|BE040481 | 5663 | 250 | 93.8 | globlastp |
| 2590 | MGP21 | barley\|12v1\|CA015158_P1 | 5664 | 250 | 87.4 | globlastp |
| 2591 | MGP21 | brachypodium\|14v1\|XM_003563628_P1 | 5665 | 250 | 85.1 | globlastp |
| 2592 | MGP21 | brachypodium\|14v1\|DV486006_P1 | 5666 | 250 | 85 | globlastp |
| 2593 | MGP21 | brachypodium\|13v2\|BRADI3G07730 | 5666 | 250 | 85 | globlastp |
| 2594 | MGP21 | maize\|13v2\|CD959011_P1 | 5667 | 250 | 83.9 | globlastp |
| 2595 | MGP21 | pineapple\|14v1\|ACOM14V1K19C1249481_P1 | 5668 | 250 | 83.7 | globlastp |
| 2596 | MGP21 | foxtail_millet\|13v2\|SRR350548X102638 | 5669 | 250 | 83.6 | globlastp |
| 2597 | MGP21 | foxtail_millet\|14v1\|XM_004951451_P1 | 5669 | 250 | 83.6 | globlastp |
| 2598 | MGP21 | sorghum\|13v2\|AW679678 | 5670 | 250 | 83.4 | globlastp |
| 2599 | MGP21 | sugarcane\|10v1\|CA084978 | 5671 | 250 | 83.4 | globlastp |
| 2600 | MGP21 | barley\|12v1\|BG299822_P1 | 5672 | 250 | 83.1 | globlastp |
| 2601 | MGP21 | barley\|12v1\|HV12V1CUFF69370T1_P1 | 5672 | 250 | 83.1 | globlastp |
| 2602 | MGP21 | wheat\|12v3\|BE419923 | 5673 | 250 | 83 | globlastp |
| 2603 | MGP21 | chelidonium\|11v1\|SRR084752X104430_P1 | 5674 | 250 | 82.4 | globlastp |
| 2604 | MGP21 | oat\|11v1\|GO589552 | 5675 | 250 | 82.3 | globlastp |
| 2605 | MGP21 | rye\|12v1\|DRR001012.101530 | 5676 | 250 | 82.3 | globlastp |
| 2606 | MGP21 | switchgrass\|12v1\|DN141499 | 5677 | 250 | 82.3 | globlastp |
| 2607 | MGP21 | banana\|14v1\|MAGEN2012034401_P1 | 5678 | 250 | 82.2 | globlastp |
| 2608 | MGP21 | oat\|14v1\|GR326669_P1 | 5679 | 250 | 82.1 | globlastp |
| 2609 | MGP21 | aquilegia\|10v2\|DR913127_P1 | 5680 | 250 | 82.1 | globlastp |
| 2610 | MGP21 | banana\|12v1\|ES434839 | 5681 | 250 | 82 | globlastp |
| 2611 | MGP21 | banana\|12v1\|MAGEN2012034401 | 5682 | 250 | 82 | globlastp |
| 2612 | MGP21 | oat\|14v1\|GO589552_P1 | 5683 | 250 | 81.9 | globlastp |
| 2613 | MGP21 | oil_palm\|11v1\|EL683339_T1 | 5684 | 250 | 81.82 | glotblastn |
| 2614 | MGP21 | oat\|14v1\|SRR020741X322264D1_P1 | 5685 | 250 | 81.7 | globlastp |
| 2615 | MGP21 | carrot\|14v1\|BSS11K19C195484_P1 | 5686 | 250 | 81.6 | globlastp |
| 2616 | MGP21 | coconut\|14v1\|COCOS14V1K19C1032207_P1 | 5687 | 250 | 81.6 | globlastp |
| 2617 | MGP21 | banana\|12v1\|MAGEN2012021585 | 5688 | 250 | 81.6 | globlastp |
| 2618 | MGP21 | poppy\|11v1\|SRR030259.171768XX1_P1 | 5689 | 250 | 81.6 | globlastp |
| 2619 | MGP21 | banana\|14v1\|MAGEN2012021585_P1 | 5690 | 250 | 81.4 | globlastp |
| 2620 | MGP21 | tabernaemontana\|11v1\|SRR098689X100113XX1 | 5691 | 250 | 81.4 | globlastp |
| 2621 | MGP21 | amorphophallus\|11v2\|SRR089351X187736_P1 | 5692 | 250 | 81.2 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2622 | MGP21 | pigeonpea\|11v1\|SRR054580X194589_P1 | 5693 | 250 | 81.2 | globlastp |
| 2623 | MGP21 | poppy\|11v1\|SRR030259.12349_P1 | 5694 | 250 | 81.2 | globlastp |
| 2624 | MGP21 | carrot\|14v1\|BSS11K19C12642_P1 | 5695 | 250 | 81 | globlastp |
| 2625 | MGP21 | coconut\|14v1\|COCOS14V1K19C1260625_P1 | 5696 | 250 | 81 | globlastp |
| 2626 | MGP21 | cacao\|13v1\|DQ448874_P1 | 5697 | 250 | 81 | globlastp |
| 2627 | MGP21 | gossypium_raimondii\|13v1\|BE055710_P1 | 5698 | 250 | 81 | globlastp |
| 2628 | MGP21 | clementine\|11v1\|EB684584_P1 | 5699 | 250 | 80.8 | globlastp |
| 2629 | MGP21 | cotton\|11v1\|CO121922_P1 | 5700 | 250 | 80.8 | globlastp |
| 2630 | MGP21 | orange\|11v1\|EB684584_P1 | 5701 | 250 | 80.8 | globlastp |
| 2631 | MGP21 | parsley\|14v1\|BSS12K19C1018491_P1 | 5702 | 250 | 80.6 | globlastp |
| 2632 | MGP21 | cotton\|11v1\|BE055710_P1 | 5703 | 250 | 80.6 | globlastp |
| 2633 | MGP21 | pepper\|14v1\|BM062205_P1 | 5704 | 250 | 80.5 | globlastp |
| 2634 | MGP21 | parsley\|14v1\|BSS12K19C725457_T1 | 5705 | 250 | 80.46 | glotblastn |
| 2635 | MGP21 | parsley\|14v1\|BSS12K19C109380_P1 | 5706 | 250 | 80.4 | globlastp |
| 2636 | MGP21 | oak\|10v1\|CU640047_P1 | 5707 | 250 | 80.4 | globlastp |
| 2637 | MGP21 | vinca\|11v1\|SRR098690X134097 | 5708 | 250 | 80.4 | globlastp |
| 2638 | MGP21 | prunus\|10v1\|CN492154 | 5709 | 250 | 80.31 | glotblastn |
| 2639 | MGP21 | grape\|13v1\|GSVIVT01015472001_P1 | 5710 | 250 | 80.2 | globlastp |
| 2640 | MGP21 | grape\|13v1\|GSVIVT01035769001_P1 | 5711 | 250 | 80.2 | globlastp |
| 2641 | MGP21 | sesame\|12v1\|SESI12V1393399 | 5712 | 250 | 80.2 | globlastp |
| 2642 | MGP21 | prunus_mume\|13v1\|SRR345675.70686 | 5713 | 250 | 80.12 | glotblastn |
| 2643 | MGP21 | chestnut\|14v1\|SRR006295X116119D1_T1 | 5714 | 250 | 80 | glotblastn |
| 2644 | MGP21 | bean\|13v1\|FG228562_P1 | 5715 | 250 | 80 | globlastp |
| 2645 | MGP21 | olea\|13v1\|SRR014465X12818D1_T1 | 5716 | 250 | 80 | glotblastn |
| 2646 | MGP21 | strawberry\|11v1\|SRR034859S0005033 | 5717 | 250 | 80 | globlastp |
| 2647 | MGP23 | sorghum\|13v2\|BF585549 | 5718 | 252 | 95.3 | globlastp |
| 2648 | MGP23 | maize\|13v2\|AW061912_P1 | 5719 | 252 | 95.2 | globlastp |
| 2649 | MGP23 | foxtail_millet\|13v2\|SRR350548X114058 | 5720 | 252 | 92.8 | globlastp |
| 2650 | MGP23 | foxtail_millet\|14v1\|JK552921_P1 | 5720 | 252 | 92.8 | globlastp |
| 2651 | MGP23 | switchgrass\|12v1\|FE616828 | 5721 | 252 | 92.4 | globlastp |
| 2652 | MGP23 | switchgrass\|12v1\|FE613379 | 5722 | 252 | 92 | globlastp |
| 2653 | MGP23 | echinochloa\|14v1\|SRR522894X182583D1_P1 | 5723 | 252 | 91.8 | globlastp |
| 2654 | MGP23 | millet\|10v1\|EVO454PM004626_T1 | 5724 | 252 | 91.15 | glotblastn |
| 2655 | MGP23 | foxtail_millet\|13v2\|SRR350548X106248 | 5725 | 252 | 90.5 | globlastp |
| 2656 | MGP23 | foxtail_millet\|14v1\|JK590718_P1 | 5725 | 252 | 90.5 | globlastp |
| 2657 | MGP23 | rice\|13v2\|C93585 | 5726 | 252 | 88 | globlastp |
| 2658 | MGP23 | sorghum\|13v2\|BG050627 | 5727 | 252 | 87.3 | globlastp |
| 2659 | MGP23 | rye\|12v1\|DRR001012.124956 | 5728 | 252 | 86.7 | globlastp |
| 2660 | MGP23 | wheat\|12v3\|BQ801661 | 5729 | 252 | 86.7 | globlastp |
| 2661 | MGP23 | wheat\|12v3\|BQ240499 | 5730 | 252 | 86.6 | globlastp |
| 2662 | MGP23 | rye\|12v1\|DRR001012.105326 | 5731 | 252 | 86.4 | globlastp |
| 2663 | MGP23 | brachypodium\|13v2\|BRADI4G00730 | 5732 | 252 | 85.9 | globlastp |
| 2664 | MGP23 | brachypodium\|14v1\|GT775119_P1 | 5732 | 252 | 85.9 | globlastp |
| 2665 | MGP23 | rye\|12v1\|DRR001012.101341 | 5733 | 252 | 85.9 | globlastp |
| 2666 | MGP23 | barley\|12v1\|BG344529_P1 | 5734 | 252 | 85.6 | globlastp |
| 2667 | MGP23 | rye\|12v1\|DRR001012.108143 | 5735 | 252 | 81.06 | glotblastn |
| 2668 | MGP23 | barley\|12v1\|BU986045_P1 | 5736 | 252 | 80.9 | globlastp |
| 2669 | MGP25 | brachypodium\|13v2\|BRADI1G75450 | 5737 | 254 | 83.5 | globlastp |
| 2670 | MGP25 | brachypodium\|14v1\|XM_003558779_P1 | 5737 | 254 | 83.5 | globlastp |
| 2671 | MGP25 | switchgrass\|12v1\|FL689827 | 5738 | 254 | 81.1 | globlastp |
| 2672 | MGP25 | switchgrass\|12v1\|FE606348 | 5739 | 254 | 80.3 | globlastp |
| 2673 | MGP26 | switchgrass\|12v1\|FE627891 | 5740 | 255 | 90.5 | globlastp |
| 2674 | MGP26 | switchgrass\|12v1\|FE632937 | 5741 | 255 | 90.3 | globlastp |
| 2675 | MGP26 | foxtail_millet\|13v2\|SRR350548X187820 | 5742 | 255 | 90 | globlastp |
| 2676 | MGP26 | foxtail_millet\|14v1\|XM_004961975_P1 | 5742 | 255 | 90 | globlastp |
| 2677 | MGP26 | sorghum\|13v2\|CD431816 | 5743 | 255 | 89.1 | globlastp |
| 2678 | MGP26 | sugarcane\|10v1\|CA147488 | 5744 | 255 | 88.1 | globlastp |
| 2679 | MGP26 | brachypodium\|13v2\|BRADI2G24910 | 5745 | 255 | 87.3 | globlastp |
| 2680 | MGP26 | brachypodium\|14v1\|XM_003568370_P1 | 5745 | 255 | 87.3 | globlastp |
| 2681 | MGP26 | barley\|12v1\|AV835303_P1 | 5746 | 255 | 86.4 | globlastp |
| 2682 | MGP26 | maize\|13v2\|DW877026_P1 | 5747 | 255 | 85.1 | globlastp |
| 2683 | MGP26 | maize\|13v2\|CK826875_P1 | 5748 | 255 | 84.6 | globlastp |
| 2684 | MGP26 | sorghum\|13v2\|CF428718 | 5749 | 255 | 84 | globlastp |
| 2685 | MGP26 | switchgrass\|12v1\|SRR187770.1014778 | 5750 | 255 | 82.8 | globlastp |
| 2686 | MGP26 | rice\|13v2\|CI143684 | 5751 | 255 | 82.1 | globlastp |
| 2687 | MGP26 | wheat\|12v3\|CK202250 | 5752 | 255 | 82.06 | glotblastn |
| 2688 | MGP26 | wheat\|12v3\|CK195696 | 5753 | 255 | 81.85 | glotblastn |
| 2689 | MGP26 | oat\|14v1\|SRR020741X121755D1_T1 | 5754 | 255 | 81.8 | glotblastn |
| 2690 | MGP26 | wheat\|12v3\|CA617462 | 5755 | 255 | 81.7 | globlastp |
| 2691 | MGP26 | rye\|12v1\|DRR001012.377283 | 5756 | 255 | 81.25 | glotblastn |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2692 | MGP26 | oat\|14v1\|SRR020744X2229D1_P1 | 5757 | 255 | 80.6 | globlastp |
| 2693 | MGP26 | wheat\|12v3\|AL825380 | 5758 | 255 | 80.6 | globlastp |
| 2694 | MGP26 | brachypodium\|14v1\|BDJGIV2008681_P1 | 5759 | 255 | 80.4 | globlastp |
| 2695 | MGP26 | oat\|14v1\|ASTE13V1K23C753101_P1 | 5760 | 255 | 80.4 | globlastp |
| 2696 | MGP26 | oat\|14v1\|SRR020741X106434D1_P1 | 5761 | 255 | 80.4 | globlastp |
| 2697 | MGP26 | brachypodium\|13v2\|BRADI2G56970 | 5759 | 255 | 80.4 | globlastp |
| 2698 | MGP26 | brachypodium\|14v1\|XR_138061_P1 | 5759 | 255 | 80.4 | globlastp |
| 2699 | MGP26 | rye\|12v1\|BE704543 | 5762 | 255 | 80.4 | glotblastn |
| 2700 | MGP27 | brachypodium\|13v2\|BRADI4G05300 | 5763 | 256 | 80.4 | globlastp |
| 2701 | MGP27 | brachypodium\|14v1\|GT770421_P1 | 5763 | 256 | 80.4 | globlastp |
| 2702 | MGP30 | brachypodium\|14v1\|XM_003575941_P1 | 5764 | 258 | 83.9 | globlastp |
| 2703 | MGP30 | barley\|12v1\|BQ468900_P1 | 5765 | 258 | 83.1 | globlastp |
| 2704 | MGP30 | maize\|13v2\|EE041826_P1 | 5766 | 258 | 81.2 | globlastp |
| 2705 | MGP30 | brachypodium\|13v2\|BRADI1G46790 | 5767 | 258 | 81.07 | glotblastn |
| 2706 | MGP30 | brachypodium\|14v1\|XM_003564116_T1 | 5768 | 258 | 80.89 | glotblastn |
| 2707 | MGP30 | switchgrass\|12v1\|FL752785 | 5769 | 258 | 80.7 | globlastp |
| 2708 | MGP30 | switchgrass\|12v1\|FL745120 | 5770 | 258 | 80.2 | globlastp |
| 2709 | MGP33 | maize\|13v2\|W49460_P1 | 5771 | 259 | 89.7 | globlastp |
| 2710 | MGP33 | switchgrass\|12v1\|DN143687 | 5772 | 259 | 85.3 | globlastp |
| 2711 | MGP33 | echinochloa\|14v1\|SRR522894X125954D1_P1 | 5773 | 259 | 85.2 | globlastp |
| 2712 | MGP33 | echinochloa\|14v1\|SRR522894X100661D1_P1 | 5774 | 259 | 84.4 | globlastp |
| 2713 | MGP33 | foxtail_millet\|13v2\|EC613702 | 5775 | 259 | 83.7 | globlastp |
| 2714 | MGP33 | foxtail_millet\|14v1\|EC613702_P1 | 5775 | 259 | 83.7 | globlastp |
| 2715 | MGP33 | rice\|13v2\|U39603 | 5776 | 259 | 81.5 | globlastp |
| 2716 | MGP33 | wheat\|12v3\|BE400515 | 5777 | 259 | 81.5 | globlastp |
| 2717 | MGP33 | oat\|11v1\|CN818001XX2 | 5778 | 259 | 80.8 | globlastp |
| 2718 | MGP33 | fescue\|13v1\|DT680085_T1 | 5779 | 259 | 80.73 | glotblastn |
| 2719 | MGP33 | lolium\|13v1\|AU247350_P1 | 5780 | 259 | 80.3 | globlastp |
| 2720 | MGP34 | foxtail_millet\|13v2\|SRR350548X112944 | 5781 | 260 | 88.2 | globlastp |
| 2721 | MGP34 | foxtail_millet\|14v1\|XM_004981997_P1 | 5781 | 260 | 88.2 | globlastp |
| 2722 | MGP34 | switchgrass\|12v1\|FL693776 | 5782 | 260 | 87.4 | globlastp |
| 2723 | MGP34 | switchgrass\|12v1\|FL707978 | 5783 | 260 | 87.4 | globlastp |
| 2724 | MGP34 | millet\|10v1\|EVO454PM038129_T1 | 5784 | 260 | 87.02 | glotblastn |
| 2725 | MGP34 | echinochloa\|14v1\|SRR522894X217118D1_P1 | 5785 | 260 | 83.5 | globlastp |
| 2726 | MGP35 | sugarcane\|10v1\|BQ533620 | 5786 | 261 | 98.5 | globlastp |
| 2727 | MGP35 | maize\|13v2\|AI603703_P1 | 5787 | 261 | 95.7 | globlastp |
| 2728 | MGP35 | millet\|10v1\|EVO454PM006333_P1 | 5788 | 261 | 95.6 | globlastp |
| 2729 | MGP35 | switchgrass\|12v1\|DN143181 | 5789 | 261 | 95.3 | globlastp |
| 2730 | MGP35 | switchgrass\|12v1\|DN147531 | 5790 | 261 | 94.8 | globlastp |
| 2731 | MGP35 | echinochloa\|14v1\|SRR522894X170168D1_P1 | 5791 | 261 | 94.5 | globlastp |
| 2732 | MGP35 | foxtail_millet\|14v1\|EC613495_P1 | 5792 | 261 | 94.5 | globlastp |
| 2733 | MGP35 | foxtail_millet\|13v2\|EC613495 | 5792 | 261 | 94.5 | globlastp |
| 2734 | MGP35 | lovegrass\|gb167\|DN481848_P1 | 5793 | 261 | 91.8 | globlastp |
| 2735 | MGP35 | rice\|13v2\|AA751791 | 5794 | 261 | 91.8 | globlastp |
| 2736 | MGP35 | sorghum\|13v2\|AW671091 | 5795 | 261 | 91.3 | globlastp |
| 2737 | MGP35 | echinochloa\|14v1\|SRR522894X111230D1_P1 | 5796 | 261 | 90.7 | globlastp |
| 2738 | MGP35 | brachypodium\|13v2\|BRADI2G56030 | 5797 | 261 | 90.7 | globlastp |
| 2739 | MGP35 | brachypodium\|14v1\|DV474678_P1 | 5797 | 261 | 90.7 | globlastp |
| 2740 | MGP35 | switchgrass\|12v1\|SRR187765.258957 | 5798 | 261 | 90.7 | globlastp |
| 2741 | MGP35 | switchgrass\|12v1\|DN148413 | 5799 | 261 | 90.4 | globlastp |
| 2742 | MGP35 | echinochloa\|14v1\|SRR522894X103900D1_P1 | 5800 | 261 | 90.1 | globlastp |
| 2743 | MGP35 | maize\|13v2\|BG355384_P1 | 5801 | 261 | 90.1 | globlastp |
| 2744 | MGP35 | foxtail_millet\|13v2\|SRR350548X102337 | 5802 | 261 | 89.8 | globlastp |
| 2745 | MGP35 | foxtail_millet\|14v1\|JK556035_P1 | 5802 | 261 | 89.8 | globlastp |
| 2746 | MGP35 | echinochloa\|14v1\|SRR522894X140301D1_T1 | 5803 | 261 | 89.5 | glotblastn |
| 2747 | MGP35 | oat\|14v1\|GO595074_P1 | 5804 | 261 | 89.2 | globlastp |
| 2748 | MGP35 | oat\|14v1\|GR321410_P1 | 5804 | 261 | 89.2 | globlastp |
| 2749 | MGP35 | rice\|13v2\|AF378182 | 5805 | 261 | 89.2 | globlastp |
| 2750 | MGP35 | flaveria\|11v1\|SRR149229.427356_P1 | 5806 | 261 | 89.2 | globlastp |
| 2751 | MGP35 | flaveria\|11v1\|SRR149239.151497_P1 | 5806 | 261 | 89.2 | globlastp |
| 2752 | MGP35 | leymus\|gb166\|EG375854_P1 | 5807 | 261 | 89 | globlastp |
| 2753 | MGP35 | barley\|12v1\|BI949443_P1 | 5808 | 261 | 89 | globlastp |
| 2754 | MGP35 | triphysaria\|13v1\|EY169717 | 5809 | 261 | 89 | globlastp |
| 2755 | MGP35 | oat\|14v1\|CN817279_P1 | 5810 | 261 | 88.9 | globlastp |
| 2756 | MGP35 | oat\|11v1\|CN817279 | 5810 | 261 | 88.9 | globlastp |
| 2757 | MGP35 | oat\|14v1\|CN818403_P1 | 5810 | 261 | 88.9 | globlastp |
| 2758 | MGP35 | banana\|12v1\|AF130251 | 5811 | 261 | 88.9 | globlastp |
| 2759 | MGP35 | banana\|14v1\|AF130251_P1 | 5811 | 261 | 88.9 | globlastp |
| 2760 | MGP35 | fescue\|13v1\|DT696580_P1 | 5812 | 261 | 88.9 | globlastp |
| 2761 | MGP35 | flaveria\|11v1\|SRR149229.103790_P1 | 5813 | 261 | 88.9 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2762 | MGP35 | flaveria\|11v1\|SRR149232.106623_P1 | 5814 | 261 | 88.9 | globlastp |
| 2763 | MGP35 | plantago\|11v2\|SRR066373X105937_P1 | 5815 | 261 | 88.7 | globlastp |
| 2764 | MGP35 | flaveria\|11v1\|SRR149229.117805_T1 | 5816 | 261 | 88.63 | glotblastn |
| 2765 | MGP35 | coconut\|14v1\|COCOS14V1K29C855983_P1 | 5817 | 261 | 88.6 | globlastp |
| 2766 | MGP35 | cichorium\|14v1\|EH680019_P1 | 5818 | 261 | 88.6 | globlastp |
| 2767 | MGP35 | lettuce\|12v1\|AF162206_P1 | 5819 | 261 | 88.6 | globlastp |
| 2768 | MGP35 | echinacea\|13v1\|EPURP13V12555234_P1 | 5820 | 261 | 88.6 | globlastp |
| 2769 | MGP35 | flaveria\|11v1\|SRR149229.481433XX1_P1 | 5821 | 261 | 88.6 | globlastp |
| 2770 | MGP35 | guizotia\|10v1\|GE553301_P1 | 5822 | 261 | 88.6 | globlastp |
| 2771 | MGP35 | millet\|10v1\|EVO454PM018151_P1 | 5823 | 261 | 88.6 | globlastp |
| 2772 | MGP35 | sunflower\|12v1\|CF080554 | 5824 | 261 | 88.6 | globlastp |
| 2773 | MGP35 | sunflower\|12v1\|DY945061 | 5824 | 261 | 88.6 | globlastp |
| 2774 | MGP35 | oat\|11v1\|CN816652 | 5825 | 261 | 88.4 | globlastp |
| 2775 | MGP35 | triphysaria\|13v1\|EY166297 | 5826 | 261 | 88.4 | globlastp |
| 2776 | MGP35 | wheat\|12v3\|BE213261 | 5827 | 261 | 88.4 | globlastp |
| 2777 | MGP35 | wheat\|12v3\|BE500460 | 5828 | 261 | 88.4 | globlastp |
| 2778 | MGP35 | wheat\|12v3\|BF483838 | 5827 | 261 | 88.4 | globlastp |
| 2779 | MGP35 | monkeyflower\|12v1\|GO964306_P1 | 5829 | 261 | 88.4 | globlastp |
| 2780 | MGP35 | rye\|12v1\|DRR001012.102480 | 5830 | 261 | 88.4 | globlastp |
| 2781 | MGP35 | rye\|12v1\|DRR001012.107173 | 5830 | 261 | 88.4 | globlastp |
| 2782 | MGP35 | rye\|12v1\|DRR001012.11334 | 5830 | 261 | 88.4 | globlastp |
| 2783 | MGP35 | rye\|12v1\|DRR001012.131061 | 5830 | 261 | 88.4 | globlastp |
| 2784 | MGP35 | wheat\|12v3\|BE418005 | 5827 | 261 | 88.4 | globlastp |
| 2785 | MGP35 | wheat\|12v3\|CA731570 | 5828 | 261 | 88.4 | globlastp |
| 2786 | MGP35 | apple\|11v1\|CN494551_T1 | 5831 | 261 | 88.34 | glotblastn |
| 2787 | MGP35 | chrysanthemum\|14v1\|DK937507_P1 | 5832 | 261 | 88.3 | globlastp |
| 2788 | MGP35 | brachypodium\|13v2\|BRADI2G24090 | 5833 | 261 | 88.3 | globlastp |
| 2789 | MGP35 | brachypodium\|14v1\|DV487803_P1 | 5833 | 261 | 88.3 | globlastp |
| 2790 | MGP35 | ginger\|gb164\|DY345757_P1 | 5834 | 261 | 88.3 | globlastp |
| 2791 | MGP35 | sunflower\|12v1\|CD847711 | 5835 | 261 | 88.3 | globlastp |
| 2792 | MGP35 | coconut\|14v1\|COCOS14V1K19C1164745_P1 | 5836 | 261 | 88.1 | globlastp |
| 2793 | MGP35 | oat\|14v1\|CN816652_P1 | 5837 | 261 | 88.1 | globlastp |
| 2794 | MGP35 | olea\|13v1\|SRR014464X66123D1_P1 | 5838 | 261 | 88.1 | globlastp |
| 2795 | MGP35 | wheat\|12v3\|SRR043323X27090D1 | 5839 | 261 | 88.05 | glotblastn |
| 2796 | MGP35 | banana\|14v1\|MAGEN2012002515_P1 | 5840 | 261 | 88 | globlastp |
| 2797 | MGP35 | chrysanthemum\|14v1\|SRR290491X102974D1_P1 | 5841 | 261 | 88 | globlastp |
| 2798 | MGP35 | chrysanthemum\|14v1\|SRR290491X260477D1_P1 | 5841 | 261 | 88 | globlastp |
| 2799 | MGP35 | pineapple\|14v1\|ACOM14V1K19C1413728_P1 | 5842 | 261 | 88 | globlastp |
| 2800 | MGP35 | rye\|12v1\|BE495892 | 5843 | 261 | 88 | globlastp |
| 2801 | MGP35 | cotton\|11v1\|CO071333_P1 | 5844 | 261 | 88 | globlastp |
| 2802 | MGP35 | ambrosia\|11v1\|SRR346935.103087_P1 | 5845 | 261 | 88 | globlastp |
| 2803 | MGP35 | banana\|12v1\|MAGEN2012002515 | 5840 | 261 | 88 | globlastp |
| 2804 | MGP35 | cotton\|11v1\|CA993334_P1 | 5846 | 261 | 88 | globlastp |
| 2805 | MGP35 | curcuma\|10v1\|DY391238_P1 | 5847 | 261 | 88 | globlastp |
| 2806 | MGP35 | wheat\|12v3\|CA640404 | 5848 | 261 | 88 | globlastp |
| 2807 | MGP35 | wheat\|12v3\|CD919038 | 5849 | 261 | 88 | globlastp |
| 2808 | MGP35 | wheat\|12v3\|CJ884647 | 5850 | 261 | 88 | globlastp |
| 2809 | MGP35 | amaranthus\|13v1\|SRR039411X125306D1_P1 | 5851 | 261 | 87.8 | globlastp |
| 2810 | MGP35 | chrysanthemum\|14v1\|SRR525216X1214D1_P1 | 5852 | 261 | 87.8 | globlastp |
| 2811 | MGP35 | eucalyptus\|11v2\|CB967649_P1 | 5853 | 261 | 87.8 | globlastp |
| 2812 | MGP35 | artemisia\|10v1\|EY037407_P1 | 5854 | 261 | 87.8 | globlastp |
| 2813 | MGP35 | sunflower\|12v1\|BU672090 | 5855 | 261 | 87.8 | globlastp |
| 2814 | MGP35 | centaurea\|11v1\|EH734375_P1 | 5856 | 261 | 87.8 | globlastp |
| 2815 | MGP35 | cephalotaxus\|11v1\|SRR064395X106196_P1 | 5857 | 261 | 87.8 | globlastp |
| 2816 | MGP35 | gossypium_raimondii\|13v1\|CA993334_P1 | 5858 | 261 | 87.8 | globlastp |
| 2817 | MGP35 | rye\|12v1\|BF145234 | 5859 | 261 | 87.8 | globlastp |
| 2818 | MGP35 | triphysaria\|13v1\|SRR023500X107995 | 5860 | 261 | 87.8 | globlastp |
| 2819 | MGP35 | tragopogon\|10v1\|SRR020205S0002522 | 5861 | 261 | 87.76 | glotblastn |
| 2820 | MGP35 | chrysanthemum\|14v1\|CCOR13V1K19C1512860_P1 | 5862 | 261 | 87.5 | globlastp |
| 2821 | MGP35 | chrysanthemum\|14v1\|SRR290491X101608D1_P1 | 5863 | 261 | 87.5 | globlaslp |
| 2822 | MGP35 | cacao\|13v1\|CU481070_P1 | 5864 | 261 | 87.5 | globlastp |
| 2823 | MGP35 | sesame\|12v1\|JK059020 | 5865 | 261 | 87.5 | globlastp |
| 2824 | MGP35 | triphysaria\|13v1\|SRR023500X11699 | 5866 | 261 | 87.5 | globlastp |
| 2825 | MGP35 | ambrosia\|11v1\|SRR346943.241097_T1 | 5867 | 261 | 87.46 | glotblastn |
| 2826 | MGP35 | valeriana\|11v1\|SRR099039X142044 | 5868 | 261 | 87.46 | glotblastn |
| 2827 | MGP35 | flaveria\|11v1\|SRR149244.129471_T1 | 5869 | 261 | 87.21 | glotblastn |
| 2828 | MGP35 | potato\|10v1\|BE922234_P1 | 5870 | 261 | 87.2 | globlastp |
| 2829 | MGP35 | tomato\|13v1\|BG134468 | 5871 | 261 | 87.2 | globlastp |
| 2830 | MGP35 | aristolochia\|10v1\|SRR039082S0026801_P1 | 5872 | 261 | 87.2 | globlastp |
| 2831 | MGP35 | cacao\|13v1\|FC072160_P1 | 5873 | 261 | 87.2 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2832 | MGP35 | centaurea\|11v1\|EH753707_P1 | 5874 | 261 | 87.2 | globlastp |
| 2833 | MGP35 | cirsium\|11v1\|SRR346952.1000554_P1 | 5874 | 261 | 87.2 | globlastp |
| 2834 | MGP35 | cirsium\|11v1\|SRR346952.1000677_P1 | 5874 | 261 | 87.2 | globlastp |
| 2835 | MGP35 | prunus_mume\|13v1\|DW341878 | 5875 | 261 | 87.2 | globlastp |
| 2836 | MGP35 | solanum_phureja\|09v1\|SPHBG134468 | 5876 | 261 | 87.2 | globlastp |
| 2837 | MGP35 | pepper\|12v1\|GD064098 | 5877 | 261 | 86.9 | globlastp |
| 2838 | MGP35 | barley\|12v1\|BF629133_P1 | 5878 | 261 | 86.9 | globlastp |
| 2839 | MGP35 | coffea\|10v1\|DV685589_P1 | 5879 | 261 | 86.9 | globlastp |
| 2840 | MGP35 | dandelion\|10v1\|DY806919_P1 | 5880 | 261 | 86.9 | globlastp |
| 2841 | MGP35 | clementine\|11v1\|CV885954_P1 | 5881 | 261 | 86.9 | globlastp |
| 2842 | MGP35 | orange\|11v1\|CV885954_P1 | 5881 | 261 | 86.9 | globlastp |
| 2843 | MGP35 | platanus\|11v1\|SRR096786X100155_P1 | 5882 | 261 | 86.9 | globlastp |
| 2844 | MGP35 | triphysaria\|13v1\|SRR023500X11413 | 5883 | 261 | 86.9 | globlastp |
| 2845 | MGP35 | prunus\|10v1\|CN494551 | 5884 | 261 | 86.7 | globlastp |
| 2846 | MGP35 | cirsium\|11v1\|SRR346952.105633_P1 | 5885 | 261 | 86.6 | globlastp |
| 2847 | MGP35 | distylium\|11v1\|SRR065077X100934_P1 | 5886 | 261 | 86.6 | globlastp |
| 2848 | MGP35 | eggplant\|10v1\|FS022032_P1 | 5887 | 261 | 86.6 | globlastp |
| 2849 | MGP35 | nicotiana_benthamiana\|12v1\|EB677504_P1 | 5888 | 261 | 86.6 | globlastp |
| 2850 | MGP35 | sequoia\|10v1\|SRR065044S0001805 | 5889 | 261 | 86.6 | globlastp |
| 2851 | MGP35 | chrysanthemum\|14v1\|CCOR13V1K19C584400_P1 | 5890 | 261 | 86.3 | globlastp |
| 2852 | MGP35 | soybean\|13v2\|GLYMA16G28310 | 5891 | 261 | 86.3 | globlastp |
| 2853 | MGP35 | conyza\|10v1\|SRR035294S0000036_P1 | 5892 | 261 | 86.3 | globlastp |
| 2854 | MGP35 | nicotiana_benthamiana\|12v1\|BP747205_P1 | 5893 | 261 | 86.3 | globlastp |
| 2855 | MGP35 | gossypium_raimondii\|13v1\|BF268473_P1 | 5894 | 261 | 86.1 | globlastp |
| 2856 | MGP35 | onion\|14v1\|CF435208_P1 | 5895 | 261 | 86 | globlastp |
| 2857 | MGP35 | lotus\|09v1\|LLAV415589_P1 | 5896 | 261 | 86 | globlastp |
| 2858 | MGP35 | peanut\|13v1\|EE126296_P1 | 5897 | 261 | 86 | globlastp |
| 2859 | MGP35 | poplar\|13v1\|BI068614_P1 | 5898 | 261 | 86 | globlastp |
| 2860 | MGP35 | potato\|10v1\|BF053889_P1 | 5899 | 261 | 86 | globlastp |
| 2861 | MGP35 | beech\|11v1\|SRR006293.10946_P1 | 5900 | 261 | 86 | globlastp |
| 2862 | MGP35 | euphorbia\|11v1\|DV121804_P1 | 5901 | 261 | 86 | globlastp |
| 2863 | MGP35 | ginseng\|13v1\|DV555769_P1 | 5902 | 261 | 86 | globlastp |
| 2864 | MGP35 | onion\|12v1\|CF435208 | 5895 | 261 | 86 | globlastp |
| 2865 | MGP35 | solanum_phureja\|09v1\|SPHBG123415 | 5899 | 261 | 86 | globlastp |
| 2866 | MGP35 | taxus\|10v1\|SRRG32523S0000081 | 5903 | 261 | 86 | globlastp |
| 2867 | MGP35 | amorphophallus\|11v2\|SRR089351X113001_P1 | 5904 | 261 | 85.8 | globlastp |
| 2868 | MGP35 | cotton\|11v1\|BF268473XX2_P1 | 5905 | 261 | 85.8 | globlastp |
| 2869 | MGP35 | sciadopitys\|10v1\|SRR065035S0022728 | 5906 | 261 | 85.8 | globlastp |
| 2870 | MGP35 | cyclamen\|14v1\|B14ROOTK19C156122_P1 | 5907 | 261 | 85.7 | globlastp |
| 2871 | MGP35 | pepper\|14v1\|CO907209_P1 | 5908 | 261 | 85.7 | globlastp |
| 2872 | MGP35 | pepper\|12v1\|CO907209 | 5908 | 261 | 85.7 | globlastp |
| 2873 | MGP35 | poplar\|13v1\|BU878945_P1 | 5909 | 261 | 85.7 | globlastp |
| 2874 | MGP35 | aquilegia\|10v2\|DR916286_P1 | 5910 | 261 | 85.7 | globlastp |
| 2875 | MGP35 | tomato\|13v1\|BG123415 | 5911 | 261 | 85.7 | globlastp |
| 2876 | MGP35 | lupin\|13v4\|SRR520491.1018904_P1 | 5912 | 261 | 85.7 | globlastp |
| 2877 | MGP35 | pigeonpea\|11v1\|GR472463_P1 | 5913 | 261 | 85.7 | globlastp |
| 2878 | MGP35 | poppy\|11v1\|SRR030262.35304_P1 | 5914 | 261 | 85.7 | globlastp |
| 2879 | MGP35 | strawberry\|11v1\|DY671211 | 5915 | 261 | 85.7 | globlastp |
| 2880 | MGP35 | clover\|14v1\|BB917224_P1 | 5916 | 261 | 85.5 | globlastp |
| 2881 | MGP35 | clover\|14v1\|ERR351507S19XK19C287382_P1 | 5917 | 261 | 85.5 | globlastp |
| 2882 | MGP35 | clover\|14v1\|ERR351507S23XK23C210554_P1 | 5918 | 261 | 85.5 | globlastp |
| 2883 | MGP35 | abies\|11v2\|SRR098676X103016_P1 | 5919 | 261 | 85.5 | globlastp |
| 2884 | MGP35 | amsonia\|11v1\|SRR098686X105944_P1 | 5920 | 261 | 85.5 | globlastp |
| 2885 | MGP35 | cedrus\|11v1\|SRR065007X101257_P1 | 5921 | 261 | 85.5 | globlastp |
| 2886 | MGP35 | pine\|10v2\|AW010749_P1 | 5922 | 261 | 85.5 | globlastp |
| 2887 | MGP35 | blueberry\|12v1\|CV190758_T1 | 5923 | 261 | 85.42 | glotblastn |
| 2888 | MGP35 | cyclamen\|14v1\|B14ROOTK19C52645_P1 | 5924 | 261 | 85.4 | globlastp |
| 2889 | MGP35 | cyclamen\|14v1\|B3LEAFK19C111351_P1 | 5925 | 261 | 85.4 | globlastp |
| 2890 | MGP35 | beet\|12v1\|BE590341_P1 | 5926 | 261 | 85.4 | globlastp |
| 2891 | MGP35 | castorbean\|12v1\|EE256791 | 5927 | 261 | 85.4 | globlastp |
| 2892 | MGP35 | castorbean\|14v2\|EE256791_P1 | 5927 | 261 | 85.4 | globlastp |
| 2893 | MGP35 | ambrosia\|11v1\|SRR346935.89631_P1 | 5928 | 261 | 85.4 | globlastp |
| 2894 | MGP35 | chickpea\|13v2\|SRR133517.161221_P1 | 5929 | 261 | 85.4 | globlastp |
| 2895 | MGP35 | cleome_spinosa\|10v1\|GR934468_P1 | 5930 | 261 | 85.4 | globlastp |
| 2896 | MGP35 | medicago\|13v1\|AW695293_P1 | 5931 | 261 | 85.4 | globlastp |
| 2897 | MGP35 | pea\|11v1\|AY093594_P1 | 5932 | 261 | 85.4 | globlastp |
| 2898 | MGP35 | vinca\|11v1\|SRR098690X119970 | 5933 | 261 | 85.2 | globlastp |
| 2899 | MGP35 | soybean\|13v2\|GLYMA20G30620 | 5934 | 261 | 85.1 | globlastp |
| 2900 | MGP35 | bean\|13v1\|CA896765_P1 | 5935 | 261 | 85.1 | globlastp |
| 2901 | MGP35 | nasturtium\|11v1\|SRR032558.106468_P1 | 5936 | 261 | 85.1 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2902 | MGP35 | pigeonpea\|11v1\|SRR054580X14372_P1 | 5937 | 261 | 85.1 | globlastp |
| 2903 | MGP35 | quinoa\|13v2\|SRR315568X181063 | 5938 | 261 | 85.1 | globlastp |
| 2904 | MGP35 | vinca\|11v1\|SRR098690X108765 | 5939 | 261 | 85 | globlastp |
| 2905 | MGP35 | spruce\|11v1\|ES262108 | 5940 | 261 | 84.9 | globlastp |
| 2906 | MGP35 | quinoa\|13v2\|SRR315568X116134 | 5941 | 261 | 84.84 | glotblastn |
| 2907 | MGP35 | arabidopsis\|13v2\|AT1G43670_P1 | 5942 | 261 | 84.8 | globlastp |
| 2908 | MGP35 | cotton\|11v1\|AI725778_P1 | 5943 | 261 | 84.8 | globlastp |
| 2909 | MGP35 | cowpea\|12v1\|FF537383_P1 | 5944 | 261 | 84.8 | globlastp |
| 2910 | MGP35 | soybean\|13v2\|GLYMA10G36990 | 5945 | 261 | 84.8 | globlastp |
| 2911 | MGP35 | arabidopsis_lyrata\|13v1\|R64990_P1 | 5946 | 261 | 84.8 | globlastp |
| 2912 | MGP35 | cannabis\|12v1\|GR221470_P1 | 5947 | 261 | 84.8 | globlastp |
| 2913 | MGP35 | gossypium_raimondii\|13v1\|AI725778_P1 | 5948 | 261 | 84.8 | globlastp |
| 2914 | MGP35 | grape\|13v1\|GSVIVT01034516001_P1 | 5949 | 261 | 84.6 | globlastp |
| 2915 | MGP35 | maritime_pine\|10v1\|SRR073317S0112065_P1 | 5950 | 261 | 84.6 | globlastp |
| 2916 | MGP35 | pseudotsuga\|10v1\|SRR065119S0006124 | 5951 | 261 | 84.6 | globlastp |
| 2917 | MGP35 | amaranthus\|13v1\|SRR039411X146682D1_T1 | 5952 | 261 | 84.55 | glotblastn |
| 2918 | MGP35 | carrot\|14v1\|BSS10K19C121060_T1 | 5953 | 261 | 84.55 | glotblastn |
| 2919 | MGP35 | parsley\|14v1\|BSS12K19C333527_T1 | 5954 | 261 | 84.55 | glotblastn |
| 2920 | MGP35 | cassava\|09v1\|DV445162_P1 | 5955 | 261 | 84.5 | globlastp |
| 2921 | MGP35 | oak\|10v1\|DN950074_P1 | 5956 | 261 | 84.5 | globlastp |
| 2922 | MGP35 | chestnut\|14v1\|SRR006295X24384D1_P1 | 5957 | 261 | 84.3 | globlastp |
| 2923 | MGP35 | bean\|13v1\|CB542773_P1 | 5958 | 261 | 84.3 | globlastp |
| 2924 | MGP35 | catharanthus\|11v1\|SRR098691X100895_P1 | 5959 | 261 | 84.3 | globlastp |
| 2925 | MGP35 | cleome_gynandra\|10v1\|SRR015532S0001488_P1 | 5960 | 261 | 84.3 | globlastp |
| 2926 | MGP35 | sarracenia\|11v1\|SRR192669.118387 | 5961 | 261 | 84.09 | glotblastn |
| 2927 | MGP35 | chrysanthemum\|14v1\|CCOR13V1K23C1593271_P1 | 5962 | 261 | 84 | globlastp |
| 2928 | MGP35 | melon\|10v1\|AM722275_P1 | 5963 | 261 | 84 | globlastp |
| 2929 | MGP35 | onion\|14v1\|CF436368_P1 | 5964 | 261 | 84 | globlastp |
| 2930 | MGP35 | bean\|13v1\|CB539815_P1 | 5965 | 261 | 84 | globlastp |
| 2931 | MGP35 | tripterygium\|11v1\|SRR098677X141751 | 5966 | 261 | 84 | globlastp |
| 2932 | MGP35 | watermelon\|11v1\|DQ641061 | 5967 | 261 | 84 | globlastp |
| 2933 | MGP35 | cucumber\|09v1\|DQ641061_P1 | 5968 | 261 | 83.5 | globlastp |
| 2934 | MGP35 | cucurbita\|11v1\|SRR091276X135772_P1 | 5969 | 261 | 83.4 | globlastp |
| 2935 | MGP35 | thellungiella_halophilum\|13v1\|DN776897 | 5970 | 261 | 83.4 | globlastp |
| 2936 | MGP35 | canola\|11v1\|EE411898_P1 | 5971 | 261 | 83.1 | globlastp |
| 2937 | MGP35 | b_juncea\|12v1\|E6ANDIZ01AN79Q_P1 | 5972 | 261 | 83.1 | globlastp |
| 2938 | MGP35 | b_oleracea\|14v1\|AY161288_P1 | 5973 | 261 | 83.1 | globlastp |
| 2939 | MGP35 | b_oleracea\|gb161\|AM387331 | 5974 | 261 | 83.1 | globlastp |
| 2940 | MGP35 | b_rapa\|11v1\|AY161288_P1 | 5971 | 261 | 83.1 | globlastp |
| 2941 | MGP35 | canola\|11v1\|CN728724_P1 | 5972 | 261 | 83.1 | globlastp |
| 2942 | MGP35 | b_juncea\|12v1\|E6ANDIZ01AWRYD_P1 | 5975 | 261 | 83.1 | globlastp |
| 2943 | MGP35 | pineapple\|14v1\|ACOM14V1K19C1091984_P1 | 5976 | 261 | 82.8 | globlastp |
| 2944 | MGP35 | canola\|11v1\|BNU20179_P1 | 5977 | 261 | 82.8 | globlastp |
| 2945 | MGP35 | b_juncea\|12v1\|E6ANDIZ01A2RP8_P1 | 5978 | 261 | 82.8 | globlastp |
| 2946 | MGP35 | b_rapa\|11v1\|BNU20179_P1 | 5977 | 261 | 82.8 | globlastp |
| 2947 | MGP35 | ceratodon\|10v1\|SRR074890S0006655_P1 | 5979 | 261 | 82.8 | globlastp |
| 2948 | MGP35 | cucurbita\|11v1\|SRR091276X118561_T1 | 5980 | 261 | 82.8 | glotblastn |
| 2949 | MGP35 | lupin\|13v4\|SRR520491.1011833_P1 | 5981 | 261 | 82.8 | globlastp |
| 2950 | MGP35 | zostera\|12v1\|AM768662 | 5982 | 261 | 82.51 | glotblastn |
| 2951 | MGP35 | b_oleracea\|14v1\|BNU20179_P1 | 5983 | 261 | 82.5 | globlastp |
| 2952 | MGP35 | radish\|gb164\|EV565372 | 5984 | 261 | 82.5 | globlastp |
| 2953 | MGP35 | tripterygium\|11v1\|SRR098677X107123 | 5985 | 261 | 82.5 | globlastp |
| 2954 | MGP35 | ambrosia\|11v1\|SRR346935.107698_P1 | 5986 | 261 | 82.4 | globlastp |
| 2955 | MGP35 | maritime_pine\|10v1\|SRR073317S0023450_T1 | 5987 | 261 | 82.27 | glotblastn |
| 2956 | MGP35 | oat\|14v1\|ERR160119X122076D1_T1 | 5988 | 261 | 82.22 | glotblastn |
| 2957 | MGP35 | euonymus\|11v1\|SRR070038X225329_P1 | 5989 | 261 | 82.2 | globlastp |
| 2958 | MGP35 | pteridium\|11v1\|SRR043594X105298 | 5990 | 261 | 82.2 | globlastp |
| 2959 | MGP35 | trigonella\|11v1\|SRR066194X188200 | 5991 | 261 | 82.2 | globlastp |
| 2960 | MGP35 | physcomitrella\|13v1\|BI487880_P1 | 5992 | 261 | 82 | globlastp |
| 2961 | MGP35 | spruce\|11v1\|ES852698 | 5993 | 261 | 82 | globlastp |
| 2962 | MGP35 | chrysanthemum\|14v1\|CCOR13V1K23C1707250_T1 | 5994 | 261 | 81.92 | glotblastn |
| 2963 | MGP35 | silene\|11v1\|SRR096785X252708 | 5995 | 261 | 81.92 | glotblastn |
| 2964 | MGP35 | physcomitrella\|13v1\|BJ157670_P1 | 5996 | 261 | 81.7 | globlastp |
| 2965 | MGP35 | pine\|10v2\|AW010114_P1 | 5997 | 261 | 81.7 | globlastp |
| 2966 | MGP35 | heritiera\|10v1\|SRR005794S0006923_P1 | 5998 | 261 | 81.6 | globlastp |
| 2967 | MGP35 | podocarpus\|10v1\|SRR065014S0006033_T1 | 5999 | 261 | 81.39 | glotblastn |
| 2968 | MGP35 | cedrus\|11v1\|SRR065007X131355_T1 | 6000 | 261 | 81.34 | glotblastn |
| 2969 | MGP35 | pineapple\|14v1\|ACOM14V1K19C1664392_P1 | 6001 | 261 | 81 | globlastp |
| 2970 | MGP35 | soybean\|13v2\|GLYMA08G19430 | 6002 | 261 | 81 | globlastp |
| 2971 | MGP35 | flaveria\|11v1\|SRR149232.11384_P1 | 6003 | 261 | 81 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 2972 | MGP35 | clover|14v1|ERR351507S19XK19C741643_P1 | 6004 | 261 | 80.8 | globlastp |
| 2973 | MGP35 | clover|14v1|ERR351507S19XK19C758412_P1 | 6005 | 261 | 80.5 | globlastp |
| 2974 | MGP35 | medicago|13v1|AL386990_P1 | 6006 | 261 | 80.5 | globlastp |
| 2975 | MGP35 | arnica|11v1|SRR099034X100297_P1 | 6007 | 261 | 80.5 | globlastp |
| 2976 | MGP35 | flaveria|11v1|SRR149232.104395_P1 | 6008 | 261 | 80.2 | globlastp |
| 2977 | MGP35 | pigeonpea|11v1|SRR054580X109409_P1 | 6009 | 261 | 80.2 | globlastp |
| 2978 | MGP37 | foxtail_millet|13v2|SRR350549X711117 | 6010 | 262 | 89.7 | globlastp |
| 2979 | MGP37 | foxtail_millet|14v1|XM_004975416_P1 | 6010 | 262 | 89.7 | globlastp |
| 2980 | MGP37 | sorghum|13v2|CD228337 | 6011 | 262 | 87.4 | globlastp |
| 2981 | MGP37 | sugarcane|10v1|CA074074 | 6012 | 262 | 87.4 | globlastp |
| 2982 | MGP37 | foxtail_millet|13v2|SRR350548X156265 | 6013 | 262 | 86.5 | globlastp |
| 2983 | MGP37 | foxtail_millet|14v1|XM_004966253_P1 | 6013 | 262 | 86.5 | globlastp |
| 2984 | MGP37 | echinochloa|14v1|SRR522894X136126D1_P1 | 6014 | 262 | 86.1 | globlastp |
| 2985 | MGP37 | switchgrass|12v1|FE651728 | 6015 | 262 | 86.1 | globlastp |
| 2986 | MGP37 | maize|13v2|AW055996_P1 | 6016 | 262 | 85.8 | globlastp |
| 2987 | MGP37 | brachypodium|13v2|BRADI5G22340 | 6017 | 262 | 85.7 | globlastp |
| 2988 | MGP37 | brachypodium|14v1|GT760670_P1 | 6017 | 262 | 85.7 | globlastp |
| 2989 | MGP37 | millet|10v1|EVO454PM005485_P1 | 6018 | 262 | 85.7 | globlastp |
| 2990 | MGP37 | rice|13v2|AJ238318 | 6019 | 262 | 85.2 | globlastp |
| 2991 | MGP37 | rice|13v2|AU029727 | 6019 | 262 | 85.2 | globlastp |
| 2992 | MGP37 | switchgrass|12v1|FL732312 | 6020 | 262 | 85.2 | globlastp |
| 2993 | MGP37 | maize|13v2|AI782948_P1 | 6021 | 262 | 84.8 | globlastp |
| 2994 | MGP37 | barley|12v1|BF258535_P1 | 6022 | 262 | 83 | globlastp |
| 2995 | MGP37 | rye|12v1|DRR001012.180497 | 6023 | 262 | 83 | globlastp |
| 2996 | MGP37 | rye|12v1|DRR001012.2023 | 6024 | 262 | 83 | globlastp |
| 2997 | MGP37 | wheat|12v3|BE414391 | 6025 | 262 | 82.1 | globlastp |
| 2998 | MGP37 | oat|14v1|SRR020741X10670D1_P1 | 6026 | 262 | 81.2 | globlastp |
| 2999 | MGP37 | brachypodium|13v2|SRR031797X208674 | 6027 | 262 | 80.7 | globlastp |
| 3000 | MGP37 | lolium|13v1|SRR029311X10533_P1 | 6028 | 262 | 80.7 | globlastp |
| 3001 | MGP37 | fescue|13v1|DT674622_P1 | 6029 | 262 | 80.4 | globlastp |
| 3002 | MGP38 | foxtail_millet|14v1|XM_004951354_P1 | 6030 | 263 | 98.9 | globlastp |
| 3003 | MGP38 | foxtail_millet|13v2|SRR350548X100752 | 6030 | 263 | 98.9 | globlastp |
| 3004 | MGP38 | switchgrass|12v1|FL718210 | 6031 | 263 | 96.8 | globlastp |
| 3005 | MGP38 | switchgrass|12v1|FE629382 | 6032 | 263 | 96.6 | globlastp |
| 3006 | MGP38 | rice|13v2|AU095769 | 6033 | 263 | 94.3 | globlastp |
| 3007 | MGP38 | sugarcane|10v1|CA142156 | 6034 | 263 | 92.24 | glotblastn |
| 3008 | MGP38 | brachypodium|13v2|BRADI3G08430 | 6035 | 263 | 92.2 | globlastp |
| 3009 | MGP38 | brachypodium|14v1|DV480252_P1 | 6035 | 263 | 92.2 | globlastp |
| 3010 | MGP38 | wheat|12v3|BE406523 | 6036 | 263 | 90.8 | globlastp |
| 3011 | MGP38 | maize|13v2|BM079493_P1 | 6037 | 263 | 88.4 | globlastp |
| 3012 | MGP38 | echinochloa|14v1|SRR522894X108924D1_P1 | 6038 | 263 | 86.2 | globlastp |
| 3013 | MGP38 | millet|10v1|EVO454PM105325_P1 | 6039 | 263 | 86.2 | globlastp |
| 3014 | MGP38 | fescue|13v1|DT686771_P1 | 6040 | 263 | 85.9 | globlastp |
| 3015 | MGP38 | foxtail_millet|13v2|SRR350548X122980 | 6041 | 263 | 85.9 | globlastp |
| 3016 | MGP38 | foxtail_millet|14v1|JK577774_P1 | 6041 | 263 | 85.9 | globlastp |
| 3017 | MGP38 | lolium|13v1|ERR246397S52418_P1 | 6042 | 263 | 85.9 | globlastp |
| 3018 | MGP38 | sorghum|13v2|XM_002438539 | 6043 | 263 | 85.6 | globlastp |
| 3019 | MGP38 | pineapple|14v1|DT337600_P1 | 6044 | 263 | 85.3 | globlastp |
| 3020 | MGP38 | brachypodium|13v2|BRADI1G37770 | 6045 | 263 | 85.3 | globlastp |
| 3021 | MGP38 | brachypodium|14v1|GT790814_P1 | 6045 | 263 | 85.3 | globlastp |
| 3022 | MGP38 | rice|13v2|AU056904 | 6046 | 263 | 85.3 | globlastp |
| 3023 | MGP38 | wheat|12v3|CA698690 | 6047 | 263 | 85.3 | globlastp |
| 3024 | MGP38 | switchgrass|12v1|FE641982 | 6048 | 263 | 85.1 | globlastp |
| 3025 | MGP38 | switchgrass|12v1|FL913880 | 6049 | 263 | 84.8 | globlastp |
| 3026 | MGP38 | maize|13v2|DV532943_P1 | 6050 | 263 | 84.6 | globlastp |
| 3027 | MGP38 | barley|12v1|BG299500_P1 | 6051 | 263 | 84.2 | globlastp |
| 3028 | MGP38 | oat|14v1|GR330674_P1 | 6052 | 263 | 83.9 | globlastp |
| 3029 | MGP38 | banana|14v1|MAGEN2012011637_P1 | 6053 | 263 | 82.5 | globlastp |
| 3030 | MGP38 | banana|12v1|MAGEN2012011637 | 6053 | 263 | 82.5 | globlastp |
| 3031 | MGP38 | oil_palm|11v1|SRR190698.232455_P1 | 6054 | 263 | 82.5 | globlastp |
| 3032 | MGP38 | banana|12v1|MAGEN2012005113 | 6055 | 263 | 82.2 | globlastp |
| 3033 | MGP38 | banana|14v1|MAGEN2012005113_P1 | 6056 | 263 | 81.9 | globlastp |
| 3034 | MGP38 | banana|14v1|FF562173_P1 | 6057 | 263 | 81.3 | globlastp |
| 3035 | MGP38 | banana|12v1|FF562173 | 6057 | 263 | 81.3 | globlastp |
| 3036 | MGP38 | rice|13v2|BI806657 | 6058 | 263 | 81.3 | globlastp |
| 3037 | MGP38 | coconut|14v1|COCOS14V1K19C1147353_P1 | 6059 | 263 | 81 | globlastp |
| 3038 | MGP38 | echinochloa|14v1|SRR522894X134931D1_P1 | 6060 | 263 | 81 | globlastp |
| 3039 | MGP38 | foxtail_millet|13v2|SRR350548X110797 | 6061 | 263 | 81 | globlastp |
| 3040 | MGP38 | foxtail_millet|14v1|JK554067_P1 | 6061 | 263 | 81 | globlastp |
| 3041 | MGP38 | brachypodium|14v1|GT760889_P1 | 6062 | 263 | 80.7 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3042 | MGP38 | coconut\|14v1\|COCOS14V1K19C1462611_P1 | 6063 | 263 | 80.7 | globlastp |
| 3043 | MGP38 | brachypodium\|13v2\|BRADI2G05770 | 6062 | 263 | 80.7 | globlastp |
| 3044 | MGP38 | fescue\|13v1\|GO838462_P1 | 6064 | 263 | 80.7 | globlastp |
| 3045 | MGP38 | fescue\|13v1\|GO842714_P1 | 6064 | 263 | 80.7 | globlastp |
| 3046 | MGP38 | lolium\|13v1\|LOLR13V11230814_P1 | 6064 | 263 | 80.7 | globlastp |
| 3047 | MGP38 | oil_palm\|11v1\|SRR190698.205819_P1 | 6065 | 263 | 80.7 | globlastp |
| 3048 | MGP38 | switchgrass\|12v1\|FL696442 | 6066 | 263 | 80.7 | globlastp |
| 3049 | MGP38 | maize\|13v2\|BM895989_P1 | 6067 | 263 | 80.5 | globlastp |
| 3050 | MGP38 | millet\|10v1\|EVO454PM002738_P1 | 6068 | 263 | 80.5 | globlastp |
| 3051 | MGP38 | sorghum\|13v2\|AI724338 | 6069 | 263 | 80.5 | globlastp |
| 3052 | MGP38 | banana\|14v1\|MAGEN2012025954_P1 | 6070 | 263 | 80.2 | globlastp |
| 3053 | MGP38 | banana\|12v1\|MAGEN2012025954 | 6070 | 263 | 80.2 | globlastp |
| 3054 | MGP38 | barley\|12v1\|BI954196_P1 | 6071 | 263 | 80.2 | globlastp |
| 3055 | MGP38 | cenchrus\|13v1\|EB654673_P1 | 6072 | 263 | 80.2 | globlastp |
| 3056 | MGP42 | rye\|12v1\|DRR001012.294558 | 6073 | 266 | 99.4 | globlastp |
| 3057 | MGP42 | foxtail_millet\|13v2\|SRR350548X311547 | 6074 | 266 | 89.9 | globlastp |
| 3058 | MGP42 | rice\|13v2\|AU101185 | 6075 | 266 | 89.9 | globlastp |
| 3059 | MGP42 | foxtail_millet\|14v1\|JK570560_P1 | 6076 | 266 | 89.6 | globlastp |
| 3060 | MGP42 | sorghum\|13v2\|XM_002455976 | 6077 | 266 | 88.1 | globlastp |
| 3061 | MGP42 | barley\|12v1\|AK250000_P1 | 6078 | 266 | 86.4 | globlastp |
| 3062 | MGP42 | maize\|13v2\|T23299_P1 | 6079 | 266 | 86.1 | globlastp |
| 3063 | MGP42 | echinochloa\|14v1\|SRR522894X111623D1_P1 | 6080 | 266 | 82.1 | globlastp |
| 3064 | MGP42 | foxtail_millet\|13v2\|GT090964 | 6081 | 266 | 82.1 | globlastp |
| 3065 | MGP42 | foxtail_millet\|14v1\|GT090964_P1 | 6081 | 266 | 82.1 | globlastp |
| 3066 | MGP42 | switchgrass\|12v1\|HO294407 | 6082 | 266 | 82 | globlastp |
| 3067 | MGP42 | rice\|13v2\|U38033 | 6083 | 266 | 81.6 | globlastp |
| 3068 | MGP42 | millet\|10v1\|EVO454PM001113_P1 | 6084 | 266 | 81.3 | globlastp |
| 3069 | MGP42 | sorghum\|13v2\|AW676941 | 6085 | 266 | 81.3 | globlastp |
| 3070 | MGP42 | sugarcane\|10v1\|CA078890 | 6085 | 266 | 81.3 | globlastp |
| 3071 | MGP42 | cenchrus\|13v1\|EB660609_P1 | 6086 | 266 | 81 | globlastp |
| 3072 | MGP42 | maize\|13v2\|T25262_P1 | 6087 | 266 | 81 | globlastp |
| 3073 | MGP42 | rye\|12v1\|DRR001012.118906 | 6088 | 266 | 81 | globlastp |
| 3074 | MGP42 | rye\|12v1\|DRR001012.291333 | 6088 | 266 | 81 | globlastp |
| 3075 | MGP42 | wheat\|12v3\|BE417095 | 6088 | 266 | 81 | globlastp |
| 3076 | MGP42 | wheat\|12v3\|BE585908 | 6088 | 266 | 81 | globlastp |
| 3077 | MGP42 | wheat\|12v3\|BJ288126 | 6088 | 266 | 81 | globlastp |
| 3078 | MGP42 | wheat\|12v3\|SRR043323X76288D1 | 6089 | 266 | 81 | globlastp |
| 3079 | MGP42 | brachypodium\|13v2\|BRADI4G01400 | 6090 | 266 | 80.7 | globlastp |
| 3080 | MGP42 | brachypodium\|14v1\|DV486862_P1 | 6090 | 266 | 80.7 | globlastp |
| 3081 | MGP42 | wheat\|12v3\|BE500570 | 6091 | 266 | 80.7 | globlastp |
| 3082 | MGP42 | wheat\|12v3\|BQ838807 | 6091 | 266 | 80.7 | globlastp |
| 3083 | MGP42 | oat\|14v1\|CN817280_P1 | 6092 | 266 | 80.1 | globlastp |
| 3084 | MGP42 | barley\|12v1\|BQ461673_P1 | 6093 | 266 | 80.1 | globlastp |
| 3085 | MGP42 | oat\|11v1\|CN817280 | 6092 | 266 | 80.1 | globlastp |
| 3086 | RIN44 | cenchrus\|13v1\|EB656437_P1 | 6094 | 269 | 97.2 | globlastp |
| 3087 | RIN44 | foxtail_millet\|13v2\|SRR350548X113582 | 6094 | 269 | 97.2 | globlastp |
| 3088 | RIN44 | foxtail_millet\|14v1\|JK578577_P1 | 6094 | 269 | 97.2 | globlastp |
| 3089 | RIN44 | millet\|10v1\|EVO454PM068145_P1 | 6094 | 269 | 97.2 | globlastp |
| 3090 | RIN44 | sorghum\|13v2\|BG357466 | 6095 | 269 | 96.8 | globlastp |
| 3091 | RIN44 | sugarcane\|10v1\|CA072235 | 6096 | 269 | 96.3 | globlastp |
| 3092 | RIN44 | switchgrass\|12v1\|DN141962 | 6097 | 269 | 96.3 | globlastp |
| 3093 | RIN44 | maize\|13v2\|AI670288_P1 | 6098 | 269 | 95.9 | globlastp |
| 3094 | RIN44 | switchgrass\|12v1\|FE658968 | 6099 | 269 | 95.9 | globlastp |
| 3095 | RIN44 | barley\|12v1\|BG368569_P1 | 6100 | 269 | 93.5 | globlastp |
| 3096 | RIN44 | brachypodium\|13v2\|BRADI2G16480 | 6101 | 269 | 93.5 | globlastp |
| 3097 | RIN44 | brachypodium\|14v1\|GT822260_P1 | 6101 | 269 | 93.5 | globlastp |
| 3098 | RIN44 | foxtail_millet\|13v2\|SRR350548X187469 | 6102 | 269 | 93.5 | globlastp |
| 3099 | RIN44 | foxtail_millet\|14v1\|JK599077_P1 | 6102 | 269 | 93.5 | globlastp |
| 3100 | RIN44 | maize\|13v2\|AI737144_P1 | 6103 | 269 | 93.5 | globlastp |
| 3101 | RIN44 | maize\|13v2\|AI947316_P1 | 6102 | 269 | 93.5 | globlastp |
| 3102 | RIN44 | oil_palm\|11v1\|EY408384_P1 | 6104 | 269 | 93.5 | globlastp |
| 3103 | RIN44 | rice\|13v2\|BI811354 | 6102 | 269 | 93.5 | globlastp |
| 3104 | RIN44 | rye\|12v1\|DRR001012.125467 | 6100 | 269 | 93.5 | globlastp |
| 3105 | RIN44 | sorghum\|13v2\|AW565732 | 6102 | 269 | 93.5 | globlastp |
| 3106 | RIN44 | sorghum\|13v2\|JGIV2SB13015821 | 6102 | 269 | 93.5 | globlastp |
| 3107 | RIN44 | switchgrass\|12v1\|FL774425 | 6105 | 269 | 93.5 | globlastp |
| 3108 | RIN44 | wheat\|12v3\|BE403841 | 6106 | 269 | 93.5 | globlastp |
| 3109 | RIN44 | wheat\|12v3\|BF200766 | 6107 | 269 | 93.5 | globlastp |
| 3110 | RIN44 | onion\|14v1\|SRR073446X102340D1_P1 | 6108 | 269 | 93.1 | globlastp |
| 3111 | RIN44 | brachypodium\|13v2\|BRADI4G28130 | 6109 | 269 | 93.1 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3112 | RIN44 | brachypodium|14v1|GT822827_P1 | 6109 | 269 | 93.1 | globlastp |
| 3113 | RIN44 | lolium|13v1|AU251220_P1 | 6110 | 269 | 93.1 | globlastp |
| 3114 | RIN44 | maize|13v2|AW289017_P1 | 6111 | 269 | 93.1 | globlastp |
| 3115 | RIN44 | nuphar|gb166|CD473858_P1 | 6112 | 269 | 93.1 | globlastp |
| 3116 | RIN44 | pineapple|14v1|ACOM14V1K19C1387575_P1 | 6113 | 269 | 92.7 | globlastp |
| 3117 | RIN44 | humulus|11v1|EX521431_P1 | 6114 | 269 | 92.7 | globlastp |
| 3118 | RIN44 | thalictrum|11v1|SRR096787X104994 | 6115 | 269 | 92.7 | globlastp |
| 3119 | RIN44 | onion|14v1|SRR573714X423152D1_P1 | 6116 | 269 | 92.6 | globlastp |
| 3120 | RIN44 | aristolochia|10v1|SRR039082S0017353_P1 | 6117 | 269 | 92.6 | globlastp |
| 3121 | RIN44 | eschscholzia|11v1|CD477198XX1_P1 | 6118 | 269 | 92.6 | globlastp |
| 3122 | RIN44 | coconut|14v1|COCOS14V1K19C1228952_P1 | 6119 | 269 | 92.2 | globlastp |
| 3123 | RIN44 | grape|13v1|GSVIVT01021143001_P1 | 6120 | 269 | 92.2 | globlastp |
| 3124 | RIN44 | aquilegia|10v2|DR918986_P1 | 6121 | 269 | 92.2 | globlastp |
| 3125 | RIN44 | centaurea|11v1|EH736291_P1 | 6122 | 269 | 92.2 | globlastp |
| 3126 | RIN44 | chelidonium|11v1|SRR084752X101292_P1 | 6123 | 269 | 92.2 | globlastp |
| 3127 | RIN44 | oat|11v1|GO591531 | 6124 | 269 | 92.2 | globlastp |
| 3128 | RIN44 | poppy|11v1|SRR030262.76307_P1 | 6125 | 269 | 92.2 | globlastp |
| 3129 | RIN44 | prunus|10v1|BU047796 | 6126 | 269 | 92.2 | globlastp |
| 3130 | RIN44 | tripterygium|11v1|SRR098677X122616 | 6127 | 269 | 92.2 | globlastp |
| 3131 | RIN44 | nasturtium|11v1|SRR032558.127119_T1 | 6128 | 269 | 92.17 | glotblasm |
| 3132 | RIN44 | onion|12v1|SRR073446X102340D1 | 6129 | 269 | 92.17 | glotblastn |
| 3133 | RIN44 | amborella|12v3|FD430880_P1 | 6130 | 269 | 91.8 | globlastp |
| 3134 | RIN44 | catharanthus|11v1|SRR098691X103140_T1 | 6131 | 269 | 91.71 | glotblastn |
| 3135 | RIN44 | cirsium|11v1|SRR346952.1005447_T1 | 6132 | 269 | 91.71 | glotblastn |
| 3136 | RIN44 | brachypodium|14v1|XM_003574385_P1 | 6133 | 269 | 91.7 | globlastp |
| 3137 | RIN44 | carrot|14v1|BSS10K19C24581_P1 | 6134 | 269 | 91.7 | globlastp |
| 3138 | RIN44 | carrot|14v1|BSS10K19C25795_P1 | 6134 | 269 | 91.7 | globlastp |
| 3139 | RIN44 | carrot|14v1|JG758285_P1 | 6134 | 269 | 91.7 | globlastp |
| 3140 | RIN44 | coconut|14v1|COCOS14V1K19C1067072_P1 | 6135 | 269 | 91.7 | globlastp |
| 3141 | RIN44 | coconut|14v1|COCOS14V1K19C1427740_P1 | 6136 | 269 | 91.7 | globlastp |
| 3142 | RIN44 | brachypodium|13v2|BRADI3G35100 | 6133 | 269 | 91.7 | globlastp |
| 3143 | RIN44 | cacao|13v1|CU494180_P1 | 6137 | 269 | 91.7 | globlastp |
| 3144 | RIN44 | cassava|09v1|DV448648_P1 | 6138 | 269 | 91.7 | globlastp |
| 3145 | RIN44 | euonymus|11v1|SRR070038X170388_P1 | 6139 | 269 | 91.7 | globlastp |
| 3146 | RIN44 | poppy|11v1|FG610924_P1 | 6140 | 269 | 91.7 | globlastp |
| 3147 | RIN44 | prunus_mume|13v1|BU047796 | 6141 | 269 | 91.7 | globlastp |
| 3148 | RIN44 | prunus_mume|13v1|SRR345674.48377 | 6142 | 269 | 91.7 | globlastp |
| 3149 | RIN44 | prunus|10v1|CN863440 | 6142 | 269 | 91.7 | globlastp |
| 3150 | RIN44 | solanum_phureja|09v1|SPHBG124266 | 6143 | 269 | 91.7 | globlastp |
| 3151 | RIN44 | thalictrum|11v1|SRR096787X100103 | 6144 | 269 | 91.7 | globlastp |
| 3152 | RIN44 | tomato|13v1|BG124266 | 6143 | 269 | 91.7 | globlastp |
| 3153 | RIN44 | tripterygium|11v1|SRR098677X119848 | 6145 | 269 | 91.7 | globlastp |
| 3154 | RIN44 | wheat|12v3|BE402743 | 6146 | 269 | 91.7 | globlastp |
| 3155 | RIN44 | kiwi|gb166|FG396819_P1 | 6147 | 269 | 91.3 | globlastp |
| 3156 | RIN44 | arabidopsis|13v2|AT5G60860_P1 | 6148 | 269 | 91.3 | globlastp |
| 3157 | RIN44 | lupin|13v4|SRR520490.318952_P1 | 6149 | 269 | 91.3 | globlastp |
| 3158 | RIN44 | nasturtium|11v1|GH167405XX2_P1 | 6150 | 269 | 91.3 | globlastp |
| 3159 | RIN44 | soybean|13v2|GLYMA13G24160 | 6151 | 269 | 91.3 | globlastp |
| 3160 | RIN44 | strawberry|11v1|EX662545 | 6152 | 269 | 91.3 | globlastp |
| 3161 | RIN44 | tabernaemontana|11v1|SRR098689X115741 | 6153 | 269 | 91.3 | globlastp |
| 3162 | RIN44 | valeriana|11v1|SRR099039X100764 | 6154 | 269 | 91.3 | globlastp |
| 3163 | RIN44 | euonymus|11v1|SRR070040X105477_T1 | 6155 | 269 | 91.24 | glotblastn |
| 3164 | RIN44 | apple|11v1|CN855415_P1 | 6156 | 269 | 91.2 | globlastp |
| 3165 | RIN44 | potato|10v1|CK266413_P1 | 6157 | 269 | 91.2 | globlastp |
| 3166 | RIN44 | eucalyptus|11v2|CD668274_P1 | 6158 | 269 | 90.9 | globlastp |
| 3167 | RIN44 | cyclamen|14v1|B14ROOTK19C112589_P1 | 6159 | 269 | 90.8 | globlastp |
| 3168 | RIN44 | oat|14v1|GO591531_P1 | 6160 | 269 | 90.8 | globlastp |
| 3169 | RIN44 | pineapple|14v1|ACOM14V1K19C1132001_P1 | 6161 | 269 | 90.8 | globlastp |
| 3170 | RIN44 | castorbean|12v1|GE633876 | 6162 | 269 | 90.8 | globlastp |
| 3171 | RIN44 | castorbean|14v2|GE633876_P1 | 6162 | 269 | 90.8 | globlastp |
| 3172 | RIN44 | coffea|10v1|DV675379_P1 | 6163 | 269 | 90.8 | globlastp |
| 3173 | RIN44 | amsonia|11v1|SRR098688X103911_P1 | 6164 | 269 | 90.8 | globlastp |
| 3174 | RIN44 | apple|11v1|CN897744_P1 | 6165 | 269 | 90.8 | globlastp |
| 3175 | RIN44 | arabidopsis_lyrata|13v1|BT005238_P1 | 6166 | 269 | 90.8 | globlastp |
| 3176 | RIN44 | beech|11v1|SRR006293.1226_P1 | 6167 | 269 | 90.8 | globlastp |
| 3177 | RIN44 | cassava|09v1|JGICASSAVA40676M1_P1 | 6168 | 269 | 90.8 | globlastp |
| 3178 | RIN44 | chickpea|13v2|SRR133517.101669_P1 | 6169 | 269 | 90.8 | globlastp |
| 3179 | RIN44 | cynara|gb167|GE592067_P1 | 6170 | 269 | 90.8 | globlastp |
| 3180 | RIN44 | euonymus|11v1|SRR070038X146214_P1 | 6171 | 269 | 90.8 | globlastp |
| 3181 | RIN44 | euonymus|11v1|SRR070038X217904_P1 | 6172 | 269 | 90.8 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3182 | RIN44 | lupin\|13v4\|SRR520490.116862_P1 | 6173 | 269 | 90.8 | globlastp |
| 3183 | RIN44 | papaya\|gb165\|EX266580_P1 | 6174 | 269 | 90.8 | globlastp |
| 3184 | RIN44 | pigeonpea\|11v1\|SRR054580X113524_P1 | 6175 | 269 | 90.8 | globlastp |
| 3185 | RIN44 | primula\|11v1\|SRR098679X82439_P1 | 6176 | 269 | 90.8 | globlastp |
| 3186 | RIN44 | safflower\|gb162\|EL385522 | 6177 | 269 | 90.8 | globlastp |
| 3187 | RIN44 | strawberry\|11v1\|CO380410 | 6178 | 269 | 90.8 | globlastp |
| 3188 | RIN44 | tripterygium\|11v1\|SRR098677X126146 | 6179 | 269 | 90.8 | globlastp |
| 3189 | RIN44 | vinca\|11v1\|SRR098690X12359 | 6180 | 269 | 90.8 | globlastp |
| 3190 | RIN44 | euonymus\|11v1\|SRR070038X402520_T1 | 6181 | 269 | 90.78 | glotblastn |
| 3191 | RIN44 | chestnut\|14v1\|SRR006295X109531D1_P1 | 6182 | 269 | 90.4 | globlastp |
| 3192 | RIN44 | blueberry\|12v1\|SRR353282X53440D1_P1 | 6183 | 269 | 90.4 | globlastp |
| 3193 | RIN44 | clementine\|11v1\|CX638873_P1 | 6184 | 269 | 90.4 | globlastp |
| 3194 | RIN44 | euphorbia\|11v1\|DV123215_P1 | 6185 | 269 | 90.4 | globlastp |
| 3195 | RIN44 | ginseng\|13v1\|JK987379_P1 | 6186 | 269 | 90.4 | globlastp |
| 3196 | RIN44 | grape\|13v1\|GSVIVT01014250001_P1 | 6187 | 269 | 90.4 | globlastp |
| 3197 | RIN44 | humulus\|11v1\|EX517008_P1 | 6188 | 269 | 90.4 | globlastp |
| 3198 | RIN44 | lotus\|09v1\|LLZ73956_P1 | 6189 | 269 | 90.4 | globlastp |
| 3199 | RIN44 | nicotiana_benthamiana\|12v1\|BP748717_P1 | 6190 | 269 | 90.4 | globlastp |
| 3200 | RIN44 | oak\|10v1\|CU657667_P1 | 6191 | 269 | 90.4 | globlastp |
| 3201 | RIN44 | oak\|10v1\|SRR006307S0042660_P1 | 6192 | 269 | 90.4 | globlastp |
| 3202 | RIN44 | orange\|11v1\|CX638873_P1 | 6184 | 269 | 90.4 | globlastp |
| 3203 | RIN44 | pepper\|12v1\|GD054316 | 6193 | 269 | 90.4 | globlastp |
| 3204 | RIN44 | watermelon\|11v1\|AM724068 | 6194 | 269 | 90.4 | globlastp |
| 3205 | RIN44 | oil_palm\|11v1\|SRR190698.262085_P1 | 6195 | 269 | 90.3 | globlastp |
| 3206 | RIN44 | eucalyptus\|11v2\|CD668564_P1 | 6196 | 269 | 90 | globlastp |
| 3207 | RIN44 | castorbean\|14v2\|XM_002522466_P1 | 6197 | 269 | 89.9 | globlastp |
| 3208 | RIN44 | clover\|14v1\|BB907424_P1 | 6198 | 269 | 89.9 | globlastp |
| 3209 | RIN44 | soybean\|13v2\|GLYMA12G14070 | 6199 | 269 | 89.9 | globlastp |
| 3210 | RIN44 | apple\|11v1\|CN909644_P1 | 6200 | 269 | 89.9 | globlastp |
| 3211 | RIN44 | bean\|13v1\|CA907878_P1 | 6201 | 269 | 89.9 | globlastp |
| 3212 | RIN44 | beet\|12v1\|BQ590967_P1 | 6202 | 269 | 89.9 | globlastp |
| 3213 | RIN44 | cacao\|13v1\|CU474236_P1 | 6203 | 269 | 89.9 | globlastp |
| 3214 | RIN44 | castorbean\|12v1\|XM_002522466 | 6197 | 269 | 89.9 | globlastp |
| 3215 | RIN44 | clementine\|11v1\|CB290326_P1 | 6204 | 269 | 89.9 | globlastp |
| 3216 | RIN44 | clementine\|11v1\|CK933331_P1 | 6205 | 269 | 89.9 | globlastp |
| 3217 | RIN44 | fagopyrum\|11v1\|SRR063689X101832_P1 | 6206 | 269 | 89.9 | globlastp |
| 3218 | RIN44 | ginseng\|13v1\|JK988803_P1 | 6207 | 269 | 89.9 | globlastp |
| 3219 | RIN44 | ginseng\|13v1\|SRR547977.221819_P1 | 6207 | 269 | 89.9 | globlastp |
| 3220 | RIN44 | hornbeam\|12v1\|SRR364455.108711_P1 | 6208 | 269 | 89.9 | globlastp |
| 3221 | RIN44 | lotus\|09v1\|LLAV419906_P1 | 6209 | 269 | 89.9 | globlastp |
| 3222 | RIN44 | medicago\|13v1\|AL369389_P1 | 6210 | 269 | 89.9 | globlastp |
| 3223 | RIN44 | nicotiana_benthamiana\|12v1\|BP748550_P1 | 6211 | 269 | 89.9 | globlastp |
| 3224 | RIN44 | nicotiana_benthamiana\|12v1\|CN747661_P1 | 6212 | 269 | 89.9 | globlastp |
| 3225 | RIN44 | pigeonpea\|11v1\|SRR054580X128996_P1 | 6213 | 269 | 89.9 | globlastp |
| 3226 | RIN44 | plantago\|11v2\|SRR066373X111949_P1 | 6214 | 269 | 89.9 | globlastp |
| 3227 | RIN44 | poplar\|13v1\|BI130112_P1 | 6215 | 269 | 89.9 | globlastp |
| 3228 | RIN44 | soybean\|13v2\|GLYMA07G32420 | 6216 | 269 | 89.9 | globlastp |
| 3229 | RIN44 | tobacco\|gb162\|EB425325 | 6217 | 269 | 89.9 | globlastp |
| 3230 | RIN44 | zostera\|12v1\|SRR057351X116426D1 | 6218 | 269 | 89.9 | globlastp |
| 3231 | RIN44 | olea\|13v1\|SRR014463X50337D1_P1 | 6219 | 269 | 89.5 | globlastp |
| 3232 | RIN44 | tabernaemontana\|11v1\|SRR098689X102629 | 6220 | 269 | 89.5 | globlastp |
| 3233 | RIN44 | pigeonpea\|11v1\|SRR054580X172487_T1 | — | 269 | 89.5 | glotblastn |
| 3234 | RIN44 | clover\|14v1\|ERR351507S19XK19C682970_P1 | 6221 | 269 | 89.4 | globlastp |
| 3235 | RIN44 | onion\|14v1\|SRR073446X116375D1_P1 | 6222 | 269 | 89.4 | globlaslp |
| 3236 | RIN44 | parsley\|14v1\|BSS12K19C1042116_P1 | 6223 | 269 | 89.4 | globlastp |
| 3237 | RIN44 | soybean\|13v2\|GLYMA06G43830 | 6224 | 269 | 89.4 | globlastp |
| 3238 | RIN44 | cassava\|09v1\|BI325245_P1 | 6225 | 269 | 89.4 | globlastp |
| 3239 | RIN44 | cassava\|09v1\|DV448254_P1 | 6226 | 269 | 89.4 | globlastp |
| 3240 | RIN44 | castorbean\|12v1\|EE256492 | 6227 | 269 | 89.4 | globlastp |
| 3241 | RIN44 | cucumber\|09v1\|ES882990_P1 | 6228 | 269 | 89.4 | globlastp |
| 3242 | RIN44 | fagopyrum\|11v1\|SRR063703X101421_P1 | 6229 | 269 | 89.4 | globlastp |
| 3243 | RIN44 | ginseng\|13v1\|SRR547984.518463_T1 | 6230 | 269 | 89.4 | glotblastn |
| 3244 | RIN44 | gossypium_raimondii\|13v1\|BG441743_P1 | 6231 | 269 | 89.4 | globlastp |
| 3245 | RIN44 | melon\|10v1\|AM724068_P1 | 6228 | 269 | 89.4 | globlastp |
| 3246 | RIN44 | olea\|13v1\|SRR014464X11215D1_P1 | 6232 | 269 | 89.4 | globlastp |
| 3247 | RIN44 | orange\|11v1\|CK933331_P1 | 6233 | 269 | 89.4 | globlastp |
| 3248 | RIN44 | peanut\|13v1\|SRR042413X11685_P1 | 6234 | 269 | 89.4 | globlastp |
| 3249 | RIN44 | phyla\|11v2\|SRR099035X125740_P1 | 6235 | 269 | 89.4 | globlastp |
| 3250 | RIN44 | poplar\|13v1\|BU889283_P1 | 6236 | 269 | 89.4 | globlastp |
| 3251 | RIN44 | silene\|11v1\|SRR096785X106982 | 6237 | 269 | 89.4 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3252 | RIN44 | triphysaria\|13v1\|DR174373 | 6238 | 269 | 89.4 | globlastp |
| 3253 | RIN44 | tripterygium\|11v1\|SRR098677X119451 | 6239 | 269 | 89.4 | globlastp |
| 3254 | RIN44 | chestnut\|gb170\|SRR006295S0049857 | 6240 | 269 | 89.1 | globlastp |
| 3255 | RIN44 | clover\|14v1\|BB929132_P1 | 6241 | 269 | 89 | globlastp |
| 3256 | RIN44 | clover\|14v1\|ERR351507S19XK19C251077_P1 | 6242 | 269 | 89 | globlastp |
| 3257 | RIN44 | clover\|14v1\|FY467422_P1 | 6241 | 269 | 89 | globlastp |
| 3258 | RIN44 | vicia\|14v1\|HX905865_P1 | 6243 | 269 | 89 | globlastp |
| 3259 | RIN44 | potato\|10v1\|BQ11861_P1 | 6244 | 269 | 89 | globlastp |
| 3260 | RIN44 | ambrosia\|11v1\|SRR346935.136483_P1 | 6245 | 269 | 89 | globlastp |
| 3261 | RIN44 | antirrhinum\|gb166\|AJ558853_P1 | 6246 | 269 | 89 | globlastp |
| 3262 | RIN44 | chickpea\|13v2\|SRR133518.35867_P1 | 6247 | 269 | 89 | globlastp |
| 3263 | RIN44 | cotton\|11v1\|BG441743_P1 | 6248 | 269 | 89 | globlastp |
| 3264 | RIN44 | ginseng\|13v1\|SRR547977.273217_P1 | 6249 | 269 | 89 | globlastp |
| 3265 | RIN44 | ginseng\|13v1\|SRR547984.155139_P1 | 6250 | 269 | 89 | globlastp |
| 3266 | RIN44 | medicago\|13v1\|AW686800_P1 | 6251 | 269 | 89 | globlastp |
| 3267 | RIN44 | medicago\|13v1\|CO516239_P1 | 6252 | 269 | 89 | globlastp |
| 3268 | RIN44 | oak\|10v1\|DB999247_P1 | 6253 | 269 | 89 | globlastp |
| 3269 | RIN44 | olea\|13v1\|SRR014463X31537D1_P1 | 6254 | 269 | 89 | globlastp |
| 3270 | RIN44 | onion\|12v1\|SRR073446X157918D1 | 6255 | 269 | 89 | globlastp |
| 3271 | RIN44 | pigeonpea\|11v1\|SRR054580X118768_P1 | 6256 | 269 | 89 | globlastp |
| 3272 | RIN44 | poplar\|13v1\|AI165923_P1 | 6257 | 269 | 89 | globlastp |
| 3273 | RIN44 | solanum_phureja\|09v1\|SPHBG130400 | 6244 | 269 | 89 | globlastp |
| 3274 | RIN44 | sunflower\|12v1\|DY916712 | 6258 | 269 | 89 | globlastp |
| 3275 | RIN44 | cynodon\|10v1\|ES295359_T1 | 6259 | 269 | 88.94 | glotblastn |
| 3276 | RIN44 | tea\|10v1\|GE652683 | 6260 | 269 | 88.94 | glotblastn |
| 3277 | RIN44 | ginseng\|13v1\|SRR547977.244630_P1 | 6261 | 269 | 88.9 | globlastp |
| 3278 | RIN44 | quinoa\|13v2\|SRR315568X173708 | 6262 | 269 | 88.9 | globlastp |
| 3279 | RIN44 | triphysaria\|13v1\|EY010106 | 6263 | 269 | 88.6 | globlastp |
| 3280 | RIN44 | vinca\|11v1\|SRR098690X123646 | 6264 | 269 | 88.6 | globlastp |
| 3281 | RIN44 | vinca\|11v1\|SRR098690X12837 | 6265 | 269 | 88.6 | globlastp |
| 3282 | RIN44 | amaranthus\|13v1\|SRR172675X355070D1_P1 | 6266 | 269 | 88.5 | globlastp |
| 3283 | RIN44 | banana\|14v1\|DN238925_P1 | 6267 | 269 | 88.5 | globlastp |
| 3284 | RIN44 | cichorium\|14v1\|CII14V1K19C484338_P1 | 6268 | 269 | 88.5 | globlastp |
| 3285 | RIN44 | clover\|14v1\|ERR351507S19XK19C141028_P1 | 6269 | 269 | 88.5 | globlastp |
| 3286 | RIN44 | clover\|14v1\|ERR351507S29XK29C449701_P1 | 6270 | 269 | 88.5 | globlastp |
| 3287 | RIN44 | parsley\|14v1\|BSS12K19C1071320_P1 | 6271 | 269 | 88.5 | globlastp |
| 3288 | RIN44 | poplar\|13v1\|CV227529_P1 | 6272 | 269 | 88.5 | globlastp |
| 3289 | RIN44 | abies\|11v2\|SRR098676X128016_P1 | 6273 | 269 | 88.5 | globlastp |
| 3290 | RIN44 | arabidopsis_lyrata\|13v1\|Z26553_P1 | 6274 | 269 | 88.5 | globlastp |
| 3291 | RIN44 | artemisia\|10v1\|EY056271_P1 | 6275 | 269 | 88.5 | globlastp |
| 3292 | RIN44 | bean\|13v1\|SRR001334X207446_P1 | 6276 | 269 | 88.5 | globlastp |
| 3293 | RIN44 | cotton\|11v1\|AI726612_P1 | 6277 | 269 | 88.5 | globlastp |
| 3294 | RIN44 | cotton\|11v1\|CO097896_P1 | 6278 | 269 | 88.5 | globlastp |
| 3295 | RIN44 | cotton\|11v1\|CO493373XX1_P1 | 6279 | 269 | 88.5 | globlastp |
| 3296 | RIN44 | euonymus\|11v1\|SRR070038X249351_P1 | 6280 | 269 | 88.5 | globlastp |
| 3297 | RIN44 | ginseng\|13v1\|JK984149_P1 | 6281 | 269 | 88.5 | globlastp |
| 3298 | RIN44 | ginseng\|13v1\|JK989019_P1 | 6282 | 269 | 88.5 | globlastp |
| 3299 | RIN44 | ginseng\|13v1\|SRR547977.160198_P1 | 6281 | 269 | 88.5 | globlastp |
| 3300 | RIN44 | ginseng\|13v1\|SRR547984.237965_P1 | 6283 | 269 | 88.5 | globlastp |
| 3301 | RIN44 | gossypium_raimondii\|13v1\|AI726612_P1 | 6279 | 269 | 88.5 | globlastp |
| 3302 | RIN44 | nasturtium\|11v1\|SRR032558.144749_P1 | 6284 | 269 | 88.5 | globlastp |
| 3303 | RIN44 | olea\|13v1\|SRR014464X48168D1_P1 | 6285 | 269 | 88.5 | globlastp |
| 3304 | RIN44 | peanut\|13v1\|SRR042413X12435_P1 | 6286 | 269 | 88.5 | globlastp |
| 3305 | RIN44 | pea\|11v1\|PEAGTPBP05_P1 | 6287 | 269 | 88.5 | globlastp |
| 3306 | RIN44 | poplar\|13v1\|BU875572_P1 | 6272 | 269 | 88.5 | globlastp |
| 3307 | RIN44 | soybean\|13v2\|GLYMA13G21850 | 6288 | 269 | 88.5 | globlastp |
| 3308 | RIN44 | tomato\|13v1\|BG130400 | 6289 | 269 | 88.5 | globlastp |
| 3309 | RIN44 | triphysaria\|13v1\|EY007784 | 6290 | 269 | 88.5 | globlastp |
| 3310 | RIN44 | eschscholzia\|11v1\|SRR014116.8789_P1 | 6291 | 269 | 88.4 | globlastp |
| 3311 | RIN44 | ipomoea_nil\|10v1\|BJ554870_P1 | 6292 | 269 | 88.2 | globlastp |
| 3312 | RIN44 | pigeonpea\|11v1\|SRR054580X151815_T1 | 6293 | 269 | 88.13 | glotblastn |
| 3313 | RIN44 | chrysanthemum\|14v1\|DK942011_P1 | 6294 | 269 | 88.1 | globlastp |
| 3314 | RIN44 | cichorium\|14v1\|CII14V1K19S008828_P1 | 6295 | 269 | 88.1 | globlastp |
| 3315 | RIN44 | cichorium\|14v1\|EH688741_P1 | 6295 | 269 | 88.1 | globlastp |
| 3316 | RIN44 | cichorium\|14v1\|EH690674_P1 | 6295 | 269 | 88.1 | globlastp |
| 3317 | RIN44 | cichorium\|14v1\|EH694727_P1 | 6296 | 269 | 88.1 | globlastp |
| 3318 | RIN44 | chickpea\|13v2\|SRR133517.276056_P1 | 6297 | 269 | 88.1 | globlastp |
| 3319 | RIN44 | cichorium\|gb171\|EH688741 | 6295 | 269 | 88.1 | globlastp |
| 3320 | RIN44 | cichorium\|gb171\|EH694727 | 6296 | 269 | 88.1 | globlastp |
| 3321 | RIN44 | cowpea\|12v1\|FG874691_P1 | 6298 | 269 | 88.1 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3322 | RIN44 | euonymus\|11v1\|SRR070038X422494_P1 | 6299 | 269 | 88.1 | globlastp |
| 3323 | RIN44 | lettuce\|12v1\|DW094381_P1 | 6300 | 269 | 88.1 | globlastp |
| 3324 | RIN44 | lupin\|13v4\|V1NGGBUXD8B02FWGHY_P1 | 6301 | 269 | 88.1 | globlastp |
| 3325 | RIN44 | maritime_pine\|10v1\|BX254888_P1 | 6302 | 269 | 88.1 | globlastp |
| 3326 | RIN44 | olea\|13v1\|SRR014463X14267D1_P1 | 6303 | 269 | 88.1 | globlastp |
| 3327 | RIN44 | pine\|10v2\|AW290599_P1 | 6302 | 269 | 88.1 | globlastp |
| 3328 | RIN44 | spruce\|11v1\|ES663470 | 6304 | 269 | 88.1 | globlastp |
| 3329 | RIN44 | thellungiella_parvulum\|13v1\|BQ079319 | 6305 | 269 | 88.1 | globlastp |
| 3330 | RIN44 | trigonella\|11v1\|SRR066194X115522 | 6306 | 269 | 88.1 | globlastp |
| 3331 | RIN44 | triphysaria\|13v1\|EY137777 | 6307 | 269 | 88.1 | globlastp |
| 3332 | RIN44 | cucurbita\|11v1\|SRR091276X191554_T1 | 6308 | 269 | 88.02 | glotblastn |
| 3333 | RIN44 | banana\|12v1\|DN238925 | 6309 | 269 | 88 | globlastp |
| 3334 | RIN44 | phyla\|11v2\|SRR099037X140826_P1 | 6310 | 269 | 87.7 | globlastp |
| 3335 | RIN44 | chrysanthemum\|14v1\|SRR290491X107452D1_P1 | 6311 | 269 | 87.6 | globlastp |
| 3336 | RIN44 | pineapple\|14v1\|ACOM14V1K19C1934134_P1 | 6312 | 269 | 87.6 | globlastp |
| 3337 | RIN44 | amorphophallus\|11v2\|SRR089351X127074XX1_P1 | 6313 | 269 | 87.6 | globlastp |
| 3338 | RIN44 | arabidopsis\|13v2\|AT3G15060_P1 | 6314 | 269 | 87.6 | globlastp |
| 3339 | RIN44 | cirsium\|11v1\|SRR346952.122840_P1 | 6315 | 269 | 87.6 | globlastp |
| 3340 | RIN44 | cleome_spinosa\|10v1\|GR934031_P1 | 6316 | 269 | 87.6 | globlastp |
| 3341 | RIN44 | cotton\|11v1\|BQ404237_P1 | 6317 | 269 | 87.6 | globlastp |
| 3342 | RIN44 | cryptomeria\|gb166\|BP175412_P1 | 6318 | 269 | 87.6 | globlastp |
| 3343 | RIN44 | dandelion\|10v1\|DY826050_P1 | 6319 | 269 | 87.6 | globlastp |
| 3344 | RIN44 | distylium\|11v1\|SRR065077X180981_P1 | 6320 | 269 | 87.6 | globlastp |
| 3345 | RIN44 | flaveria\|11v1\|SRR149229.166836_P1 | 6321 | 269 | 87.6 | globlastp |
| 3346 | RIN44 | flaveria\|11v1\|SRR149232.127553_P1 | 6321 | 269 | 87.6 | globlastp |
| 3347 | RIN44 | gossypium_raimondii\|13v1\|BQ404237_P1 | 6317 | 269 | 87.6 | globlastp |
| 3348 | RIN44 | gossypium_raimondii\|13v1\|SRR278711.420563_P1 | 6322 | 269 | 87.6 | globlastp |
| 3349 | RIN44 | lupin\|13v4\|SRR520491.1111857_P1 | 6323 | 269 | 87.6 | globlastp |
| 3350 | RIN44 | phalaenopsis\|11v1\|CK856700_P1 | 6324 | 269 | 87.6 | globlastp |
| 3351 | RIN44 | pseudotsuga\|10v1\|SRR065119S0002306 | 6325 | 269 | 87.6 | globlastp |
| 3352 | RIN44 | sequoia\|10v1\|SRR065044S0059550 | 6326 | 269 | 87.6 | globlastp |
| 3353 | RIN44 | silene\|11v1\|GH293699 | 6327 | 269 | 87.6 | globlastp |
| 3354 | RIN44 | utricularia\|11v1\|SRR094438.113223 | 6328 | 269 | 87.6 | globlastp |
| 3355 | RIN44 | oat\|14v1\|SRR020741X282931D1_T1 | 6329 | 269 | 87.56 | glotblastn |
| 3356 | RIN44 | ginseng\|13v1\|SRR547986.103026_T1 | 6330 | 269 | 87.56 | glotblastn |
| 3357 | RIN44 | onion\|12v1\|SRR073446X116375D1 | 6331 | 269 | 87.56 | glotblastn |
| 3358 | RIN44 | sarracenia\|11v1\|SRR192669.137369 | 6332 | 269 | 87.56 | glotblastn |
| 3359 | RIN44 | taxus\|10v1\|SRR032523S0003180 | 6333 | 269 | 87.39 | glotblastn |
| 3360 | RIN44 | parsley\|14v1\|BSS12K19C676527_P1 | 6334 | 269 | 87.2 | globlastp |
| 3361 | RIN44 | cephalotaxus\|11v1\|SRR064395X129589_P1 | 6335 | 269 | 87.2 | globlastp |
| 3362 | RIN44 | cirsium\|11v1\|SRR346952.124898_P1 | 6336 | 269 | 87.2 | globlastp |
| 3363 | RIN44 | conyza\|10v1\|SRR035294S0009339_P1 | 6337 | 269 | 87.2 | globlastp |
| 3364 | RIN44 | cotton\|11v1\|CO085845_P1 | 6338 | 269 | 87.2 | globlastp |
| 3365 | RIN44 | flaveria\|11v1\|SRR149232.25218_P1 | 6339 | 269 | 87.2 | globlastp |
| 3366 | RIN44 | monkeyflower\|12v1\|DV208485_P1 | 6340 | 269 | 87.2 | globlastp |
| 3367 | RIN44 | monkeyflower\|12v1\|SRR037228.172037_P1 | 6341 | 269 | 87.2 | globlastp |
| 3368 | RIN44 | nicotiana_benthamiana\|12v1\|TOBNTRAB_P1 | 6342 | 269 | 87.2 | globlastp |
| 3369 | RIN44 | olea\|13v1\|SRR014465X17726D1_P1 | 6343 | 269 | 87.2 | globlastp |
| 3370 | RIN44 | sciadopitys\|10v1\|SRR065035S0025411 | 6344 | 269 | 87.2 | globlastp |
| 3371 | RIN44 | soybean\|13v2\|GLYMA10G08020 | 6345 | 269 | 87.2 | globlastp |
| 3372 | RIN44 | thellungiella_halophilum\|13v1\|BQ079319 | 6346 | 269 | 87.2 | globlastp |
| 3373 | RIN44 | tobacco\|gb162\|EB424864 | 6342 | 269 | 87.2 | globlastp |
| 3374 | RIN44 | tobacco\|gb162\|TOBNTRAB | 6342 | 269 | 87.2 | globlastp |
| 3375 | RIN44 | banana\|14v1\|FF561534_P1 | 6347 | 269 | 87.1 | globlastp |
| 3376 | RIN44 | chrysanthemum\|14v1\|SRR290491X1574D1_P1 | 6348 | 269 | 87.1 | globlastp |
| 3377 | RIN44 | chrysanthemum\|14v1\|SRR290491X323279D1_P1 | 6349 | 269 | 87.1 | globlastp |
| 3378 | RIN44 | fagopyrum\|11v1\|SRR063689X155852_T1 | 6350 | 269 | 87.1 | glotblastn |
| 3379 | RIN44 | nasturtium\|11v1\|SRR032558.170381_T1 | 6351 | 269 | 87.1 | glotblastn |
| 3380 | RIN44 | amsonia\|11v1\|SRR098688X138096_P1 | 6352 | 269 | 86.8 | globlastp |
| 3381 | RIN44 | catharanthus\|11v1\|EG558757_P1 | 6353 | 269 | 86.8 | globlastp |
| 3382 | RIN44 | nicotiana_benthamiana\|12v1\|EB424864_P1 | 6354 | 269 | 86.8 | globlastp |
| 3383 | RIN44 | centaurea\|11v1\|EH748535_P1 | 6355 | 269 | 86.7 | globlastp |
| 3384 | RIN44 | centaurea\|11v1\|SRR346938.108282_P1 | 6355 | 269 | 86.7 | globlastp |
| 3385 | RIN44 | centaurea\|11v1\|SRR346940.101987_P1 | 6355 | 269 | 86.7 | globlastp |
| 3386 | RIN44 | cirsium\|11v1\|SRR346952.1000433_P1 | 6355 | 269 | 86.7 | globlastp |
| 3387 | RIN44 | podocarpus\|10v1\|SRR065014S0008395_P1 | 6356 | 269 | 86.7 | globlastp |
| 3388 | RIN44 | beech\|11v1\|SRR006293.27171_T1 | 6357 | 269 | 86.64 | glotblastn |
| 3389 | RIN44 | artemisia\|10v1\|EY079320_P1 | 6358 | 269 | 86.6 | globlastp |
| 3390 | RIN44 | gnetum\|10v1\|SRR064399S0012938_P1 | 6359 | 269 | 86.3 | globlastp |
| 3391 | RIN44 | orobanche\|10v1\|SRR023189S0008569_P1 | 6360 | 269 | 86.3 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3392 | RIN44 | potato|10v1|BF153993_P1 | 6361 | 269 | 86.3 | globlastp |
| 3393 | RIN44 | tomato|13v1|BG131899 | 6361 | 269 | 86.3 | globlastp |
| 3394 | RIN44 | carrot|14v1|BSS11K19C172899_P1 | 6362 | 269 | 86.2 | globlastp |
| 3395 | RIN44 | cichorium|14v1|EH673219_P1 | 6363 | 269 | 86.2 | globlastp |
| 3396 | RIN44 | parsley|14v1|BSS12K19C442218_P1 | 6364 | 269 | 86.2 | globlastp |
| 3397 | RIN44 | vicia|14v1|Z29591_P1 | 6365 | 269 | 86.2 | globlastp |
| 3398 | RIN44 | banana|12v1|FF561534 | 6366 | 269 | 86.2 | globlastp |
| 3399 | RIN44 | cichorium|gb171|EH693037 | 6363 | 269 | 86.2 | globlastp |
| 3400 | RIN44 | cucumber|09v1|BGI454H0179518_P1 | 6367 | 269 | 86.2 | globlastp |
| 3401 | RIN44 | eucalyptus|11v2|JGIEG031078_P1 | 6368 | 269 | 86.2 | globlastp |
| 3402 | RIN44 | flaveria|11v1|SRR149229.81238_P1 | 6369 | 269 | 86.2 | globlastp |
| 3403 | RIN44 | monkeyflower|12v1|GO978979_P1 | 6370 | 269 | 86.2 | globlastp |
| 3404 | RIN44 | sunflower|12v1|CX947515 | 6371 | 269 | 86.2 | globlastp |
| 3405 | RIN44 | watermelon|11v1|SRR057380.179518 | 6372 | 269 | 86.2 | globlastp |
| 3406 | RIN44 | zostera|12v1|AM766720 | 6373 | 269 | 86.2 | globlastp |
| 3407 | RIN44 | dandelion|10v1|DR401467_T1 | 6374 | 269 | 86.18 | glotblastn |
| 3408 | RIN44 | flaveria|11v1|SRR149232.78800_T1 | 6375 | 269 | 86.18 | glotblastn |
| 3409 | RIN44 | carrot|14v1|JG765323_P1 | 6376 | 269 | 85.8 | globlastp |
| 3410 | RIN44 | ambrosia|11v1|SRR346935.376902_P1 | 6377 | 269 | 85.8 | globlastp |
| 3411 | RIN44 | b_rapa|11v1|H07383_P1 | 6378 | 269 | 85.8 | globlastp |
| 3412 | RIN44 | banana|12v1|MAGEN2012003585 | 6379 | 269 | 85.8 | globlastp |
| 3413 | RIN44 | eggplant|10v1|FS049994_P1 | 6380 | 269 | 85.8 | globlastp |
| 3414 | RIN44 | eucalyptus|11v2|JGIEG030153_P1 | 6381 | 269 | 85.8 | globlastp |
| 3415 | RIN44 | solanum_phureja|09v1|SPHBG131899 | 6382 | 269 | 85.8 | globlastp |
| 3416 | RIN44 | b_oleracea|14v1|EV194378_T1 | 6383 | 269 | 85.78 | glotblastn |
| 3417 | RIN44 | ambrosia|11v1|SRR346946.127470_T1 | 6384 | 269 | 85.71 | glotblastn |
| 3418 | RIN44 | flaveria|11v1|SRR149229.295375_T1 | 6385 | 269 | 85.71 | glotblastn |
| 3419 | RIN44 | banana|14v1|ES432735_P1 | 6386 | 269 | 85.7 | globlastp |
| 3420 | RIN44 | banana|14v1|MAGEN2012026350_P1 | 6387 | 269 | 85.7 | globlastp |
| 3421 | RIN44 | carrot|14v1|BSS8K19C102243_P1 | 6388 | 269 | 85.7 | globlastp |
| 3422 | RIN44 | phalaenopsis|11v1|SRR125771.14025640_P1 | 6389 | 269 | 85.7 | globlastp |
| 3423 | RIN44 | silene|11v1|SRR096785X10278 | 6390 | 269 | 85.7 | globlastp |
| 3424 | RIN44 | b_oleracea|14v1|EVG19430_P1 | 6391 | 269 | 85.4 | globlastp |
| 3425 | RIN44 | b_rapa|11v1|ES981511_P1 | 6392 | 269 | 85.4 | globlastp |
| 3426 | RIN44 | canola|11v1|EV019430_P1 | 6391 | 269 | 85.4 | globlastp |
| 3427 | RIN44 | banana|14v1|MAGEN2012003585_P1 | 6393 | 269 | 85.3 | globlastp |
| 3428 | RIN44 | carrot|14v1|BSS11K19C104965_P1 | 6394 | 269 | 85.3 | globlastp |
| 3429 | RIN44 | ambrosia|11v1|SRR346943.100711_P1 | 6395 | 269 | 85.3 | globlastp |
| 3430 | RIN44 | artemisia|10v1|EY110208_P1 | 6396 | 269 | 85.3 | globlastp |
| 3431 | RIN44 | artemisia|10v1|SRR019254S0247451_P1 | 6397 | 269 | 85.3 | globlastp |
| 3432 | RIN44 | banana|12v1|ES432735 | 6398 | 269 | 85.3 | globlastp |
| 3433 | RIN44 | bean|13v1|EX305072_P1 | 6399 | 269 | 85.3 | globlastp |
| 3434 | RIN44 | grape|13v1|GSVIVT01020651001_P1 | 6400 | 269 | 85.3 | globlastp |
| 3435 | RIN44 | silene|11v1|SRR096785X128629 | 6401 | 269 | 85.3 | globlastp |
| 3436 | RIN44 | sunflower|12v1|DY915288 | 6402 | 269 | 85.3 | globlastp |
| 3437 | RIN44 | tragopogon|10v1|SRR020205S0042841 | 6403 | 269 | 85.3 | globlastp |
| 3438 | RIN44 | amaranthus|13v1|SRR039411X156152D1_T1 | 6404 | 269 | 85.25 | glotblastn |
| 3439 | RIN44 | ambrosia|11v1|SRR346935.119605_T1 | 6405 | 269 | 85.25 | glotblastn |
| 3440 | RIN44 | flaveria|11v1|SRR149232.111836_T1 | 6406 | 269 | 85.25 | glotblastn |
| 3441 | RIN44 | chrysanthemum|14v1|CCOR13V1K23C430131_P1 | 6407 | 269 | 84.9 | globlastp |
| 3442 | RIN44 | chrysanthemum|14v1|SRR290491X100322D1_P1 | 6407 | 269 | 84.9 | globlastp |
| 3443 | RIN44 | chrysanthemum|14v1|SRR290491X335873D1_P1 | 6407 | 269 | 84.9 | globlastp |
| 3444 | RIN44 | chrysanthemum|14v1|SRR525216X18089D1_P1 | 6408 | 269 | 84.9 | globlastp |
| 3445 | RIN44 | cichorium|14v1|DT211198_P1 | 6409 | 269 | 84.9 | globlastp |
| 3446 | RIN44 | parsley|14v1|BSS12K19C206925_P1 | 6410 | 269 | 84.9 | globlastp |
| 3447 | RIN44 | ambrosia|11v1|SRR346943.102476_P1 | 6411 | 269 | 84.9 | globlastp |
| 3448 | RIN44 | centaurea|11v1|EH734462_P1 | 6412 | 269 | 84.9 | globlastp |
| 3449 | RIN44 | cynara|gb167|GE603226_P1 | 6413 | 269 | 84.9 | globlastp |
| 3450 | RIN44 | flaveria|11v1|SRR149229.127289_P1 | 6414 | 269 | 84.9 | globlastp |
| 3451 | RIN44 | banana|12v1|MAGEN2012026350 | 6415 | 269 | 84.8 | globlastp |
| 3452 | RIN44 | curcuma|10v1|DY385358_P1 | 6416 | 269 | 84.8 | globlastp |
| 3453 | RIN44 | sugarcane|10v1|CA084788 | 6417 | 269 | 84.79 | glotblastn |
| 3454 | RIN44 | b_oleracea|14v1|EE442663_P1 | 6418 | 269 | 84.5 | globlastp |
| 3455 | RIN44 | pepper|14v1|GD056255_P1 | 6419 | 269 | 84.5 | globlastp |
| 3456 | RIN44 | b_rapa|11v1|GR452784_P1 | 6420 | 269 | 84.5 | globlastp |
| 3457 | RIN44 | cichorium|14v1|CII14V1K19C664563_P1 | 6421 | 269 | 84.4 | globlastp |
| 3458 | RIN44 | petunia|gb171|DW177184_P1 | 6422 | 269 | 84.4 | globlastp |
| 3459 | RIN44 | arnica|11v1|SRR099034X115667_P1 | 6423 | 269 | 84.4 | globlastp |
| 3460 | RIN44 | arnica|11v1|SRR099034X126737_P1 | 6424 | 269 | 84.4 | globlastp |
| 3461 | RIN44 | centaurea|11v1|EH752311_P1 | 6425 | 269 | 84.4 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3462 | RIN44 | cichorium\|gb171\|DT211198 | 6421 | 269 | 84.4 | globlastp |
| 3463 | RIN44 | cirsium\|11v1\|SRR346952.1045901_P1 | 6425 | 269 | 84.4 | globlastp |
| 3464 | RIN44 | fagopyrum\|11v1\|SRR063689X107361_P1 | 6426 | 269 | 84.4 | globlastp |
| 3465 | RIN44 | flaveria\|11v1\|SRR149229.265009_P1 | 6427 | 269 | 84.4 | globlastp |
| 3466 | RIN44 | flaveria\|11v1\|SRR149241.118833_P1 | 6428 | 269 | 84.4 | globlastp |
| 3467 | RIN44 | lettuce\|12v1\|BQ988212_P1 | 6429 | 269 | 84.4 | globlastp |
| 3468 | RIN44 | sesame\|12v1\|SESI12V1285236 | 6430 | 269 | 84.4 | globlastp |
| 3469 | RIN44 | sunflower\|12v1\|EL426528 | 6431 | 269 | 84.4 | globlastp |
| 3470 | RIN44 | flaveria\|11v1\|SRR149229.21834_T1 | 6432 | 269 | 84.33 | glotblastn |
| 3471 | RIN44 | banana\|14v1\|FL661351_P1 | 6433 | 269 | 84.3 | globlastp |
| 3472 | RIN44 | echinochloa\|14v1\|SRR522894X264423D1_P1 | 6434 | 269 | 84.3 | globlastp |
| 3473 | RIN44 | banana\|12v1\|FL661351 | 6433 | 269 | 84.3 | globlastp |
| 3474 | RIN44 | b_oleracea\|14v1\|AM385714_P1 | 6435 | 269 | 84 | globlastp |
| 3475 | RIN44 | arabidopsis\|13v2\|AT1G28550_P1 | 6436 | 269 | 84 | globlastp |
| 3476 | RIN44 | pepper\|12v1\|GD056255 | 6437 | 269 | 84 | globlastp |
| 3477 | RIN44 | radish\|gb164\|EX746923 | 6438 | 269 | 84 | globlastp |
| 3478 | RIN44 | dandelion\|10v1\|DY805517_P1 | 6439 | 269 | 83.9 | globlastp |
| 3479 | RIN44 | fagopyrum\|11v1\|SRR063689X11756_P1 | 6440 | 269 | 83.9 | globlastp |
| 3480 | RIN44 | flaveria\|11v1\|SRR149229.301696_P1 | 6441 | 269 | 83.9 | globlastp |
| 3481 | RIN44 | sunflower\|12v1\|DY904808 | 6442 | 269 | 83.9 | globlastp |
| 3482 | RIN44 | valeriana\|11v1\|SRR099039X11149 | 6443 | 269 | 83.9 | globlastp |
| 3483 | RIN44 | euphorbia\|11v1\|DV126875_P1 | 6444 | 269 | 83.8 | globlastp |
| 3484 | RIN44 | arabidopsis_lyrata\|13v1\|DQ056467_P1 | 6445 | 269 | 83.6 | globlastp |
| 3485 | RIN44 | b_rapa\|11v1\|CD822268_P1 | 6446 | 269 | 83.6 | globlastp |
| 3486 | RIN44 | b_rapa\|11v1\|E6ANDIZ01EHD0P_P1 | 6447 | 269 | 83.6 | globlastp |
| 3487 | RIN44 | thellumgiella_halophilum\|13v1\|EHJGI11006167 | 6445 | 269 | 83.6 | globlastp |
| 3488 | RIN44 | arnica\|11v1\|SRR099034X146027_P1 | 6448 | 269 | 83.5 | globlastp |
| 3489 | RIN44 | flaveria\|11v1\|SRR149232.121675_P1 | 6449 | 269 | 83.5 | globlastp |
| 3490 | RIN44 | kiwi\|gb166\|FG421856_P1 | 6450 | 269 | 83.5 | globlastp |
| 3491 | RIN44 | spikemoss\|gb165\|DN838839 | 6451 | 269 | 83.5 | globlastp |
| 3492 | RIN44 | sunflower\|12v1\|CD851540 | 6452 | 269 | 83.5 | globlastp |
| 3493 | RIN44 | sunflower\|12v1\|SRR346950X163545 | 6452 | 269 | 83.5 | globlastp |
| 3494 | RIN44 | banana\|12v1\|MAGEN2012005906P1 | 6453 | 269 | 83.4 | globlastp |
| 3495 | RIN44 | arabidopsis_lyrata\|13v1\|DQ446594_P1 | 6454 | 269 | 83.1 | globlastp |
| 3496 | RIN44 | arabidopsis\|13v2\|AT2G33870_P1 | 6454 | 269 | 83.1 | globlastp |
| 3497 | RIN44 | canola\|11v1\|EE453825_P1 | 6455 | 269 | 83.1 | globlastp |
| 3498 | RIN44 | olea\|13v1\|SRR014463X12029D1_P1 | 6456 | 269 | 83.1 | globlastp |
| 3499 | RIN44 | pepper\|14v1\|GD092092_P1 | 6457 | 269 | 83 | globlastp |
| 3500 | RIN44 | cotton\|11v1\|SRR032367.171510_P1 | 6458 | 269 | 83 | globlastp |
| 3501 | RIN44 | fagopyrum\|11v1\|SRR063703X1286_P1 | 6459 | 269 | 83 | globlastp |
| 3502 | RIN44 | gossypium_raimondii\|13v1\|GRJGIV8003391_P1 | 6458 | 269 | 83 | globlastp |
| 3503 | RIN44 | nicotiana_benthamiana\|12v1\|NB12v1CRP023728_P1 | 6460 | 269 | 83 | globlastp |
| 3504 | RIN44 | nicotiana_benthamiana\|12v1\|NB12v1CRP057290_P1 | 6461 | 269 | 83 | globlastp |
| 3505 | RIN44 | solanum_phureja\|09v1\|SPHBG136292 | 6462 | 269 | 83 | globlastp |
| 3506 | RIN44 | petunia\|gb171\|DC241142_T1 | 6463 | 269 | 82.95 | glotblastn |
| 3507 | RIN44 | banana\|14v1\|MAGEN2012012212_P1 | 6464 | 269 | 82.9 | globlastp |
| 3508 | RIN44 | spurge\|gb161\|DV126875 | 6465 | 269 | 82.9 | globlastp |
| 3509 | RIN44 | antirrhinum\|gb166\|AJ789317_P1 | 6466 | 269 | 82.6 | globlastp |
| 3510 | RIN44 | marchantia\|gb166\|AB288008_P1 | 6467 | 269 | 82.6 | globlastp |
| 3511 | RIN44 | phyla\|11v2\|SRR099035X35056_P1 | 6468 | 269 | 82.6 | globlastp |
| 3512 | RIN44 | platanus\|11v1\|SRR096786X100315_P1 | 6469 | 269 | 82.6 | globlastp |
| 3513 | RIN44 | pteridium\|11v1\|SRR043594X121968 | 6470 | 269 | 82.6 | globlastp |
| 3514 | RIN44 | thellungiella_halophilum\|13v1\|EHJGI11000740 | 6471 | 269 | 82.6 | globlastp |
| 3515 | RIN44 | thellungiella_parvulum\|13v1\|EP13V1CRP002155 | 6472 | 269 | 82.6 | globlastp |
| 3516 | RIN44 | thellungiella_parvulum\|13v1\|EP13V1CRP011210 | 6473 | 269 | 82.6 | globlastp |
| 3517 | RIN44 | tomato\|13v1\|BG136292 | 6474 | 269 | 82.6 | globlastp |
| 3518 | RIN44 | millet\|10v1\|EVO454PM334086_P1 | 6475 | 269 | 82.5 | globlastp |
| 3519 | RIN44 | parsley\|14v1\|BSS12K19C111946_P1 | 6476 | 269 | 82.4 | globlastp |
| 3520 | RIN44 | peanut\|13v1\|SRR042415X44092_P1 | 6477 | 269 | 82.3 | globlastp |
| 3521 | RIN44 | banana\|14v1\|MAGEN2012022553_P1 | 6478 | 269 | 82.1 | globlastp |
| 3522 | RIN44 | ambrosia\|11v1\|SRR346935.115765_P1 | 6479 | 269 | 82.1 | globlastp |
| 3523 | RIN44 | ambrosia\|11v1\|SRR346935.261747_P1 | 6480 | 269 | 82.1 | globlastp |
| 3524 | RIN44 | banana\|12v1\|MAGEN2012022553 | 6478 | 269 | 82.1 | globlastp |
| 3525 | RIN44 | nicotiana_benthamiana\|12v1\|CN747749_P1 | 6481 | 269 | 82.1 | globlastp |
| 3526 | RIN44 | thellungiella_halophilum\|13v1\|SRR487818.114860 | 6482 | 269 | 82.1 | globlastp |
| 3528 | RIN44 | radish\|gb164\|EV567048 | 6483 | 269 | 82 | globlastp |
| 3529 | RIN44 | cyclamen\|14v1\|B14ROOTK19C163097_P1 | 6484 | 269 | 81.8 | globlastp |
| 3530 | RIN44 | cotton\|11v1\|CO095695_P1 | 6485 | 269 | 81.7 | globlastp |
| 3531 | RIN44 | ambrosia\|11v1\|SRR346949.110657_P1 | 6486 | 269 | 81.7 | globlastp |
| 3532 | RIN44 | cedrus\|11v1\|SRR065007X106994_P1 | 6487 | 269 | 81.7 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3533 | RIN44 | nicotiana_benthamiana\|12v1\|NB12v1CRP022550_P1 | 6488 | 269 | 81.7 | globlastp |
| 3534 | RIN44 | podocarpus\|10v1\|SRR065014S0007246_P1 | 6489 | 269 | 81.7 | globlastp |
| 3535 | RIN44 | pteridium\|11v1\|SRR043594X11265 | 6490 | 269 | 81.7 | globlastp |
| 3536 | RIN44 | solanum_phureja\|09v1\|SPHBG626641 | 6491 | 269 | 81.7 | globlastp |
| 3537 | RIN44 | fagopyrum\|11v1\|SRR063639X115478_P1 | 6492 | 269 | 81.6 | globlastp |
| 3538 | RIN44 | spikemoss\|gb165\|DN839336 | 6493 | 269 | 81.53 | glotblastn |
| 3539 | RIN44 | abies\|11v2\|SRR098676X108080_P1 | 6494 | 269 | 81.2 | globlastp |
| 3540 | RIN44 | canola\|11v1\|EV164212_P1 | 6495 | 269 | 81.2 | globlastp |
| 3541 | RIN44 | cedrus\|11v1\|SRR065007X108589_P1 | 6494 | 269 | 81.2 | globlastp |
| 3542 | RIN44 | centaurea\|11v1\|EH762876_P1 | 6496 | 269 | 81.2 | globlastp |
| 3543 | RIN44 | centaurea\|11v1\|EH764927_P1 | 6496 | 269 | 81.2 | globlastp |
| 3544 | RIN44 | cephalotaxus\|11v1\|SRR064395X136513_P1 | 6497 | 269 | 81.2 | globlastp |
| 3545 | RIN44 | gossypium_raimondii\|13v1\|DW504795_P1 | 6498 | 269 | 81.2 | globlastp |
| 3546 | RIN44 | spruce\|11v1\|ES260868 | 6494 | 269 | 81.2 | globlastp |
| 3547 | RIN44 | tomato\|13v1\|BG626641 | 6499 | 269 | 81.2 | globlastp |
| 3548 | RIN44 | cucumber\|09v1\|AM738794_P1 | 6500 | 269 | 81 | globlastp |
| 3549 | RIN44 | cucurbita\|11v1\|SRR091276X103886_P1 | 6501 | 269 | 81 | globlastp |
| 3550 | RIN44 | arabidopsis\|13v2\|AT4G18800_P1 | 6502 | 269 | 80.8 | globlastp |
| 3551 | RIN44 | arabidopsis_lyrata\|13v1\|T14100_P1 | 6503 | 269 | 80.8 | globlastp |
| 3552 | RIN44 | b_rapa\|11v1\|EX067677_P1 | 6504 | 269 | 80.8 | globlastp |
| 3553 | RIN44 | centaurea\|11v1\|EL931394_P1 | 6505 | 269 | 80.7 | globlastp |
| 3554 | RIN44 | maritime_pine\|10v1\|BX249423_P1 | 6506 | 269 | 80.7 | globlastp |
| 3555 | RIN44 | pine\|10v2\|AI813071_P1 | 6506 | 269 | 80.7 | globlastp |
| 3556 | RIN44 | pseudotsuga\|10v1\|SRR065119S0025298 | 6507 | 269 | 80.7 | globlastp |
| 3557 | RIN44 | pteridium\|11v1\|SRR043594X10999 | 6508 | 269 | 80.7 | globlastp |
| 3558 | RIN44 | spikemoss\|gb165\|FE507023 | 6509 | 269 | 80.7 | globlastp |
| 3559 | RIN44 | coconut\|14v1\|COCOS14V1K19C1025074_P1 | 6510 | 269 | 80.5 | globlastp |
| 3560 | RIN44 | coconut\|14v1\|COCOS14V1K19C349621_P1 | 6511 | 269 | 80.5 | globlastp |
| 3561 | RIN44 | gossypium_raimondii\|13v1\|GFXAY632360X1_P1 | 6512 | 269 | 80.5 | globlastp |
| 3562 | RIN44 | phalaenopsis\|11v1\|SRR125771.1005309_P1 | 6513 | 269 | 80.5 | globlastp |
| 3563 | RIN44 | thellungiella_parvulum\|13v1\|SRR487818.106136 | 6514 | 269 | 80.5 | globlastp |
| 3564 | RIN44 | watermelon\|11v1\|AM738794 | 6515 | 269 | 80.5 | globlastp |
| 3565 | RIN44 | melon\|10v1\|AM738794_T1 | 6516 | 269 | 80.45 | glotblastn |
| 3566 | RIN44 | utricularia\|11v1\|SRR094438.115760 | 6517 | 269 | 80.45 | glotblastn |
| 3567 | RIN44 | amorphophallus\|11v2\|SRR346501.178551_P1 | 6518 | 269 | 80.4 | globlastp |
| 3568 | RIN44 | b_rapa\|11v1\|DY007433_P1 | 6519 | 269 | 80.4 | globlastp |
| 3569 | RIN44 | cleome_gynandra\|10v1\|SRR015532S0026089_P1 | 6520 | 269 | 80.4 | globlastp |
| 3570 | RIN44 | guizotia\|10v1\|GE557520_P1 | 6521 | 269 | 80.3 | globlastp |
| 3571 | RIN44 | sciadopitys\|10v1\|SRR065035S0012141 | 6522 | 269 | 80.3 | globlastp |
| 3572 | RIN44 | b_oleracea\|14v1\|EE550081_T1 | 6523 | 269 | 80.28 | glotblastn |
| 3573 | RIN44 | b_oleracea\|14v1\|EX067677_T1 | 6524 | 269 | 80.28 | glotblastn |
| 3574 | RIN44 | distylium\|11v1\|SRR065077X144105_T1 | 6525 | 269 | 80.28 | glotblastn |
| 3575 | RIN44 | clover\|14v1\|ERR351507S19XK19C250651_P1 | 6526 | 269 | 80.2 | globlastp |
| 3576 | RIN44 | canola\|11v1\|ES981511_P1 | 6527 | 269 | 80.2 | globlastp |
| 3577 | RIN44 | thellungiella_halophilum\|13v1\|SRR487818.380245 | 6528 | 269 | 80.18 | glotblastn |
| 3578 | RIN44 | cotton\|11v1\|DT563255XX1_P1 | 6529 | 269 | 80.1 | globlastp |
| 3579 | RIN44 | aristolochia\|10v1\|SRR039082S0177578_P1 | 6530 | 269 | 80.1 | globlastp |
| 3580 | RIN44 | cacao\|13v1\|CU503250_P1 | 6531 | 269 | 80.1 | globlastp |
| 3581 | RIN44 | sunflower\|12v1\|EE649050 | 6532 | 269 | 80 | globlastp |
| 3582 | LGB11 | pineapple\|14v1\|DT339529_P1 | 6533 | 270 | 84.1 | globlastp |
| 3583 | LGB11 | phalaenopsis\|11v1\|CK856635_P1 | 6534 | 270 | 80.8 | globlastp |
| 3584 | LGB11 | onion\|14v1\|SRR073446X304654D1_P1 | 6535 | 270 | 80.6 | globlastp |
| 3585 | LGD7 | cleome_spinosa\|10v1\|SRR015531S0037929_T1 | 6536 | 272 | 82.25 | glotblastn |
| 3586 | LGA6 | gossypium_raimondii\|13v1\|AI728967_P1 | 275 | 275 | 100 | globlastp |
| 3587 | LGA6 | papaya\|gb165\|GFXEF645801X1_T1 | 6537 | 275 | 82.86 | glotblastn |
| 3588 | LGA9 | cotton\|11v1\|SRR032367.533610_T1 | — | 276 | 97.9 | glotblastn |
| 3589 | LGA9 | olea\|13v1\|SRR014464X40062D1_P1 | 6538 | 276 | 86.1 | globlastp |
| 3590 | LGA9 | petunia\|gb171\|CV293159_P1 | 6539 | 276 | 85.3 | globlastp |
| 3591 | LGA9 | cacao\|13v1\|CU505498_P1 | 6540 | 276 | 84.9 | globlastp |
| 3592 | LGA9 | jatropha\|09v1\|GH295610_P1 | 6541 | 276 | 84.9 | globlastp |
| 3593 | LGA9 | coffea\|10v1\|DV700377_P1 | 6542 | 276 | 84.8 | globlastp |
| 3594 | LGA9 | cassava\|09v1\|CK643438_P1 | 6543 | 276 | 84.2 | globlastp |
| 3595 | LGA9 | euphorbia\|11v1\|DV120163_P1 | 6544 | 276 | 82.9 | globlastp |
| 3596 | LGA9 | spurge\|gb161\|DV120163 | 6545 | 276 | 82.8 | globlastp |
| 3597 | LGA9 | utricularia\|11v1\|SRR094438.103956 | 6546 | 276 | 82.8 | globlastp |
| 3598 | LGA9 | castorbean\|14v2\|T14863_P1 | 6547 | 276 | 82.2 | globlastp |
| 3599 | LGA9 | castorbean\|12v1\|T14863 | 6547 | 276 | 82.2 | globlastp |
| 3600 | LGA9 | clementine\|11v1\|CB291348_P1 | 6548 | 276 | 82.2 | globlastp |
| 3601 | LGA9 | hevea\|10v1\|EC600080_P1 | 6549 | 276 | 82.2 | globlastp |
| 3602 | LGA9 | orange\|11v1\|CB291348_P1 | 6548 | 276 | 82.2 | globlastp |

TABLE 179-continued

Homologues (e.g., orthologues) of the identified genes/polypeptides for increasing abiotic stress tolerance, water use efficiency, yield, growth rate, vigor, oil content, biomass, growth rate, nitrogen use efficiency and fertilizer use efficiency of a plant

| P.N. SEQ ID NO: | Hom. to Gene Name | cluster name | P.P. SEQ ID NO: | Hom. to SEQ ID NO: | % glob. Ident. | Algor. |
|---|---|---|---|---|---|---|
| 3603 | LGA9 | thellungiella_parvulum\|13v1\|BY801935 | 6550 | 276 | 81.82 | glotblastn |
| 3604 | LGA9 | phyla\|11v2\|SRR099035X107274__P1 | 6551 | 276 | 81.8 | globlastp |
| 3605 | LGA9 | liriodendron\|gb166\|DT580185__P1 | 6552 | 276 | 81.8 | globlastp |
| 3606 | LGA9 | thellungiella_halophilum\|13v1\|BY801935 | 6553 | 276 | 81.5 | globlastp |
| 3607 | LGA9 | pepper\|14v1\|CA525422__P1 | 6554 | 276 | 81.4 | globlastp |
| 3608 | LGA9 | pepper\|12v1\|CA525422 | 6554 | 276 | 81.4 | globlastp |
| 3609 | LGA9 | chestnut\|gb170\|SRR006295S0044763 | 6555 | 276 | 81.12 | globlastp |
| 3610 | LGA9 | cleome_spinosa\|10v1\|GR934782__T1 | 6556 | 276 | 81.12 | globlastp |
| 3611 | LGA9 | cotton\|11v1\|DW499045__T1 | 6557 | 276 | 81.12 | glotblastn |
| 3612 | LGA9 | gossypium_raimondii\|13v1\|DW499045__T1 | 6558 | 276 | 81.12 | glotblastn |
| 3613 | LGA9 | beech\|11v1\|SRR006293.11390__T1 | 6559 | 276 | 80.42 | glotblastn |
| 3614 | LGA9 | eucalyptus\|11v2\|CD669782__T1 | 6560 | 276 | 80.42 | glotblastn |
| 3615 | LGA9 | radish\|gb164\|EV537754 | 6561 | 276 | 80.1 | globlastp |
| 3616 | LGA9 | radish\|gb164\|EW735530 | 6561 | 276 | 80.1 | globlastp |
| 3617 | LGA9 | radish\|gb164\|EX755332 | 6561 | 276 | 80.1 | globlastp |
| 3618 | LGA9 | soybean\|13v2\|GLYMA03G31960 | 6562 | 276 | 80.1 | globlastp |
| 3619 | LGA17 | maize\|13v2\|AI619115__P1 | 6563 | 277 | 98 | globlastp |
| 3620 | LGA17 | maize\|13v2\|AI600525__P1 | 6564 | 277 | 97.7 | globlastp |
| 3621 | LGA17 | foxtail_millet\|13v2\|SRR350548X135549 | 6565 | 277 | 96.3 | globlastp |
| 3622 | LGA17 | foxtail_millet\|14v1\|JK553133__P1 | 6565 | 211 | 96.3 | globlastp |
| 3623 | LGA17 | switchgrass\|12v1\|FE611775 | 6566 | 211 | 95.7 | globlastp |
| 3624 | LGA17 | switchgrass\|12v1\|FL914630 | 6567 | 211 | 88.44 | glotblastn |
| 3625 | LGD1 | wheat\|12v3\|BE405478 | 6568 | 281 | 98.3 | globlastp |
| 3626 | LGD1 | rye\|12v1\|DRR001012.147774 | 6569 | 281 | 97.7 | globlastp |
| 3627 | LGD1 | barley\|12v1\|BF631209__P1 | 6570 | 281 | 97.3 | globlastp |
| 3628 | LGD7 | b_rapa\|11v1\|CX273158__P1 | 282 | 282 | 100 | globlastp |
| 3629 | LGD7 | canola\|11v1\|CN731556__P1 | 6571 | 282 | 98 | globlastp |
| 3630 | LGD7 | b_oleracea\|14v1\|EE451543__P1 | 6572 | 282 | 91.2 | globlastp |
| 3631 | LGD7 | radish\|gb164\|EV550854 | 6573 | 282 | 89.2 | globlastp |
| 3632 | LGD8 | cowpea\|12v1\|FF383509__P1 | 6574 | 283 | 90.9 | globlastp |
| 3633 | LGD10 | cowpea\|12v1\|FF546254__P1 | 6575 | 284 | 93.8 | globlastp |
| 3634 | LGD10 | soybean\|13v2\|GLYMA06G17900 | 6576 | 284 | 90.1 | globlastp |
| 3635 | LGD10 | soybean\|13v2\|GLYMA04G37150P1 | 6577 | 284 | 87 | globlastp |
| 3636 | LGD10 | chickpea\|13v2\|SRR133519.127676__P1 | 6578 | 284 | 81.2 | globlastp |
| 3637 | LGD14 | cichorium\|14v1\|DT213181__P1 | 6579 | 285 | 80.7 | globlastp |
| 3638 | LGM7 | foxtail_millet\|13v2\|SRR350549X114369 | 6580 | 286 | 86.1 | globlastp |
| 3639 | LGM7 | foxtail_millet\|14v1\|XM_004953342__P1 | 6580 | 286 | 86.1 | globlastp |
| 3640 | LGM16 | rye\|12v1\|DRR001012.110595 | 6581 | 287 | 82.6 | globlastp |
| 3641 | LGM22 | rice\|13v2\|BI807358 | 6582 | 289 | 90.2 | globlastp |
| 3642 | LGM23 | maize\|13v2\|CD936584__T1 | 6583 | 290 | 90.1 | glotblastn |
| 3643 | MGP17 | rye\|12v1\|DRR001012.155499 | 6584 | 291 | 91.8 | globlastp |
| 3644 | MGP18 | cacao\|13v1\|CU551482__P1 | 6585 | 292 | 90.6 | globlastp |
| 3645 | MGP20 | brachypodium\|13v2\|BRADI1G06700 | 6586 | 293 | 85.1 | globlastp |
| 3646 | MGP20 | brachypodium\|14v1\|DV474102__P1 | 6586 | 293 | 85.1 | globlastp |
| 3647 | MGP34 | maize\|13v2\|AI586806__P1 | 6587 | 295 | 91.2 | globlastp |
| 3648 | MGP34 | sugarcane\|10v1\|BU925676 | 6588 | 295 | 83.1 | globlastp |
| 3649 | MGP42 | brachypodium\|13v2\|BRADI2G44530 | 6589 | 297 | 94.5 | globlastp |
| 3650 | MGP42 | brachypodium\|14v1\|GT799139__P1 | 6589 | 297 | 94.5 | globlastp |
| 10 | MGP22 | foxtail_millet\|13v2\|SRR350548X140046 | 191 | 251 | 83.23 | globlastp |
| 70 | LGB5 | maize\|13v2\|CF629964 | 251 | 191 | 83.23 | globlastp |

Table 179: Provided are the homologous polypeptides (polyp.) and polynucleotides (polyn.) of the genes for increasing abiotic stress tolerance, yield, growth rate, vigor, oil content, fiber yield, fiber quality, biomass, nitrogen use efficiency, water use efficiency and fertilizer use efficiency genes of a plant which are listed in Table 178 above. Homology was calculated as % of identity over the aligned sequences (global identity over the entire sequence). The query sequences were polynucleotide and polypeptides depicted in Table 178 above, and the subject sequences are protein and polynucleotide sequences identified in the database based on greater than 80% global identity to the query nucleotide and/or polypeptide sequences. Hom. = Homology; Glob. = Global; Algor. = Algorithm. Ident. = identity. "p.n." = polynucleotide; "p.p." = polypeptide.

The output of the functional genomics approach described herein is a set of genes highly predicted to improve ABST, yield and/or other agronomic important traits such as growth rate, vigor, biomass, growth rate, oil content, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 20

Gene Cloning and Generation of Binary Vectors for Plant Expression

To validate their role in improving yield, selected genes were over-expressed in plants, as follows.

Cloning Strategy

Selected genes from those presented in Examples 1-19 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/ limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Usually, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested/undigested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase is needed.

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc or pQsFN) and the NOS terminator (SEQ ID NO: 6625) via digestion with appropriate restriction endonucleases.

Several DNA sequences of the selected genes were synthesized by GeneArt (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

Figure 11:
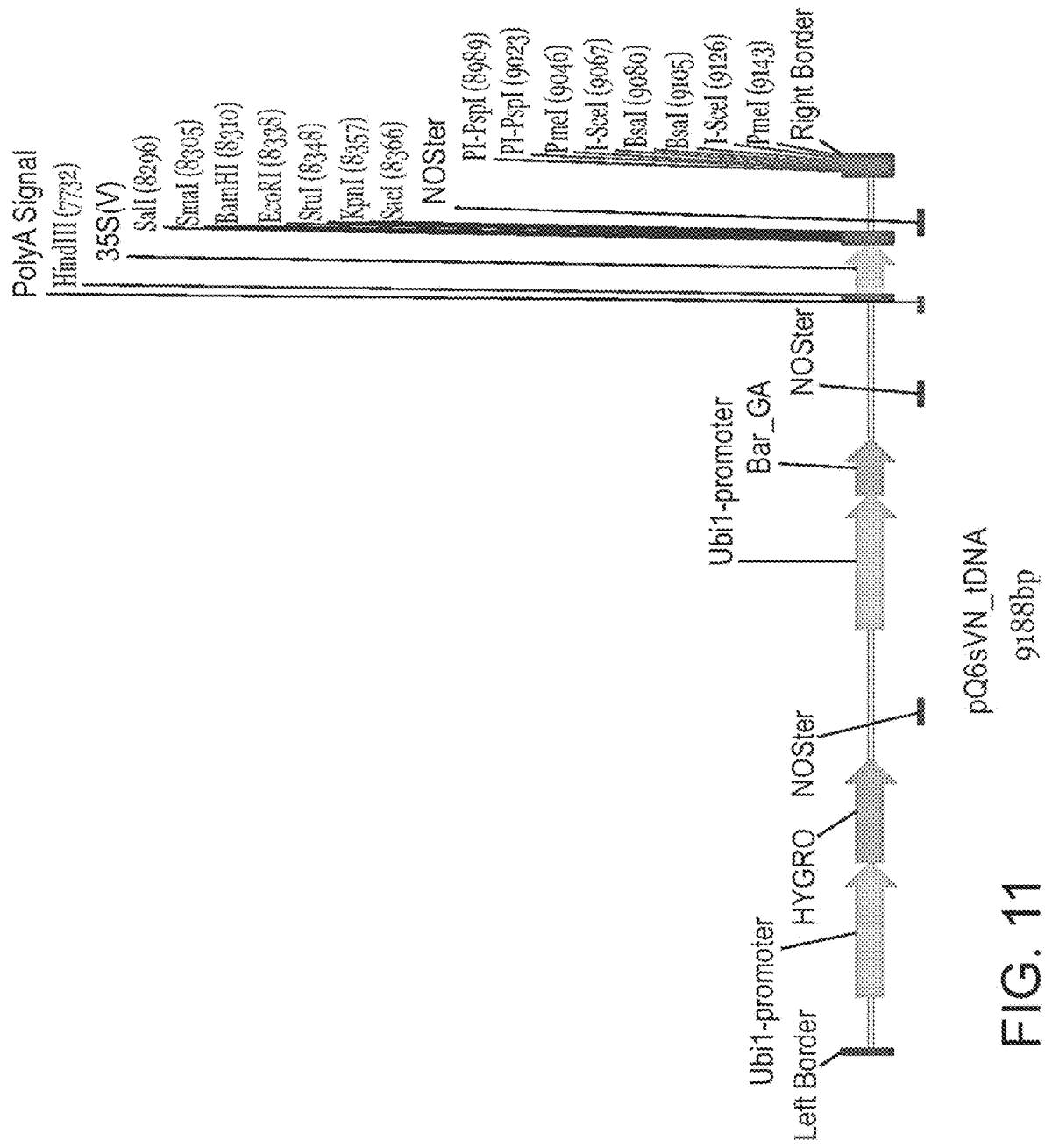
FIG. 11 is a schematic illustration of the pQ6sVN plasmid. pQ6sVN was used for expression of the isolated polynucleotide sequences of some embodiments of the invention in Brachypodium. "35S(V)"=35S promoter (SEQ ID NO:6626); "NOS ter"=nopaline synthase terminator; "Bar_GA"=BAR open reading frame optimized for expression in Brachypodium (SEQ ID NO: 6628); "Hygro"=Hygromycin resistance gene. "Ubi1 promoter"=SEQ ID NO: 6600; The isolated polynucleotide sequences of some embodiments of the invention were cloned into the Multiple cloning site of the vector (downstream of the "35S(V)" promoter) using one or more of the indicated restriction enzyme sites.
Figure 12:
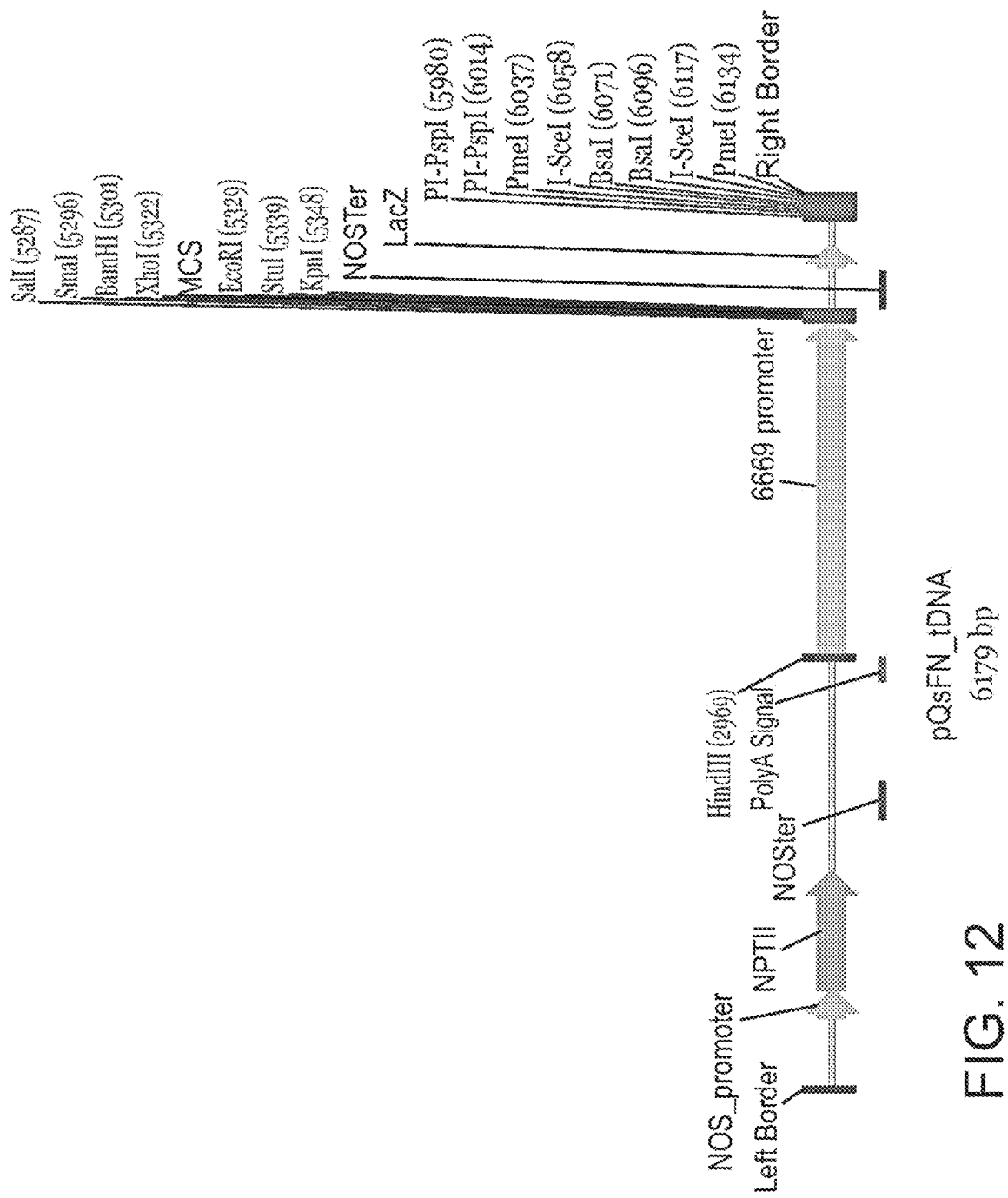
FIG. 12 is a schematic illustration of the pQsFN plasmid containing the new At6669 promoter (SEQ ID NO: 6614) used for expression the isolated polynucleotide sequences of the invention in *Arabidopsis*. RB—T-DNA right border, LB—T-DNA left border, MCS—Multiple cloning site; RE—any restriction enzyme; NOS pro=nopaline synthase promoter, NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 13:
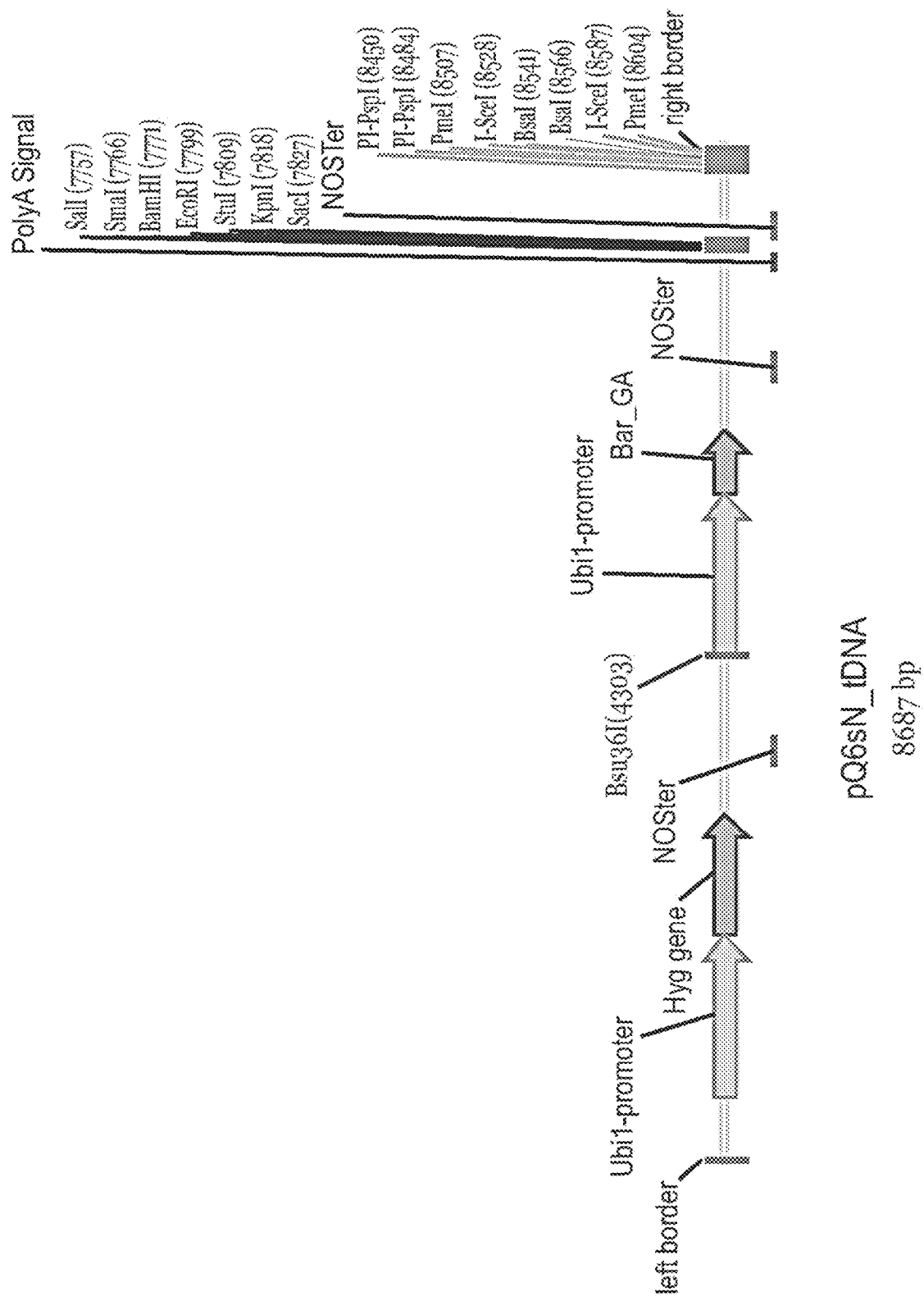
FIG. 13 is schematic illustration pQ6sN plasmid, which is used as a negative control ("empty vector") of the experiments performed when the plants were transformed with the pQ6sVN vector. "Ubi1" promoter (SEQ ID NO: 6600); NOS ter=nopaline synthase terminator; "Bar_GA"=BAR open reading frame optimized for expression in Brachypodium (SEQ ID NO:6628).

The modified pGI vector (e.g., pQFN, pQFNc, pQYN_6669, pQNa_RP, pQFYN, pQXNc, pQ6sVN (FIG. 11) or pQsFN (FIG. 12)) is a modified version of the pGI vector in which the cassette is inverted between the left and right borders so the gene and its corresponding promoter are close to the right border and the NPTII gene is close to the left border.

At6669, the new *Arabidopsis thaliana* promoter sequence (SEQ ID NO: 6614) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

In case of Brachypodium transformation, after confirming the sequences of the cloned genes, the cloned cDNAs were introduced into pQ6sVN (FIG. 11) containing 35S promoter (SEQ ID NO: 6626) and the NOS terminator (SEQ ID NO: 6625) via digestion with appropriate restriction endonucleases. The genes were cloned downstream to the 35S promoter and upstream to the NOS terminator. In the pQ6sVN vector the Hygromycin resistance gene cassette and the Bar_GA resistance gene cassette replaced the NPTII resistance gene cassette. pQ6sVN contains the 35S promoter (SEQ ID NO: 6626). Bar_GA resistance gene (SEQ ID NO: 6628) is an optimized sequence of the BAR gene for expression in Brachypodium plants (ordered from GeneArt).

Figure 9A:
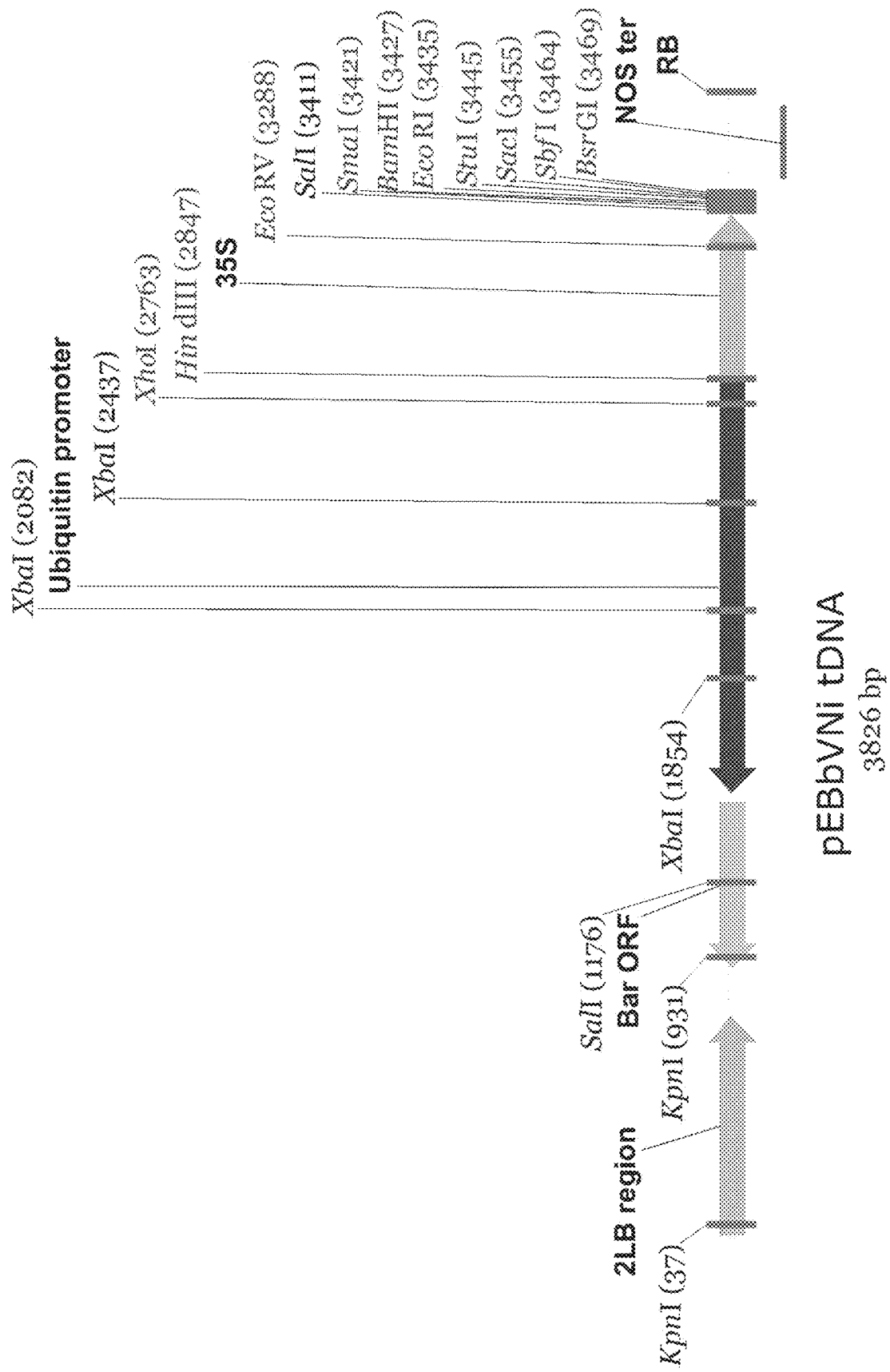
FIGS. 9A-B are schematic illustrations of the pEBbVNi tDNA (FIG. 9A) and the pEBbNi tDNA (FIG. 9B) plasmids used in the Brachypodium experiments. pEBbVNi tDNA (FIG. 9A) was used for expression of the isolated polynucleotide sequences of some embodiments of the invention in Brachypodium. pEBbNi tDNA (FIG. 9B) was used for transformation into Brachypodium as a negative control. "RB"=right border; "2LBregion"=2 repeats of left border, "35S"=35S promoter (SEQ ID NO: 10666 in FIG. 9A); "Ubiquitin promoter (SEQ ID NO: 6600 in both of FIGS. 9A and 9B; "NOS ter"=nopaline synthase terminator; "Bar ORF"—BAR open reading frame (GenBank Accession No. JQ293091.1; SEQ ID NO: 6627; The isolated polynucleotide sequences of some embodiments of the invention were cloned into the Multiple cloning site of the vector using one or more of the indicated restriction enzyme sites.

Additionally or alternatively, Brachypodium transformation was performed using the pEBbVNi vector. pEBbVNi (FIG. 9A) is a modified version of pJJ2LB in which the Hygromycin resistance gene was replaced with the BAR gene which confers resistance to the BASTA herbicide [BAR gene coding sequence is provided in GenBank Accession No. JQ293091.1 (SEQ ID NO: 6627); further description is provided in Akama K, et al. "Efficient *Agrobacterium-mediated transformation of Arabidopsis thaliana using the bar gene as selectable marker*", Plant Cell Rep. 1995, 14(7):450-4; Christiansen P, et al. "*A rapid and efficient transformation protocol for the grass Brachypodium distachyon*", Plant Cell Rep. 2005 March; 23(10-11):751-8. Epub 2004 Oct. 19; and Păcurar D I, et al. "A high-throughput *Agrobacterium*-mediated transformation system for the grass model species Brachypodium distachyon L", Transgenic Res. 2008 17(5):965-75; each of which is fully incorporated herein by reference in its entirety]. The pEBbVNi construct contains the 35S promoter (SEQ ID NO: 6626). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104).

TABLE 180

Cloned genes

| Gene Name | High copy plasmid | Organism | Primers used SEQ ID NOs: | Polynucleotide SEQ ID NO: | Polypeptide SEQ ID NO: |
| --- | --- | --- | --- | --- | --- |
| LGA1_H4 | pMA-RQ_LGA1_H4_GA | barley | 6715, 6778, 6761, 6788 | 106 | 187 |
| LGA17 | pUCsFN_LGA17 | barley | 6774, 6630, 6747, 6651 | 105 | 277 |
| LGA2 | pQFNc_LGA2 | barley | 6797, 6673, 6805, 6668 | 102 | 183 |
| LGA6 | pUCsFN_LGA6 | cotton | 6809, 6671, 6809, 6671 | 103 | 275 |
| LGA9 | pUCsFN_LGA9 | | | 104 | 276 |
| LGB1 | TopoB_LGB1 | maize | 6811, 6663, 6811, 6666 | 107 | 278 |
| LGB10 | TopoB_LGB10 | maize | 6807, 6667, 6800, 6665 | 113 | 279 |
| LGB11 | pMA_LGB11_GA | maize | 6762, 6781, 6773, 6780 | 114 | 196 |
| LGB14 | pQsFN_LGB14 | | | 115 | 197 |
| LGB15 | pUCsFN_LGB15 | | | 116 | 198 |
| LGB16 | pUCsFN_LGB16 | rice | 6753, 6652, 6735, 6644 | 117 | 199 |
| LGB18_H2 | TopoB_LGB18_H2 | rice | 6769, 6820, 6769, 6820 | 118 | 280 |
| LGB2 | pUCsFN_LGB2 | | | 108 | 189 |
| LGB4 | pUCsFN_LGB4 | rice | 6744, 6791, 6767, 6779 | 109 | 190 |
| LGB5 | pQFNc_LGB5 | | | 110 | 191 |
| LGB8 | pQsFN_LGB8 | sorghum | 6752, 6639, 6752, 6656 | 111 | 193 |
| LGB9 | pMA-RQ_LGB9_GA | sorghum | 6659, 6670, 6659, 6670 | 112 | 194 |
| LGD1 | TopoB_LGD1 | | | 119 | 281 |
| LGD10 | pQFNc_LGD10 | sorghum | 6750, 6637, 6731, 6640 | 126 | 284 |
| LGD11 | pUCsFN_LGD11 | sorghum | 6650, 6674, 6650, 6674 | 127 | 210 |
| LGD12 | pUCsFN_LGD12 | tomato | 6801, 6819, 6801, 6819 | 128 | 211 |
| LGD14 | pUCsFN_LGD14 | wheat | 6732, 6775, 6716, 6784 | 129 | 285 |
| LGD15 | pUCsFN_LGD15 | SORGHUM Sorghum bicolor | 6724, 6787, 6724, 6787 | 130 | 213 |
| LGD16 | pMA-RQ_LGD16_GA | | | 131 | 214 |
| LGD17 | pUCsFN_LGD17 | BARLEY Hordeum vulgare L. | 6794, 6675, 6808, 6676 | 132 | 215 |
| LGD18 | pUCsFN_LGD18 | COTTON Gossypium hirsutum | 6771, 6645, 6757, 6646 | 113 | 216 |
| LGD19 | pMA-T_LGD19_GA | COTTON Gossypium hirsutum | 6812, 6664, 6812, 6669 | 134 | 217 |
| LGD2 | pUCsFN_LGD2 | RICE Oryza sativa L. | 6712, 6815, 6713, 6816 | 120 | 203 |
| LGD20 | pMK-RQ_LGD20_GA | SORGHUM Sorghum bicolor | 6793, 6707, 6793, 6707 | 135 | 218 |
| LGD21 | pUCsFN_LGD21 | SORGHUM Sorghum bicolor | 6738, 6691, 6738, 6692 | 136 | 219 |
| LGD23 | pMA-T_LGD23_GA | RICE Oryza sativa L. | 6706, 6814, 6706, 6814 | 137 | 220 |
| LGD24 | pUCsFN_LGD24 | Maize | 6729, 6703, 6768, 6698 | 138 | 221 |
| LGD26 | pUCsFN_LGD26 | SORGHUM Sorghum bicolor | 6721, 6705, 6741, 6696 | 139 | 223 |
| LGD3 | TopoB_LGD3 | Maize | 6719, 6701, 6733, 6695 | 121 | 204 |
| LGD6 | pUCsFN_LGD6 | SORGHUM Sorghum bicolor | 6723, 6687, 6739, 6690 | 122 | 205 |
| LGD7 | pUCsFN_LGD7 | | | 123 | 282 |
| LGD8 | pQFNc_LGD8 | Maize | 6765, 6693, 6760, 6704 | 124 | 283 |
| LGD9 | pUCsFN_LGD9 | | | 125 | 208 |
| LGM10 | pUCsFN_LGM10 | | | 146 | 230 |
| LGM11 | pUCsFN_LGM11 | Oryza sativa Japonica Group | 6802, 6821, 6802, 6821 | 147 | 231 |
| LGM12 | pUCsFN_LGM12 | sorghum bicolor | | 148 | 232 |
| LGM13 | pQsFN_LGM13 | Zea mays | 6725, 6636, 6725, 6636 | 149 | 233 |
| LGM14 | pUCsFN_LGM14 | Maize | 6772, 6694, 6727, 6702 | 150 | 234 |
| LGM15 | pUCsFN_LGM15 | Maize | 6759, 6786, 6746, 6776 | 151 | 215 |
| LGM16 | pUCsFN_LGM16 | | | 152 | 287 |
| LGM17 | pUCsFN_LGM17 | | | 153 | 237 |
| LGM18_H1 | pMA-RQ_LGM18_H1_GA | rice | 6740, 6777, 6813, 6783 | 158 | 243 |
| LGM19 | pUCsFN_LGM19 | Gossypium barbadense | 6734, 6638, 6726, 6653 | 154 | 288 |
| LGM2 | pMA_LGM2_GA | Oryza sativa Japonica Group | 6803, 6677, 6795, 6680 | 140 | 224 |
| LGM21 | pMA-T_LGM21_GA | | | 155 | 240 |
| LGM22 | pQFNc_LGM22 | sorghum bicolor | 6755, 6785, 6755, 6785 | 156 | 289 |
| LGM23 | pQsFN_LGM23 | sorghum bicolor | 6714, 6634, 6751, 6699 | 157 | 290 |
| LGM4 | pQsFN_LGM4 | sorghum bicolor | 6748, 6632, 6748, 6632 | 141 | 225 |
| LGM5 | pUCsFN_LGM5 | Barley | 6683, 6686, 6683, 6686 | 142 | 226 |
| LGM7 | pUCsFN_LGM7 | Setaria italica | 6745, 6661, 6743, 6647 | 143 | 286 |
| LGM8 | pMK-RQ_LGM8_GA | Setaria italica | 6770, 6697, 6770, 6700 | 144 | 228 |
| LGM9 | pMK-RQ_LGM9_GA | Setaria italica | 6796, 6685, 6804, 6684 | 145 | 229 |
| MGP15 | pQFNc_MGP15 | Zea mays | 6798, 6672, 6798, 6672 | 159 | 244 |
| MGP16 | pQFNc_MGP16 | | | 160 | 245 |
| MGP17 | pQFNc_MGP17 | WHEAT Triticum aestivum L. | 6742, 6818, 6742, 6818 | 161 | 291 |
| MGP18 | pUCsFN_MGP18 | Phaseolus vulgaris | 6720, 6635, 6758, 6629 | 162 | 292 |
| MGP19_H1 | pMA-RQ_MGP19_H1_GA | Phaseolus vulgaris | 6728, 6655, 6728, 6658 | 179 | 267 |
| MGP20 | pUCsFN_MGP20 | Brassica napus | 6708, 6790, 6708, 6790 | 163 | 293 |
| MGP21 | pUCsFN_MGP21 | Medicago truncatula | 6711, 6817, 6711, 6817 | 164 | 250 |

TABLE 180-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| MGP22 | pQsFN_MGP22 | Medicago truncatula | 6749, 6633, 6749, 6633 | 165 | 251 |
| MGP23 | pMA-RQ_MGP23_GA | | | 166 | 252 |
| MGP24 | pMK-RQ_MGP24_GA | Medicago truncatula | 6766, 6660, 6766, 6660 | 167 | 253 |
| MGP25 | pUCsFN_MGP25 | Glycine max | 6710, 6631, 6736, 6643 | 168 | 254 |
| MGP26 | pUCsFN_MGP26 | | | 169 | 255 |
| MGP27 | pMK-RQ_MGP27_GA | TOMATO Lycopersicum esculentum | 6709, 6689, 6722, 6688 | 170 | 256 |
| MGP28 | pUCsFN_MGP28 | | | 171 | 294 |
| MGP30_H3 | pMK-RQ_MGP30_H3_GA | Glycine max | 6764, 6657, 6763, 6649 | 180 | 268 |
| MGP33 | pUCsFN_MGP33 | | | 172 | 259 |
| MGP34 | pQFNc_MGP34 | Solanum lycopersicum | 6737, 6641, 6730, 6654 | 173 | 295 |
| MGP35 | pMA-RQ_MGP35_GA | Solanum lycopersicum | | 174 | 261 |
| MGP38 | pUCsFN_MGP38 | Phaseolus vulgaris | | 175 | 263 |
| MGP39 | pQFNc_MGP39 | Arabidopsis thaliana | 6799, 6678, 6810, 6679 | 176 | 264 |
| MGP40 | pUCsFN_MGP40 | Brasicca Juncea | 6754, 6822, 6754, 6822 | 177 | 296 |
| MGP42 | pQFNc_MGP42 | Phaseolus vulgaris | 6682, 6648, 6681, 6642 | 178 | 297 |
| RIN44 | pQFNc_RIN44 | Phaseolus vulgaris | 6717, 6789, 6717, 6789 | 181 | 269 |

Table 180. Cloned genes. Provided are the gene names, cluster names, organisms from which they were derived, and polynucleotide and polypeptide sequence identifiers of selected genes of some embodiments of the invention.
"GA"—Gene Art (synthetically prepared gene sequence).

Example 21

Transforming *Agrobacterium Tumefaciens* Cells with Binary Vectors Harboring Putative Genes The above described binary vectors were used to transform *Agrobacterium* cells. Two additional binary constructs, having only the At6669 or the 35S promoter, or no additional promoter are used as negative controls.

The binary vectors were introduced to *Agrobacterium tumefaciens* GV301 or LB4404 (for *Arabidopsis*) or AGL1 (for Brachypodium) competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (for *Arabidopsis*; 50 mg/L; for *Agrobacterium* strains GV301) or streptomycin (for *Arabidopsis*; 300 mg/L; for *Agrobacterium* strain LB4404); or with Carbenicillin (for Brachypodium; 50 mg/L) and kanamycin (for *Arabidopsis* and Brachypodium; 50 mg/L) at 28° C. for 48 hours. *Abrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention are properly introduced to the *Agrobacterium* cells.

Example 22

Transformation of *Arabidopsis Thaliana* Plants with the Polynucleotides of the Invention Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar, 50 mM kanamycin; and 200 mM carbenicylin (Duchefa). The culture plates were incubated at 4° C. for 48 hours then transferred to a growth room at 25° C. for an additional week of incubation. Vital $T_1$ Arabidopsis plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 23

Transformation of Brachypodium Distachyon Plants with the Polynucleotides of the Invention Similar to the Arabidopsis model plant, Brachypodium distachyon has several features that recommend it as a model plant for functional genomic studies, especially in the grasses. Traits that make it an ideal model include its small genome (~160 Mbp for a diploid genome and 355 Mbp for a polyploidy genome), small physical stature, a short life-cycle, and few growth requirements. Brachypodium is related to the major cereal grain species but is understood to be more closely related to the Triticeae (wheat, barley) than to the other cereals. Brachypodium, with its polyploidy accessions, can serve as an ideal model for these grains (whose genomics size and complexity is a major barrier to biotechnological improvement).

Brachypodium distachyon embryogenic calli are transformed using the procedure described by Vogel and Hill (2008) [High-efficiency Agrobacterium-mediated transformation of Brachypodium distachyon inbred line Bd21-3. Plant Cell Rep 27:471-478], Vain et al (2008) [Agrobacterium-mediated transformation of the temperate grass Brachypodium distachyon (genotypeBd21) for T-DNA insertional mutagenesis. Plant Biotechnology J 6: 236-245], and Vogel J, et al. (2006) [Agrobacterium mediated transformation and inbred line development in the model grass Brachypodium distachyon. Plant Cell Tiss Org. Cult. 85:199-211], each of which is fully incorporated herein by reference, with some minor modifications, which are briefly summarized hereinbelow.

Callus initiation—Immature spikes (about 2 months after seeding) are harvested at the very beginning of seeds filling. Spikes are then husked and surface sterilized with 3% NaClO containing 0.1% Tween 20, shaken on a gyratory shaker at low speed for 20 minutes. Following three rinses with sterile distilled water, embryos are excised under a dissecting microscope in a laminar flow hood using fine forceps.

Excised embryos (size ~0.3 mm, bell shaped) are placed on callus induction medium (CIM) [LS salts (Linsmaier, E. M. & Skoog, F. 1965. Physiol. Plantarum 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] scutellar side down, 100 embryos on a plate, and incubated at 28° C. in the dark. One week later, the embryonic calli is cleaned from emerging roots, shoots and somatic calli, and is subcultured onto fresh CIM medium. During culture, yellowish embryogenic callus (EC) appeared and are further selected (e.g., picked and transferred) for further incubation in the same conditions for additional 2 weeks. Twenty-five pieces of sub-cultured calli are then separately placed on 90×15 mm petri plates, and incubated as before for three additional weeks.

Transformation—As described in Vogel and Hill (2008, Supra), Agrobacterium is scraped off 2-day-old MGL plates (plates with the MGL medium which contains: Tryptone 5 g/l, Yeast Extract 2.5 g/l, NaCl 5 g/l, D-Mannitol 5 g/l, $MgSO_4*7H_2O$ 0.204 g/l, $K_2HPO_4$ 0.25 g/l, Glutamic Acid 1.2 g/l, Plant Agar 7.5 g/l) and resuspended in liquid MS medium supplemented with 200 µM acetosyringone to an optic density (OD) at 600 nm ($OD_{600}$) of 0.6. Once the desired OD is attained, 1 ml of 10% Synperonic PE/F68 (Sigma) per 100 ml of inoculation medium is added.

To begin inoculation, 300 callus pieces are placed in approximately 12 plates (25 callus pieces in each plate) and covered with the Agrobacterium suspension (8-8.5 ml). The callus is incubated in the Agrobacterium suspension for 15 minutes with occasional gentle rocking. After incubation, the Agrobacterium suspension is aspirated off and the calli are then transferred into co-cultivation plates, prepared by placing a sterile 7-cm diameter filter paper in an empty 90×15 mm petri plate. The calli pieces are then gently distributed on the filter paper. One co-cultivation plate is used for two starting callus plates (50 initial calli pieces). The co-cultivation plates are then sealed with parafilm and incubated at 22° C. in the dark for 3 days.

The callus pieces are then individually transferred onto CIM medium as described above, which is further supplemented with 200 mg/l Ticarcillin (to kill the Agrobacterium) and Bialaphos (5 mg/L) (for selection of the transformed resistant embryogenic calli sections), and incubated at 28° C. in the dark for 14 days.

The calli pieces are then transferred to shoot induction media (SIM; LS salts and vitamins plus 3% Maltose monohydrate) supplemented with 200 mg/l Ticarcillin, Bialaphos (5 mg/L), Indol-3-acetic acid (IAA) (0.25 mg/L), and 6-Benzylaminopurine (BAP) (1 mg/L), and are sub-cultured in light to the same media after 10 days (total of 20 days). At each sub-culture all the pieces from a single callus are kept together to maintain their independence and are incubated under the following conditions: lighting to a level of 60 1E m-2 s-1, a 16-h light, 8-h dark photoperiod and a constant 24° C. temperature. Plantlets emerge from the transformed calli.

When plantlets are large enough to handle without damage, they are transferred to plates containing the above mentioned shoot induction media (SIM) without Bialaphos. Each plantlet is considered as a different event. The plantlets grow axillary tillers and eventually become bushy. Each bush from the same plant (event ID) is then divided to tissue culture boxes ("Humus") containing "rooting medium" [MS basal salts, 3% sucrose, 3 g/L phytagel, 2 mg/L α-Naphthalene Acetic Acid (NAA) and 1 mg/L IAA and Ticarcillin 200 mg/L, PH 5.8). All plants in a "Humus box" are different plants of the same transformation event.

When plantlets establish roots they are transplanted to soil and transferred to a greenhouse. To verify the transgenic status of plants containing the other constructs, T0 plants are subjected to PCR as previously described by Vogel et al. 2006 [Agrobacterium mediated transformation and inbred line development in the model grass Brachypodium distachyon. Plant Cell Tiss Org. Cult. 85:199-211].

Example 24

Evaluation of Transgenic Arabidopsis Abst, Yield and Plant Growth Rate Under Abiotic Stress as Well as Under Standard Growth Conditions in Greenhouse Assay (GH-SM Assays)

Assay 1: Seed Yield, Plant Biomass and Plant Growth Rate in Greenhouse Conditions (Seed Maturation Assay).

Under Normal conditions—This assay follows seed yield production, the biomass formation and the rosette area growth of plants grown in the greenhouse at non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:2 ratio. The plant were grown under normal growth conditions which included irrigation of the trays with a solution containing 6 mM inorganic nitrogen in the form of $KNO_3$ with 1 mM $KH_2PO_4$, 1 mM $MgSO_4$, 1.5 mM $CaCl_2$ and microelements. Under normal conditions the plants grow in a controlled environment in a closed transgenic greenhouse, temperature about 18-22° C., humidity around 70%. Irrigation was done by flooding with a water solution containing 6 mM N (nitrogen) (as described hereinabove), and flooding was repeated whenever water loss reached 50%. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Under drought conditions and standard growth conditions—This assay follows seed yield production, the biomass formation and the rosette area growth of plants grown in the greenhouse under drought conditions and under standard growth conditions. Transgenic *Arabidopsis* seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress. All plants were grown in the greenhouse until seeds maturation. Seeds were harvested, extracted and weighted. The remaining plant biomass (the above ground tissue) was also harvested, and weighted immediately or following drying in oven at 50° C. for 24 hours.

Each construct was validated at its $T_2$ generation (under the control of the At6669 promoter, SEQ ID NO: 6614). Transgenic plants transformed with a construct conformed by an empty vector carrying the At6669 (SEQ ID NO: 6614) promoter and the selectable marker were used as control.

The plants were analyzed for their overall size, growth rate, flowering, seed yield, 1,000-seed weight, dry matter and harvest index (HI—seed yield/dry matter). Transgenic plants performance was compared to control plants grown in parallel under the same conditions. Mock-transgenic plants with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which is developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area, Petiole Relative Area and leaf petiole length.

Vegetative growth rate: the relative growth rate (RGR) of leaf number [formula VIII (described above)], rosette area (Formula IX, above), plot coverage (Formula XI, above) and harvest index (Formula XV) was calculated with the indicated formulas.

Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber, Seed yield per plant=total seed weight per plant (gr.). 1000 seed weight (the weight of 1000 seeds) (gr.).

The measured parameter "flowering" refers to number of days in which 50% of the plants are flowering (50% or above).

The measured parameter "Inflorescence Emergence" refers to number of days in which 50% of the plants are bolting (50% or above).

The measured parameter "plot coverage" refers to Rosette Area*plant number.

It should be noted that a negative increment (in percentages) when found in flowering or inflorescence emergence indicates drought avoidance of the plant.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results

Tables 181-185 summarize the observed phenotypes of transgenic plants exogenously expressing the gene constructs using the seed maturation (GH-SM) assays under normal conditions. The genes listed in these Tables show increased biomass (e.g., increased dry weight, rosette area, rosette diameter), photosynthetic area (e.g., increased leaf blade area, leaf number, plot coverage), increased yield (e.g., increased harvest index, seed yield, 1000 seed weight) and increased growth rate (e.g., increased growth rate of leaf number, plot coverage, rosette diameter) as well as negative increments in "flowering" and "inflorescence emergence" (indicating drought avoidance) under non-stress conditions (e.g., normal or standard growth conditions). The evaluation of each gene was performed by testing the performance of different number of events. Event with p-value <0.1 was considered statistically significant.

TABLE 181

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGD2 | 91167.2 | 1230.0 | 0.02 | 12 | 43.4 | 0.26 | −3 | 35.4 | 0.05 | −4 |
| LGD2 | 91169.2 | 1201.0 | 0.12 | 10 | 44.3 | 0.16 | −1 | — | — | — |
| CONT. | — | 1096.6 | — | — | 44.6 | — | — | 36.8 | — | — |
| LGM7 | 91255.4 | 1110.4 | 0.26 | 4 | — | — | — | 18.5 | 0.26 | −7 |
| LGM7 | 91258.1 | — | — | — | — | — | — | 19.0 | 0.14 | −4 |
| LGM7 | 91258.2 | — | — | — | — | — | — | 19.3 | 0.23 | −3 |
| LGM7 | 91258.4 | 1121.2 | 0.28 | 5 | — | — | — | — | — | — |
| CONT. | — | 1070.8 | — | — | — | — | — | 19.9 | — | — |
| LGD1 | 92045.4 | — | — | — | 18.0 | 0.23 | −1 | — | — | — |
| LGD1 | 92048.4 | — | — | — | 18.0 | 0.23 | −1 | — | — | — |
| CONT. | — | — | — | — | 18.0 | — | — | — | — | — |
| LGD20 | 93505.1 | — | — | — | 18.7 | 0.14 | −2 | 13.4 | 0.02 | −5 |
| LGD20 | 93507.2 | — | — | — | — | — | — | 13.9 | 0.23 | −2 |
| CONT. | — | — | — | — | 19.1 | — | — | 14.1 | — | — |
| LGM15 | 92364.4 | 1240.0 | 0.15 | 6 | — | — | — | — | — | — |
| LGM15 | 92367.1 | 1265.0 | 0.09 | 8 | — | — | — | — | — | — |
| CONT. | — | 1167.5 | — | — | — | — | — | — | — | — |
| LGM5 | 90808.3 | 1458.3 | 0.03 | 16 | — | — | — | — | — | — |
| LGM5 | 90811.1 | 1511.1 | 0.10 | 20 | 16.7 | 0.13 | −7 | 11.6 | 0.25 | −7 |
| CONT. | — | 1262.5 | — | — | 18.0 | — | — | 12.5 | — | — |
| LGM5 | 90811.1 | 1250.8 | 0.30 | 9 | 45.6 | 0.15 | −1 | 37.0 | 0.02 | −4 |
| CONT. | — | 1146.7 | — | — | 46.2 | — | — | 38.5 | — | — |
| LGM11 | 92054.1 | — | — | — | — | — | — | 17.9 | 0.27 | −1 |
| LGM11 | 92055.1 | — | — | — | 23.3 | 0.08 | −5 | — | — | — |
| LGM11 | 92055.4 | — | — | — | 23.5 | 0.04 | −5 | 17.8 | 0.14 | −1 |
| CONT. | — | — | — | — | 24.6 | — | — | 18.1 | — | — |
| LGD26 | 94245.3 | — | — | — | 17.3 | 0.05 | −8 | 12.2 | 0.16 | −3 |
| LGD26 | 94245.4 | — | — | — | 17.4 | 0.06 | −8 | 12.0 | 0.12 | −4 |
| LGD26 | 94245.5 | — | — | — | 17.5 | 0.08 | −7 | — | — | — |
| CONT. | — | — | — | — | 18.8 | — | — | 12.5 | — | — |
| LGD2 | 91166.1 | 1211.4 | 0.13 | 11 | — | — | — | — | — | — |
| LGD2 | 91167.2 | — | — | — | 41.2 | L | −8 | 34.5 | 0.08 | −5 |
| CONT. | — | 1086.7 | — | — | 44.6 | — | — | 36.5 | — | — |
| LGM15 | 92367.1 | 1113.8 | 0.29 | 14 | — | — | — | — | — | — |
| LGM15 | 92368.1 | 1117.1 | 0.28 | 15 | — | — | — | — | — | — |
| CONT. | — | 973.1 | — | — | — | — | — | — | — | — |
| LGM7 | 91257.4 | 1312.5 | 0.17 | 5 | — | — | — | — | — | — |
| LGM7 | 91258.2 | 1316.2 | 0.08 | 5 | — | — | — | — | — | — |
| CONT. | — | 1249.6 | — | — | — | — | — | — | — | — |
| LGD1 | 92045.3 | — | — | — | 21.4 | 0.15 | −5 | — | — | — |
| LGD1 | 92045.4 | 1209.2 | 0.25 | 4 | — | — | — | — | — | — |
| LGD1 | 92045.5 | — | — | — | 21.4 | 0.13 | −5 | — | — | — |
| LGD1 | 92048.3 | 1227.1 | 0.11 | 6 | 20.4 | 0.03 | −10 | 14.5 | 0.08 | −5 |
| LGD1 | 92048.4 | — | — | — | 21.5 | 0.19 | −5 | — | — | — |
| CONT. | — | 1158.1 | — | — | 22.6 | — | — | 15.4 | — | — |
| LGM17 | 92375.1 | — | — | — | 25.1 | 0.23 | −1 | — | — | — |
| LGM17 | 92378.5 | 1287.9 | 0.08 | 13 | — | — | — | — | — | — |
| CONT. | — | 1138.5 | — | — | 25.3 | — | — | — | — | — |
| LGM19 | 92379.2 | — | — | — | — | — | — | 19.8 | 0.28 | −1 |
| LGM19 | 92383.1 | — | — | — | 26.4 | 0.26 | −2 | 19.7 | 0.16 | −2 |
| CONT. | — | — | — | — | 27.1 | — | — | 20.1 | — | — |
| LGD3 | 91582.3 | — | — | — | 23.7 | 0.05 | −5 | 17.7 | 0.07 | −7 |
| LGD3 | 91583.4 | 1222.1 | 0.21 | 7 | 24.2 | 0.17 | −3 | 17.5 | 0.05 | −8 |
| LGD3 | 91584.2 | — | — | — | 24.7 | 0.23 | −1 | — | — | — |
| CONT. | — | 1142.5 | — | — | 25.0 | — | — | 19.0 | — | — |
| LGD3 | 91582.3 | — | — | — | 18.7 | 0.13 | −4 | — | — | — |
| LGD3 | 91583.4 | — | — | — | 18.5 | 0.18 | −6 | 13.3 | 0.29 | −2 |
| CONT. | — | — | — | — | 19.6 | — | — | 13.6 | — | — |
| LGM12 | 90801.1 | 1067.1 | 0.29 | 13 | — | — | — | — | — | — |
| CONT. | — | 945.4 | — | — | — | — | — | — | — | — |
| LGD20 | 93505.3 | 1352.9 | L | 14 | — | — | — | — | — | — |
| CONT. | — | 1190.8 | — | — | — | — | — | — | — | — |
| LGM17 | 92375.2 | — | — | — | — | — | — | 12.8 | 0.11 | −6 |
| CONT. | — | — | — | — | — | — | — | 13.7 | — | — |
| LGD23 | 93295.1 | 1243.3 | 0.13 | 6 | — | — | — | — | — | — |

TABLE 181-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGD23 | 93295.3 | — | — | — | 18.9 | 0.06 | −1 | — | — | — |
| LGD23 | 93298.4 | 1443.8 | 0.03 | 23 | — | — | — | — | — | — |
| LGD23 | 93298.5 | 1261.2 | 0.22 | 8 | — | — | — | — | — | — |
| CONT. | — | 1169.7 | — | — | 19.1 | — | — | — | — | — |
| LGM11 | 92055.1 | 1409.6 | 0.07 | 7 | — | — | — | — | — | — |
| CONT. | — | 1314.2 | — | — | — | — | — | — | — | — |

"CONT." = Control; "Ave." = Average; "% Incr." = % increment; "p-val." = p-value, L = p < 0.01.

TABLE 182

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LGD2 | 91166.1 | 1.28 | 0.15 | 20 | — | — | — | — | — | — |
| LGD2 | 91167.2 | 1.34 | L | 25 | 12.2 | 0.14 | 6 | 81.9 | 0.02 | 26 |
| LGD2 | 91169.1 | 1.19 | L | 12 | — | — | — | 72.9 | 0.06 | 12 |
| LGD2 | 91169.2 | 1.24 | L | 16 | — | — | — | 75.1 | 0.02 | 16 |
| CONT. | — | 1.07 | — | — | 11.5 | — | — | 64.8 | — | — |
| LGD1 | 92045.4 | 1.83 | 0.03 | 12 | — | — | — | 109.4 | 0.05 | 13 |
| LGD1 | 92048.4 | 1.91 | L | 17 | — | — | — | 108.9 | 0.03 | 13 |
| CONT. | — | 1.63 | — | — | — | — | — | 96.5 | — | — |
| LGD20 | 93505.1 | 1.71 | 0.14 | 15 | — | — | — | 95.9 | 0.14 | 17 |
| CONT. | — | 1.49 | — | — | — | — | — | 81.8 | — | — |
| LGM15 | 92367.1 | 1.63 | 0.22 | 4 | 10.8 | 0.09 | 5 | 92.6 | 0.07 | 13 |
| CONT. | — | 1.56 | — | — | 10.3 | — | — | 82.2 | — | — |
| LGB11 | 93849.4 | 0.786 | 0.03 | 9 | 9.50 | 0.19 | 5 | 41.7 | 0.03 | 15 |
| LGB11 | 93850.3 | — | — | — | 9.38 | 0.19 | 3 | 40.9 | 0.18 | 13 |
| CONT. | — | 0.724 | — | — | 9.08 | — | — | 36.1 | — | — |
| LGA17 | 94214.1 | — | — | — | 9.59 | 0.28 | 7 | — | — | — |
| CONT. | — | — | — | — | 9.00 | — | — | — | — | — |
| LGM5 | 90808.2 | 1.43 | 0.05 | 14 | — | — | — | — | — | — |
| LGM5 | 90810.1 | — | — | — | 11.1 | 0.18 | 6 | — | — | — |
| LGM5 | 90811.1 | 1.49 | 0.12 | 19 | 10.8 | 0.25 | 3 | 93.5 | 0.13 | 22 |
| CONT. | — | 1.26 | — | — | 10.4 | — | — | 76.7 | — | — |
| LGM5 | 90808.2 | — | — | — | 11.0 | 0.10 | 8 | 51.1 | 0.29 | 8 |
| LGM5 | 90810.2 | 0.945 | 0.09 | 17 | — | — | — | 54.1 | 0.12 | 15 |
| LGM5 | 90811.1 | 0.979 | 0.03 | 21 | 11.1 | 0.06 | 9 | 61.5 | 0.02 | 30 |
| CONT. | — | 0.808 | — | — | 10.2 | — | — | 47.2 | — | — |
| MGP20 | 94576.1 | — | — | — | 9.62 | L | 6 | — | — | — |
| MGP20 | 94579.4 | — | — | — | 9.46 | 0.02 | 4 | — | — | — |
| MGP20 | 94579.5 | 1.11 | 0.26 | 7 | 9.48 | 0.06 | 4 | — | — | — |
| CONT. | — | 1.04 | — | — | 9.09 | — | — | — | — | — |
| LGD23 | 93295.1 | — | — | — | 9.62 | 0.10 | 4 | — | — | — |
| LGD23 | 93295.3 | 1.19 | 0.30 | 6 | 10.1 | 0.03 | 9 | 68.7 | 0.09 | 16 |
| LGD23 | 93298.4 | 1.24 | 0.14 | 11 | 9.67 | 0.22 | 5 | 66.7 | 0.13 | 13 |
| LGD23 | 93298.5 | — | — | — | 9.75 | 0.06 | 5 | — | — | — |
| LGD23 | 93298.6 | — | — | — | 9.88 | 0.08 | 7 | — | — | — |
| CONT. | — | 1.12 | — | — | 9.25 | — | — | 59.1 | — | — |
| LGB1 | 95790.2 | 0.764 | 0.07 | 19 | — | — | — | 41.0 | L | 19 |
| LGB1 | 95792.2 | 0.796 | L | 24 | — | — | — | 40.1 | L | 17 |
| CONT. | — | 0.640 | — | — | — | — | — | 34.4 | — | — |
| LGM11 | 92055.1 | 1.48 | 0.06 | 13 | — | — | — | 91.2 | 0.11 | 19 |
| LGM11 | 92055.4 | 1.45 | 0.20 | 11 | — | — | — | 84.2 | 0.23 | 10 |
| CONT. | — | 1.30 | — | — | — | — | — | 76.8 | — | — |
| MGP20 | 94574.1 | 1.14 | 0.12 | 11 | 10.4 | 0.08 | 8 | 68.4 | 0.22 | 18 |
| CONT. | — | 1.03 | — | — | 9.63 | — | — | 57.8 | — | — |
| LGM12 | 90797.2 | — | — | — | 12.8 | 0.13 | 5 | — | — | — |
| LGM12 | 90799.1 | — | — | — | 13.3 | 0.09 | 9 | — | — | — |
| LGM12 | 90799.2 | — | — | — | 12.9 | 0.20 | 6 | 78.6 | 0.29 | 7 |
| LGM12 | 90801.2 | — | — | — | 12.5 | 0.23 | 3 | — | — | — |
| CONT. | — | — | — | — | 12.2 | — | — | 73.5 | — | — |
| LGA9 | 94220.3 | — | — | — | 9.58 | 0.23 | 3 | — | — | — |

TABLE 182-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LGA9 | 94223.2 | — | — | — | 10.2 | 0.19 | 9 | — | — | — |
| CONT. | — | — | — | — | 9.34 | — | — | — | — | — |
| LGD26 | 94245.4 | 1.58 | 0.09 | 13 | — | — | — | 95.8 | 0.08 | 20 |
| CONT. | — | 1.40 | — | — | — | — | — | 79.7 | — | — |
| LGD2 | 91169.1 | 1.18 | 0.11 | 7 | — | — | — | — | — | — |
| CONT. | — | 1.10 | — | — | — | — | — | — | — | — |
| LGM15 | 92367.1 | 1.05 | 0.18 | 13 | — | — | — | 59.6 | 0.19 | 15 |
| CONT. | — | 0.928 | — | — | — | — | — | 51.8 | — | — |
| LGM7 | 91255.4 | — | — | — | 11.1 | 0.22 | 7 | 102.8 | 0.02 | 17 |
| LGM7 | 91257.3 | — | — | — | 10.9 | 0.27 | 5 | — | — | — |
| LGM7 | 91257.4 | — | — | — | 11.1 | 0.16 | 7 | 101.9 | 0.04 | 16 |
| CONT. | — | — | — | — | 10.4 | — | — | 88.2 | — | — |
| LGD1 | 92048.3 | 1.55 | 0.07 | 9 | — | — | — | 90.0 | 0.07 | 12 |
| CONT. | — | 1.43 | — | — | — | — | — | 80.5 | — | — |
| LGA17 | 94216.2 | 1.82 | 0.11 | 9 | — | — | — | 98.6 | 0.26 | 7 |
| CONT. | — | 1.67 | — | — | — | — | — | 92.5 | — | — |
| LGB4 | 96492.2 | 0.587 | 0.22 | 6 | — | — | — | 31.2 | 0.08 | 10 |
| LGB4 | 96492.3 | — | — | — | — | — | — | 32.4 | 0.25 | 15 |
| CONT. | — | 0.553 | — | — | — | — | — | 28.3 | — | — |
| LGM19 | 92379.1 | 0.807 | 0.29 | 7 | — | — | — | — | — | — |
| LGM19 | 92379.2 | — | — | — | 9.23 | 0.28 | 2 | — | — | — |
| LGM19 | 92382.2 | — | — | — | 9.54 | 0.26 | 5 | — | — | — |
| LGM19 | 92382.5 | — | — | — | — | — | — | 39.7 | 0.22 | 6 |
| LGM19 | 92383.1 | 0.858 | 0.23 | 14 | 9.71 | 0.11 | 7 | 48.3 | 0.08 | 29 |
| CONT. | — | 0.751 | — | — | 9.09 | — | — | 37.3 | — | — |
| LGD3 | 91582.3 | 1.46 | 0.02 | 20 | 11.8 | 0.02 | 12 | 89.9 | L | 31 |
| LGD3 | 91583.4 | 1.43 | 0.15 | 17 | — | — | — | 81.3 | 0.28 | 18 |
| CONT. | — | 1.22 | — | — | 10.5 | — | — | 68.8 | — | — |
| LGD3 | 91582.3 | 1.69 | 0.28 | 12 | 10.3 | 0.07 | 5 | 93.4 | 0.13 | 20 |
| LGD3 | 91583.4 | 1.65 | 0.04 | 10 | 10.9 | 0.10 | 10 | 91.4 | 0.02 | 18 |
| LGD3 | 91584.2 | — | — | — | — | — | — | 84.1 | 0.29 | 8 |
| CONT. | — | 1.50 | — | — | 9.88 | — | — | 77.7 | — | — |
| LGM12 | 90801.1 | — | — | — | 12.3 | 0.26 | 4 | 70.9 | 0.25 | 10 |
| CONT. | — | — | — | — | 11.8 | — | — | 64.5 | — | — |
| LGD20 | 93505.1 | 1.39 | 0.16 | 9 | 10.5 | 0.17 | 6 | 79.0 | 0.08 | 13 |
| CONT. | — | 1.27 | — | — | 9.92 | — | — | 69.8 | — | — |
| MGP40 | 96913.4 | — | — | — | 10.2 | 0.03 | 6 | — | — | — |
| MGP18 | 96854.3 | 1.33 | 0.27 | 4 | 10.2 | 0.08 | 6 | 70.6 | 0.07 | 7 |
| CONT. | — | 1.27 | — | — | 9.59 | — | — | 65.7 | — | — |
| MGP40 | 96913.4 | 0.674 | 0.05 | 6 | — | — | — | — | — | — |
| MGP18 | 96854.1 | 0.678 | 0.12 | 7 | — | — | — | — | — | — |
| MGP18 | 96854.3 | 0.681 | 0.11 | 7 | 9.54 | 0.16 | 3 | 38.9 | 0.03 | 11 |
| CONT. | — | 0.634 | — | — | 9.23 | — | — | 35.1 | — | — |
| MGP21 | 94572.1 | — | — | — | 11.0 | 0.22 | 5 | 84.0 | 0.20 | 7 |
| CONT. | — | — | — | — | 10.5 | — | — | 78.2 | — | — |
| MGP21 | 94572.1 | 1.51 | 0.04 | 12 | 10.1 | 0.23 | 3 | 81.3 | 0.04 | 10 |
| CONT. | — | 1.35 | — | — | 9.78 | — | — | 74.0 | — | — |
| LGM17 | 92378.5 | 1.66 | 0.02 | 8 | 11.2 | 0.07 | 8 | 97.4 | 0.04 | 15 |
| CONT. | — | 1.55 | — | — | 10.4 | — | — | 84.9 | — | — |
| LGD23 | 93295.3 | 1.54 | 0.28 | 11 | 11.2 | 0.14 | 6 | 87.9 | 0.10 | 14 |
| LGD23 | 93298.4 | — | — | — | — | — | — | 86.4 | 0.22 | 12 |
| CONT. | — | 1.39 | — | — | 10.5 | — | — | 76.8 | — | — |
| LGA9 | 94220.3 | 1.51 | 0.21 | 10 | — | — | — | 81.0 | 0.27 | 11 |
| LGA9 | 94223.2 | 1.58 | 0.07 | 15 | — | — | — | 87.7 | 0.08 | 20 |
| CONT. | — | 1.37 | — | — | — | — | — | 73.1 | — | — |
| LGB1 | 95790.2 | — | — | — | — | — | — | 70.3 | 0.15 | 7 |
| CONT. | — | — | — | — | — | — | — | 65.7 | — | — |
| LGB11 | 93849.4 | 1.46 | 0.08 | 21 | 10.3 | 0.01 | 10 | 78.8 | 0.14 | 22 |
| CONT. | — | 1.21 | — | — | 9.33 | — | — | 64.5 | — | — |

"CONT." = Control; "Ave." = Average; "% Incr." = % increment; "p-val." = p-value, L = p < 0.01.

TABLE 183

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Vol. | % Incr. |
| LGD2 | 91166.1 | — | — | — | — | — | — | 0.412 | 0.28 | 13 |
| LGD2 | 91167.2 | — | — | — | 9.41 | 0.03 | 26 | 0.419 | 0.01 | 15 |
| LGD2 | 91169.1 | — | — | — | 8.44 | 0.07 | 13 | 0.382 | 0.06 | 5 |
| LGD2 | 91169.2 | — | — | — | 8.65 | 0.02 | 16 | 0.394 | 0.02 | 8 |
| CONT. | — | — | — | — | 7.47 | — | — | 0.365 | — | — |
| LGM7 | 91255.4 | — | — | — | — | — | — | 0.361 | 0.26 | 10 |
| LGM7 | 91258.2 | — | — | — | — | — | — | 0.353 | 0.19 | 7 |
| LGM7 | 91258.4 | — | — | — | — | — | — | 0.363 | 0.10 | 11 |
| CONT. | — | — | — | — | — | — | — | 0.328 | — | — |
| LGD1 | 92045.3 | — | — | — | — | — | — | 0.613 | 0.23 | 7 |
| LGD1 | 92045.4 | — | — | — | 14.4 | 0.06 | 13 | 0.618 | 0.20 | 8 |
| LGD1 | 92048.4 | — | — | — | 14.4 | 0.02 | 13 | 0.630 | 0.05 | 10 |
| CONT. | — | — | — | — | 12.8 | — | — | 0.574 | — | — |
| LGD20 | 93505.1 | — | — | — | 12.7 | 0.14 | 17 | — | — | — |
| CONT. | — | — | — | — | 10.9 | — | — | — | — | — |
| LGM15 | 92367.1 | 0.862 | 0.15 | 7 | 13.9 | 0.06 | 14 | 0.578 | 0.05 | 7 |
| CONT. | — | 0.804 | — | — | 12.2 | — | — | 0.541 | — | — |
| LGB11 | 93849.4 | 0.996 | 0.26 | 17 | 8.16 | 0.07 | 15 | — | — | — |
| LGB11 | 93850.3 | — | — | — | 7.99 | 0.26 | 13 | — | — | — |
| CONT. | — | 0.852 | — | — | 7.09 | — | — | — | — | — |
| LGA17 | 94214.1 | 0.605 | 0.26 | 38 | — | — | — | — | — | — |
| LGA17 | 94216.2 | 0.631 | 0.17 | 44 | — | — | — | — | — | — |
| CONT. | — | 0.438 | — | — | — | — | — | — | — | — |
| LGM5 | 90808.2 | — | — | — | — | — | — | 0.537 | 0.12 | 9 |
| LGM5 | 90810.1 | — | — | — | — | — | — | 0.520 | 0.26 | 6 |
| LGM5 | 90811.1 | — | — | — | 13.7 | 0.14 | 22 | 0.580 | 0.03 | 18 |
| CONT. | — | — | — | — | 11.3 | — | — | 0.492 | — | — |
| LGM5 | 90808.2 | — | — | — | 6.01 | 0.25 | 9 | 0.308 | 0.20 | 7 |
| LGM5 | 90810.2 | — | — | — | 6.26 | 0.13 | 14 | 0.312 | 0.18 | 8 |
| LGM5 | 90811.1 | — | — | — | 7.13 | 0.02 | 30 | 0.329 | 0.12 | 14 |
| CONT. | — | — | — | — | 5.50 | — | — | 0.288 | — | — |
| MGP20 | 94576.1 | 0.723 | 0.26 | 25 | — | — | — | — | — | — |
| MGP20 | 94579.4 | 0.726 | 0.28 | 25 | — | — | — | — | — | — |
| CONT. | — | 0.580 | — | — | — | — | — | — | — | — |
| LGD23 | 93295.1 | 0.583 | 0.25 | 8 | — | — | — | — | — | — |
| LGD23 | 93295.3 | 0.644 | 0.20 | 19 | 9.05 | 0.11 | 16 | — | — | — |
| LGD23 | 93298.4 | — | — | — | 8.80 | 0.11 | 13 | 0.509 | 0.24 | 7 |
| LGD23 | 93298.5 | 0.653 | 0.02 | 21 | — | — | — | — | — | — |
| LGD23 | 93298.6 | 0.647 | 0.05 | 20 | — | — | — | — | — | — |
| CONT. | — | 0.540 | — | — | 7.78 | — | — | 0.475 | — | — |
| LGB1 | 95790.2 | — | — | — | 8.13 | 0.05 | 18 | — | — | — |
| LGB1 | 95792.2 | — | — | — | 8.03 | 0.05 | 17 | 0.545 | 0.20 | 10 |
| LGB1 | 95792.3 | 1.03 | 0.24 | 8 | — | — | — | — | — | — |
| CONT. | — | 0.956 | — | — | 6.87 | — | — | 0.496 | — | — |
| LGM11 | 92055.1 | — | — | — | 11.3 | 0.12 | 19 | — | — | — |
| LGM11 | 92055.4 | 0.682 | 0.13 | 6 | 10.6 | 0.18 | 12 | 0.463 | 0.16 | 11 |
| CONT. | — | 0.646 | — | — | 9.46 | — | — | 0.416 | — | — |
| MGP20 | 94574.1 | 0.812 | 0.02 | 26 | 11.5 | 0.23 | 21 | 0.554 | 0.25 | 7 |
| MGP20 | 94576.1 | 0.765 | 0.10 | 19 | — | — | — | — | — | — |
| MGP20 | 94579.4 | 0.759 | 0.08 | 18 | — | — | — | — | — | — |
| MGP20 | 94579.5 | 0.777 | 0.20 | 20 | — | — | — | — | — | — |
| CONT. | — | 0.645 | — | — | 9.50 | — | — | 0.517 | — | — |
| LGM12 | 90797.2 | 0.748 | 0.14 | 13 | — | — | — | — | — | — |
| LGM12 | 90799.1 | 0.796 | 0.11 | 21 | — | — | — | — | — | — |
| LGM12 | 90799.2 | — | — | — | 9.00 | 0.28 | 7 | — | — | — |
| CONT. | — | 0.660 | — | — | 8.38 | — | — | — | — | — |
| LGD26 | 94245.4 | — | — | — | 13.8 | 0.10 | 19 | — | — | — |
| CONT. | — | — | — | — | 11.6 | — | — | — | — | — |
| LGD2 | 91169.1 | 0.871 | 0.13 | 24 | — | — | — | — | — | — |
| CONT. | — | 0.704 | — | — | — | — | — | — | — | — |
| LGM15 | 92367.1 | — | — | — | 7.33 | 0.15 | 17 | — | — | — |
| CONT. | — | — | — | — | 6.25 | — | — | — | — | — |
| LGB4 | 96492.1 | — | — | — | — | — | — | 0.458 | 0.24 | 8 |
| LGB4 | 96492.2 | — | — | — | — | — | — | 0.456 | 0.26 | 8 |
| LGB4 | 96492.3 | — | — | — | — | — | — | 0.471 | 0.15 | 11 |
| LGB4 | 96493.3 | — | — | — | — | — | — | 0.467 | 0.18 | 10 |
| LGB4 | 96493.4 | — | — | — | — | — | — | 0.481 | 0.29 | 14 |
| CONT. | — | — | — | — | — | — | — | 0.423 | — | — |
| LGD1 | 92048.3 | — | — | — | 12.0 | 0.07 | 12 | — | — | — |
| CONT. | — | — | — | — | 10.8 | — | — | — | — | — |
| LGA17 | 94214.1 | — | — | — | — | — | — | 0.690 | 0.17 | 7 |

TABLE 183-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Vol. | % Incr. |
| LGA17 | 94216.1 | — | — | — | — | — | — | 0.678 | 0.28 | 5 |
| LGA17 | 94216.2 | — | — | — | — | — | — | 0.713 | 0.24 | 10 |
| CONT. | — | — | — | — | — | — | — | 0.647 | — | — |
| LGB4 | 96492.1 | 1.03 | 0.24 | 14 | — | — | — | — | — | — |
| LGB4 | 96492.2 | — | — | — | 6.10 | 0.16 | 13 | 0.442 | 0.09 | 9 |
| LGB4 | 96492.3 | — | — | — | 6.31 | 0.13 | 17 | 0.435 | 0.24 | 8 |
| CONT. | — | — | — | — | 5.41 | — | — | 0.404 | — | — |
| LGM19 | 92379.2 | 0.571 | 0.20 | 20 | — | — | — | — | — | — |
| LGM19 | 92382.2 | 0.562 | 0.24 | 18 | — | — | — | — | — | — |
| LGM19 | 92382.5 | 0.580 | 0.18 | 21 | 4.91 | 0.13 | 10 | — | — | — |
| LGM19 | 92383.1 | 0.558 | 0.26 | 17 | 5.96 | 0.09 | 33 | — | — | — |
| CONT. | — | 0.478 | — | — | 4.47 | — | — | — | — | — |
| LGD3 | 91582.3 | — | — | — | — | — | — | 0.449 | L | 14 |
| CONT. | — | — | — | — | — | — | — | 0.393 | — | — |
| LGD3 | 91582.3 | — | — | — | 13.8 | 0.12 | 21 | 0.581 | 0.05 | 8 |
| LGD3 | 91583.4 | — | — | — | 13.5 | 0.02 | 18 | 0.579 | 0.22 | 8 |
| LGD3 | 91584.2 | — | — | — | 12.5 | 0.23 | 9 | — | — | — |
| CONT. | — | — | — | — | 11.4 | — | — | 0.537 | — | — |
| LGM12 | 90801.1 | — | — | — | 8.16 | 0.19 | 11 | — | — | — |
| CONT. | — | — | — | — | 7.36 | — | — | — | — | — |
| LGD20 | 93505.1 | — | — | — | 10.4 | 0.09 | 13 | 0.546 | 0.10 | 8 |
| LGD20 | 93505.3 | — | — | — | — | — | — | 0.530 | 0.24 | 4 |
| CONT. | — | — | — | — | 9.23 | — | — | 0.508 | — | — |
| MGP40 | 96912.3 | 0.702 | 0.12 | 13 | — | — | — | — | — | — |
| MGP40 | 96913.4 | 0.792 | 0.22 | 27 | — | — | — | — | — | — |
| MGP18 | 96854.1 | 0.732 | 0.12 | 18 | — | — | — | — | — | — |
| MGP18 | 96854.3 | 0.732 | 0.12 | 18 | 11.5 | 0.11 | 7 | — | — | — |
| MGP18 | 96856.2 | 0.714 | 0.24 | 15 | — | — | — | — | — | — |
| CONT. | — | 0.622 | — | — | 10.7 | — | — | — | — | — |
| MGP40 | 96913.4 | — | — | — | 6.50 | 0.16 | 6 | 0.423 | 0.05 | 9 |
| MGP18 | 96854.3 | — | — | — | 6.73 | 0.04 | 10 | — | — | — |
| MGP18 | 96855.3 | — | — | — | — | — | — | 0.420 | 0.15 | 9 |
| CONT. | — | — | — | — | 6.13 | — | — | 0.386 | — | — |
| MGP21 | 94572.1 | — | — | — | 14.1 | 0.16 | 8 | 0.655 | 0.14 | 8 |
| CONT. | — | — | — | — | 13.1 | — | — | 0.608 | — | — |
| MGP21 | 94572.1 | — | — | — | 13.1 | 0.07 | 8 | 0.562 | 0.07 | 10 |
| MGP21 | 94573.1 | 0.717 | 0.23 | 28 | — | — | — | — | — | — |
| CONT. | — | 0.562 | — | — | 12.1 | — | — | 0.511 | — | — |
| LGM17 | 92378.5 | 0.920 | 0.23 | 14 | 14.6 | 0.04 | 15 | 0.618 | 0.01 | 7 |
| CONT. | — | 0.807 | — | — | 12.7 | — | — | 0.577 | — | — |
| LGD23 | 93295.3 | 0.760 | 0.10 | 15 | 11.7 | 0.09 | 15 | — | — | — |
| LGD23 | 93298.4 | — | — | — | 11.4 | 0.22 | 13 | — | — | — |
| LGD23 | 93298.6 | 0.743 | 0.22 | 12 | — | — | — | — | — | — |
| CONT. | — | 0.661 | — | — | 10.1 | — | — | — | — | — |
| LGA9 | 94220.3 | — | — | — | 13.8 | 0.24 | 11 | — | — | — |
| LGA9 | 94223.2 | — | — | — | 14.7 | 0.09 | 19 | — | — | — |
| LGA9 | 94223.3 | 0.714 | 0.29 | 20 | — | — | — | — | — | — |
| CONT. | — | 0.595 | — | — | 12.4 | — | — | — | — | — |
| LGB1 | 95790.2 | — | — | — | 11.6 | 0.15 | 7 | 0.541 | 0.14 | 7 |
| CONT. | — | — | — | — | 10.9 | — | — | 0.506 | — | — |
| LGM11 | 92055.1 | — | — | — | 18.3 | 0.25 | 9 | — | — | — |
| CONT. | — | — | — | — | 16.8 | — | — | — | — | — |
| LGB11 | 93849.4 | — | — | — | 13.0 | 0.11 | 21 | 0.626 | 0.12 | 17 |
| CONT. | — | — | — | — | 10.8 | — | — | 0.537 | — | — |

"CONT." = Control; "Ave." = Average; "% Incr." = % increment; "p-val." = p-value, L = p < 0.01.

TABLE 184

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P. Val. | % Incr. | Ave. | P-Val. | % Incr. |
| LGD2 | 91166.1 | — | — | — | 9.16 | 0.03 | 13 | 5.33 | 0.10 | 11 |
| LGD2 | 91167.2 | — | — | — | 10.2 | 0.02 | 26 | 5.50 | L | 15 |
| LGD2 | 91169.1 | — | — | — | 9.11 | 0.06 | 12 | 5.16 | 0.02 | 8 |
| LGD2 | 91169.2 | — | — | — | 9.39 | 0.06 | 16 | 5.22 | 0.01 | 9 |
| CONT. | — | — | — | — | 8.11 | — | — | 4.79 | — | — |
| LGM7 | 91255.4 | 0.333 | 0.03 | 22 | — | — | — | 4.75 | 0.29 | 7 |
| LGM7 | 91257.4 | 0.322 | 0.26 | 18 | — | — | — | — | — | — |
| LGM7 | 91258.1 | 0.305 | 0.17 | 12 | — | — | — | — | — | — |
| LGM7 | 91258.2 | 0.320 | 0.24 | 18 | — | — | — | — | — | — |
| CONT. | — | 0.272 | — | — | — | — | — | — | — | — |
| LGD1 | 92045.3 | — | — | — | — | — | — | 6.32 | 0.24 | 6 |
| LGD1 | 92045.4 | — | — | — | 13.7 | 0.05 | 13 | 6.55 | 0.05 | 10 |
| LGD1 | 92045.5 | 0.431 | 0.05 | 15 | — | — | — | — | — | — |
| LGD1 | 92048.4 | — | — | — | 13.6 | 0.03 | 13 | 6.50 | L | 9 |
| CONT. | — | 0.376 | — | — | 12.1 | — | — | 5.95 | — | — |
| LGD20 | 93505.1 | — | — | — | 12.0 | 0.14 | 17 | — | — | — |
| LGD20 | 93507.2 | 0.400 | 0.27 | 28 | — | — | — | — | — | — |
| CONT. | — | 0.314 | — | — | 10.2 | — | — | — | — | — |
| LGM15 | 92367.1 | — | — | — | 11.6 | 0.07 | 13 | 5.72 | 0.07 | 5 |
| LGM15 | 92367.2 | — | — | — | — | — | — | 5.61 | 0.10 | 3 |
| CONT. | — | — | — | — | 10.3 | — | — | 5.42 | — | — |
| LGB11 | 93849.4 | — | — | — | 5.21 | 0.03 | 15 | 4.30 | 0.14 | 4 |
| LGB11 | 93850.3 | — | — | — | 5.11 | 0.18 | 13 | — | — | — |
| CONT. | — | — | — | — | 4.51 | — | — | 4.13 | — | — |
| 7LGM5 | 90808.2 | — | — | — | — | — | — | 5.60 | 0.28 | 5 |
| LGM5 | 90811.1 | — | — | — | 11.7 | 0.13 | 22 | 6.08 | 0.04 | 14 |
| CONT. | — | — | — | — | 9.59 | — | — | 5.35 | — | — |
| LGM5 | 90808.2 | — | — | — | 6.39 | 0.29 | 8 | — | — | — |
| LGM5 | 90810.2 | 0.177 | 0.21 | 22 | 6.76 | 0.12 | 15 | 4.41 | 0.14 | 9 |
| LGM5 | 90811.1 | — | — | — | 7.68 | 0.02 | 30 | 4.63 | 0.04 | 14 |
| CONT. | — | 0.145 | — | — | 5.90 | — | — | 4.06 | — | — |
| MGP20 | 94579.5 | — | — | — | 7.33 | 0.16 | 11 | — | — | — |
| CONT. | — | — | — | — | 6.62 | — | — | — | — | — |
| LGD23 | 93295.3 | — | — | — | 8.58 | 0.09 | 16 | 5.13 | 0.29 | 6 |
| LGD23 | 93298.4 | — | — | — | 8.33 | 0.13 | 13 | 5.17 | 0.17 | 6 |
| LGD23 | 93298.5 | 0.311 | 0.10 | 13 | — | — | — | — | — | — |
| CONT. | — | 0.276 | — | — | 7.39 | — | — | 4.86 | — | — |
| LGB1 | 95790.2 | — | — | — | 5.13 | L | 19 | 4.21 | 0.01 | 9 |
| LGB1 | 95792.2 | — | — | — | 5.01 | L | 17 | 4.26 | 0.02 | 11 |
| CONT. | — | — | — | — | 4.30 | — | — | 3.85 | — | — |
| LGM11 | 92055.1 | — | — | — | 11.4 | 0.11 | 19 | 5.62 | 0.06 | 7 |
| LGM11 | 92055.4 | 0.461 | 0.24 | 12 | 10.5 | 0.23 | 10 | 5.56 | 0.19 | 6 |
| CONT. | — | 0.412 | — | — | 9.60 | — | — | 5.26 | — | — |
| MGP20 | 94574.1 | — | — | — | 8.56 | 0.21 | 15 | 5.23 | 0.21 | 6 |
| CONT. | — | — | — | — | 7.41 | — | — | 4.95 | — | — |
| LGM12 | 90799.2 | — | — | — | 9.83 | 0.29 | 7 | 5.36 | 0.16 | 4 |
| CONT. | — | — | — | — | 9.18 | — | — | 5.15 | — | — |
| LGA9 | 94223.2 | — | — | — | — | — | — | 5.19 | 0.29 | 2 |
| CONT. | — | — | — | — | — | — | — | 5.08 | — | — |
| LGD26 | 94245.2 | 0.417 | 0.24 | 11 | — | — | — | — | — | — |
| LGD26 | 94245.3 | 0.415 | 0.27 | 10 | — | — | — | — | — | — |
| LGD26 | 94245.4 | — | — | — | 12.0 | 0.08 | 20 | 5.82 | 0.12 | 8 |
| CONT. | — | 0.375 | — | — | 9.96 | — | — | 5.40 | — | — |
| LGD2 | 91167.1 | 0.216 | 0.16 | 11 | — | — | — | — | — | — |
| CONT. | — | 0.194 | — | — | — | — | — | — | — | — |
| LGM15 | 92367.1 | — | — | — | 7.45 | 0.19 | 15 | — | — | — |
| CONT. | — | — | — | — | 6.47 | — | — | — | — | — |
| LGM7 | 91255.4 | — | — | — | 12.8 | 0.02 | 17 | 6.11 | 0.04 | 6 |
| LGM7 | 91257.4 | — | — | — | 12.7 | 0.04 | 16 | 6.20 | 0.02 | 7 |
| CONT. | — | — | — | — | 11.0 | — | — | 5.79 | — | — |
| LGD1 | 92045.3 | 0.356 | 0.05 | 14 | — | — | — | — | — | — |
| LGD1 | 92048.3 | — | — | — | 11.3 | 0.07 | 12 | 5.92 | 0.28 | 3 |
| LGD1 | 92048.4 | 0.359 | 0.19 | 15 | — | — | — | — | — | — |
| CONT. | — | 0.312 | — | — | 10.1 | — | — | 5.76 | — | — |
| LGA17 | 94216.2 | — | — | — | 12.3 | 0.26 | 7 | 6.22 | 0.10 | 6 |
| CONT. | — | — | — | — | 11.6 | — | — | 5.87 | — | — |
| LGB4 | 96492.2 | — | — | — | 3.89 | 0.08 | 10 | 3.68 | 0.11 | 4 |
| LGB4 | 96492.3 | — | — | — | 4.05 | 0.25 | 15 | 3.72 | 0.27 | 5 |
| CONT. | — | — | — | — | 3.53 | — | — | 3.54 | — | — |
| LGM19 | 92379.1 | — | — | — | — | — | — | 3.84 | 0.28 | 4 |
| LGM19 | 92383.1 | — | — | — | 6.03 | 0.11 | 24 | 4.09 | 0.06 | 11 |

TABLE 184-continued

Genes showing improved plant performance at Normal growth conditions under regulation of At6669 promoter

| | | Harvest Index | | | Rosette Area [cm²] | | | Rosette Diameter [cm] | | |
|---|---|---|---|---|---|---|---|---|---|---|
| Gene Name | Event # | Ave. | P-Val. | % Incr. | Ave. | P. Val. | % Incr. | Ave. | P-Val. | % Incr. |
| CONT. | — | — | — | — | 4.88 | — | — | 3.70 | — | — |
| LGD3 | 91582.3 | 0.450 | 0.26 | 10 | 11.2 | L | 31 | 5.56 | L | 14 |
| LGD3 | 91583.4 | — | — | — | 10.2 | 0.28 | 18 | 5.30 | 0.23 | 9 |
| CONT. | — | 0.408 | — | — | 4.88 | — | — | — | — | — |
| LGD3 | 91582.3 | 0.343 | 0.05 | 16 | 11.7 | 0.13 | 20 | 5.83 | 0.07 | 8 |
| LGD3 | 91583.4 | 0.333 | 0.09 | 13 | 11.4 | 0.02 | 18 | 5.82 | 0.10 | 7 |
| LGD3 | 91584.2 | 0.349 | 0.06 | 18 | 10.5 | 0.29 | 8 | — | — | — |
| CONT. | — | 0.295 | — | — | 9.71 | — | — | 5.42 | — | — |
| LGM12 | 90801.1 | — | — | — | 8.86 | 0.25 | 10 | — | — | — |
| CONT. | — | — | — | — | 8.06 | — | — | — | — | — |
| LGD20 | 93505.1 | — | — | — | 9.87 | 0.08 | 13 | 5.57 | 0.12 | 6 |
| CONT. | — | — | — | — | 8.73 | — | — | 5.26 | — | — |
| MGP18 | 96854.3 | — | — | — | 8.82 | 0.07 | 7 | 5.13 | 0.07 | 5 |
| CONT. | — | — | — | — | 8.21 | — | — | 4.86 | — | — |
| MGP40 | 96913.4 | — | — | — | — | — | — | 4.01 | 0.22 | 2 |
| MGP18 | 96854.1 | — | — | — | — | — | — | 4.03 | 0.25 | 3 |
| MGP18 | 96854.3 | — | — | — | 4.87 | 0.03 | 11 | 4.15 | 0.04 | 6 |
| MGP18 | 96855.3 | — | — | — | — | — | — | 4.06 | 0.23 | 4 |
| CONT. | — | — | — | — | 4.39 | — | — | 3.91 | — | — |
| MGP21 | 94572.1 | — | — | — | 10.5 | 0.20 | 7 | 6.05 | 0.30 | 4 |
| CONT. | — | — | — | — | 9.77 | — | — | 5.82 | — | — |
| MGP21 | 94572.1 | — | — | — | 10.2 | 0.04 | 10 | 5.64 | 0.03 | 6 |
| CONT. | — | — | — | — | 9.25 | — | — | 5.31 | — | — |
| LGM17 | 92378.3 | 0.307 | 0.20 | 7 | — | — | — | — | — | — |
| LGM17 | 92378.5 | — | — | — | 12.2 | 0.04 | 15 | 6.05 | 0.02 | 7 |
| CONT. | — | 0.287 | — | — | 10.6 | — | — | 5.64 | — | — |
| LGD23 | 93295.3 | — | — | — | 11.0 | 0.10 | 14 | — | — | — |
| LGD23 | 93298.4 | — | — | — | 10.8 | 0.22 | 12 | — | — | — |
| CONT. | — | — | — | — | 9.60 | — | — | — | — | — |
| LGA9 | 94220.3 | — | — | — | 10.1 | 0.27 | 11 | — | — | — |
| LGA9 | 94223.2 | — | — | — | 11.0 | 0.08 | 20 | 5.62 | 0.16 | 9 |
| CONT. | — | — | — | — | 9.14 | — | — | 5.15 | — | — |
| LGB1 | 95790.2 | — | — | — | 8.79 | 0.15 | 7 | 5.08 | 0.17 | 4 |
| CONT. | — | — | — | — | 8.21 | — | — | 4.87 | — | — |
| LGB11 | 93849.4 | — | — | — | 10.2 | 0.04 | 27 | 5.78 | 0.03 | 15 |
| CONT. | — | — | — | — | 8.06 | — | — | 5.01 | — | — |
| LGM7 | 91255.4 | 0.333 | 0.03 | 22 | — | — | — | — | — | — |
| LGM7 | 91257.4 | 0.322 | 0.26 | 18 | — | — | — | — | — | — |
| LGM7 | 91258.1 | 0.305 | 0.17 | 12 | — | — | — | — | — | — |
| LGM7 | 91258.2 | 0.320 | 0.24 | 18 | — | — | — | — | — | — |
| CONT. | — | 0.272 | — | — | — | — | — | — | — | — |
| LGD1 | 92045.5 | 0.431 | 0.05 | 15 | — | — | — | — | — | — |
| CONT. | — | 0.376 | — | — | — | — | — | — | — | — |
| LGD20 | 93507.2 | 0.400 | 0.27 | 28 | — | — | — | — | — | — |
| CONT. | — | 0.314 | — | — | — | — | — | — | — | — |
| LGM5 | 90810.2 | 0.177 | 0.21 | 22 | — | — | — | — | — | — |
| CONT. | — | 0.145 | — | — | — | — | — | — | — | — |
| LGD23 | 93298.5 | 0.311 | 0.10 | 13 | — | — | — | — | — | — |
| CONT. | — | 0.276 | — | — | — | — | — | — | — | — |
| LGM11 | 92055.4 | 0.461 | 0.24 | 12 | — | — | — | — | — | — |
| CONT. | — | 0.412 | — | — | — | — | — | — | — | — |
| LGD26 | 94245.2 | 0.417 | 0.24 | 11 | — | — | — | — | — | — |
| LGD26 | 94245.3 | 0.415 | 0.27 | 10 | — | — | — | — | — | — |
| CONT. | — | 0.375 | — | — | — | — | — | — | — | — |
| LGD2 | 91167.1 | 0.216 | 0.16 | 11 | — | — | — | — | — | — |
| CONT. | — | 0.194 | — | — | — | — | — | — | — | — |
| LGD1 | 92045.3 | 0.356 | 0.05 | 14 | — | — | — | — | — | — |
| LGD1 | 92048.4 | 0.359 | 0.19 | 15 | — | — | — | — | — | — |
| CONT. | — | 0.312 | — | — | — | — | — | — | — | — |
| LGD3 | 91582.3 | 0.450 | 0.26 | 10 | — | — | — | — | — | — |
| CONT. | — | 0.408 | — | — | — | — | — | — | — | — |
| LGD3 | 91582.3 | 0.343 | 0.05 | 16 | — | — | — | — | — | — |
| LGD3 | 91583.4 | 0.333 | 0.09 | 13 | — | — | — | — | — | — |
| LGD3 | 91584.2 | 0.349 | 0.06 | 18 | — | — | — | — | — | — |
| CONT. | — | 0.295 | — | — | — | — | — | — | — | — |
| LGM17 | 92378.3 | 0.307 | 0.20 | 7 | — | — | — | — | — | — |
| CONT. | — | 0.287 | — | — | — | — | — | — | — | — |

"CONT." = Control; "Ave." = Average; "% Incr." = % increment; "p-val." = p-value, L = p < 0.01.

TABLE 185

Genes showing improved plant performance at Normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LGD2 | 91167.2 | — | — | — | 24.9 | 0.11 | 13 |
| CONT. | | — | — | — | 22.0 | — | — |
| LGM7 | 91255.4 | 368.8 | 0.03 | 26 | 19.6 | 0.09 | 8 |
| LGM7 | 91257.4 | 351.7 | 0.28 | 21 | — | — | — |
| LGM7 | 91258.1 | 329.2 | 0.16 | 13 | — | — | — |
| LGM7 | 91258.2 | 348.8 | 0.18 | 20 | — | — | — |
| LGM7 | 91258.4 | 320.5 | 0.25 | 10 | 19.9 | 0.07 | 9 |
| CONT. | | 291.5 | — | — | 18.2 | — | — |
| LGD1 | 92045.5 | 481.9 | 0.13 | 11 | — | — | — |
| LGD1 | 92048.4 | — | — | — | 19.5 | 0.18 | 4 |
| CONT. | | 434.1 | — | — | 18.7 | — | — |
| LGD20 | 93505.3 | — | — | — | 23.2 | 0.03 | 25 |
| CONT. | | — | — | — | 18.5 | — | — |
| LGM15 | 92367.1 | — | — | — | 20.6 | 0.27 | 8 |
| LGM15 | 92367.2 | — | — | — | 19.8 | 0.17 | 4 |
| CONT. | | — | — | — | 19.1 | — | — |
| LGM5 | 90810.1 | — | — | — | 22.0 | 0.08 | 10 |
| LGM5 | 90811.1 | — | — | — | 24.6 | 0.03 | 23 |
| CONT. | | — | — | — | 20.0 | — | — |
| LGM5 | 90810.2 | 212.0 | 0.07 | 30 | — | — | — |
| LGM5 | 90811.1 | 187.7 | 0.07 | 15 | 22.6 | 0.03 | 8 |
| CONT. | | 163.6 | — | — | 21.0 | — | — |
| LGD23 | 93298.4 | — | — | — | 19.4 | 0.08 | 13 |
| LGD23 | 93298.5 | 402.3 | 0.22 | 14 | 19.3 | 0.07 | 12 |
| CONT. | | 352.6 | — | — | 17.2 | — | — |
| LGM11 | 92055.1 | — | — | — | 22.1 | 0.04 | 23 |
| CONT. | | — | — | — | 17.9 | — | — |
| LGM12 | 90799.2 | — | — | — | 20.7 | 0.11 | 13 |
| CONT. | | — | — | — | 18.4 | — | — |
| LGD26 | 94245.3 | 498.8 | 0.24 | 9 | — | — | — |
| LGD26 | 94245.4 | — | — | — | 21.8 | 0.17 | 9 |
| CONT. | | 458.1 | — | — | 20.0 | — | — |
| LGD2 | 91167.2 | — | — | — | 21.4 | 0.09 | 8 |
| CONT. | | — | — | — | 19.8 | — | — |
| LGM15 | 92367.2 | — | — | — | 19.2 | 0.25 | 7 |
| LGM15 | 92368.1 | — | — | — | 19.8 | 0.21 | 10 |
| CONT. | | — | — | — | 17.9 | — | — |
| LGM7 | 91255.4 | — | — | — | 20.6 | 0.08 | 9 |
| LGM7 | 91257.4 | — | — | — | 22.1 | 0.07 | 17 |
| LGM7 | 91258.2 | 379.7 | 0.28 | 7 | — | — | — |
| LGM7 | 91258.4 | — | — | — | 19.7 | 0.22 | 5 |
| CONT. | | 354.8 | — | — | 18.8 | — | — |
| LGD1 | 92045.3 | 414.5 | 0.20 | 14 | — | — | — |
| LGD1 | 92045.4 | 414.4 | 0.20 | 14 | — | — | — |
| LGD1 | 92048.4 | 444.4 | 0.22 | 23 | — | — | — |
| CONT. | | 362.1 | — | — | — | — | — |
| LGM17 | 92378.5 | — | — | — | 23.3 | L | 21 |
| CONT. | | — | — | — | 19.3 | — | — |
| LGM19 | 92383.1 | — | — | — | 24.6 | 0.06 | 37 |
| CONT. | | — | — | — | 18.0 | — | — |
| LGD3 | 91582.3 | 392.0 | 0.13 | 11 | — | — | — |
| LGD3 | 91583.4 | 386.5 | 0.18 | 9 | — | — | — |
| LGD3 | 91584.2 | 410.7 | 0.13 | 16 | — | — | — |
| CONT. | | 353.4 | — | — | — | — | — |
| LGD20 | 93505.3 | — | — | — | 21.4 | L | 27 |
| CONT. | | — | — | — | 16.8 | — | — |
| LGM17 | 92377.1 | — | — | — | 22.3 | 0.03 | 14 |
| LGM17 | 92378.5 | — | — | — | 27.6 | 0.02 | 42 |
| CONT. | | — | — | — | 19.5 | — | — |
| LGM19 | 92379.1 | — | — | — | 20.6 | 0.14 | 11 |
| LGM19 | 92379.2 | — | — | — | 20.0 | 0.16 | 8 |
| LGM19 | 92382.2 | — | — | — | 20.2 | 0.11 | 10 |
| LGM19 | 92383.1 | — | — | — | 27.3 | L | 48 |
| CONT. | | — | — | — | 18.5 | — | — |
| LGD23 | 93295.1 | 464.7 | 0.15 | 13 | — | — | — |
| LGD23 | 93298.5 | — | — | — | 22.1 | 0.04 | 17 |
| CONT. | | 409.8 | — | — | 18.9 | — | — |
| LGM11 | 92054.1 | — | — | — | 22.0 | 0.22 | 5 |
| LGM11 | 92055.1 | — | — | — | 25.9 | L | 23 |
| CONT. | | — | — | — | 21.0 | — | — |
| LGD2 | 91167.2 | — | — | — | 24.9 | 0.11 | 13 |
| CONT. | | — | — | — | 22.0 | — | — |
| LGM7 | 91255.4 | — | — | — | 19.6 | 0.09 | 8 |
| LGM7 | 91258.4 | — | — | — | 19.9 | 0.07 | 9 |
| CONT. | | — | — | — | 18.2 | — | — |
| LGD1 | 92048.4 | — | — | — | 19.5 | 0.18 | 4 |
| CONT. | | — | — | — | 18.7 | — | — |
| LGD20 | 93505.3 | — | — | — | 23.2 | 0.03 | 25 |
| CONT. | | — | — | — | 18.5 | — | — |
| LGM15 | 92367.1 | — | — | — | 20.6 | 0.27 | 8 |
| LGM15 | 92367.2 | — | — | — | 19.8 | 0.17 | 4 |
| CONT. | | — | — | — | 19.1 | — | — |
| LGM5 | 90810.1 | — | — | — | 22.0 | 0.08 | 10 |
| LGM5 | 90811.1 | — | — | — | 24.6 | 0.03 | 23 |
| CONT. | | — | — | — | 20.0 | — | — |
| LGM5 | 90811.1 | — | — | — | 22.6 | 0.03 | 8 |
| CONT. | | — | — | — | 21.0 | — | — |
| LGD23 | 93298.4 | — | — | — | 19.4 | 0.08 | 13 |
| LGD23 | 93298.5 | — | — | — | 19.3 | 0.07 | 12 |
| CONT. | | — | — | — | 17.2 | — | — |
| LGM11 | 92055.1 | — | — | — | 22.1 | 0.04 | 23 |
| CONT. | | — | — | — | 17.9 | — | — |
| LGM12 | 90799.2 | — | — | — | 20.7 | 0.11 | 13 |
| CONT. | | — | — | — | 18.4 | — | — |
| LGD26 | 94245.4 | — | — | — | 21.8 | 0.17 | 9 |
| CONT. | | — | — | — | 20.0 | — | — |
| LGD2 | 91167.2 | — | — | — | 21.4 | 0.09 | 8 |
| CONT. | | — | — | — | 19.8 | — | — |
| LGM15 | 92367.2 | — | — | — | 19.2 | 0.25 | 7 |
| LGM15 | 92368.1 | — | — | — | 19.8 | 0.21 | 10 |
| CONT. | | — | — | — | 17.9 | — | — |
| LGM7 | 91255.4 | — | — | — | 20.6 | 0.08 | 9 |
| LGM7 | 91257.4 | — | — | — | 22.1 | 0.07 | 17 |
| LGM7 | 91258.4 | — | — | — | 19.7 | 0.22 | 5 |
| CONT. | | — | — | — | 18.8 | — | — |
| LGM17 | 92378.5 | — | — | — | 23.3 | L | 21 |
| CONT. | | — | — | — | 19.3 | — | — |
| LGM19 | 92383.1 | — | — | — | 24.6 | 0.06 | 37 |
| CONT. | | — | — | — | 18.0 | — | — |
| LGD20 | 93505.3 | — | — | — | 21.4 | L | 27 |
| CONT. | | — | — | — | 16.8 | — | — |
| LGM17 | 92377.1 | — | — | — | 22.3 | 0.03 | 14 |
| LGM17 | 92378.5 | — | — | — | 27.6 | 0.02 | 42 |
| CONT. | | — | — | — | 19.5 | — | — |
| LGM19 | 92379.1 | — | — | — | 20.6 | 0.14 | 11 |
| LGM19 | 92379.2 | — | — | — | 20.0 | 0.16 | 8 |
| LGM19 | 92382.2 | — | — | — | 20.2 | 0.11 | 10 |
| LGM19 | 92383.1 | — | — | — | 27.3 | L | 48 |
| CONT. | | — | — | — | 18.5 | — | — |
| LGD23 | 93298.5 | — | — | — | 22.1 | 0.04 | 17 |
| CONT. | | — | — | — | 18.9 | — | — |
| LGM11 | 92054.1 | — | — | — | 22.0 | 0.22 | 5 |
| LGM11 | 92055.1 | — | — | — | 25.9 | L | 23 |
| CONT. | | — | — | — | 21.0 | — | — |

"CONT." = Control; "Ave." = Average; "% Incr." = % increment; "p-val." = p-value, L = p < 0.01.

Tables 186-188 summarize the observed phenotypes of transgenic plants exogenously expressing the gene constructs using the seed maturation (GH-SM) assays under drought stress growth conditions. The genes listed in these Tables show increased biomass (e.g., increased rosette area, rosette diameter), and increased growth rate (e.g., increased growth rate of leaf number, plot coverage, rosette diameter) under drought stress growth conditions. The evaluation of each gene was performed by testing the performance of different number of events. Event with p-value <0.1 was considered statistically significant.

TABLE 186

Genes showing improved plant performance at Drought growth conditions under regulation of At6669 promoter

| Gene Name | Event # | Leaf Blade Area [cm²] | | | Leaf Number | | | Plot coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LGB4 | 96492.3 | 0.628 | 0.19 | 7 | — | — | — | 35.1 | 0.10 | 15 |
| CONT. | — | 0.585 | — | — | — | — | — | 30.6 | — | — |
| LGA17 | 94216.2 | 1.91 | 0.11 | 16 | — | — | — | — | — | — |
| CONT. | — | 1.64 | — | — | — | — | — | — | — | — |
| LGB1 | 95790.2 | 0.759 | L | 17 | 9.50 | 0.18 | 6 | 39.1 | 0.02 | 14 |
| LGB1 | 95790.4 | — | — | — | — | — | — | 37.3 | 0.15 | 9 |
| LGB1 | 95791.1 | 0.682 | 0.16 | 5 | 9.67 | 0.09 | 7 | 36.7 | 0.13 | 7 |
| LGB1 | 95792.2 | 0.739 | L | 14 | 9.42 | 0.22 | 5 | 38.5 | 0.03 | 12 |
| CONT. | — | 0.647 | — | — | 9.00 | — | — | 34.3 | — | — |
| LGA9 | 94220.3 | 1.29 | 0.22 | 13 | — | — | — | — | — | — |
| LGA9 | 94223.2 | 1.31 | 0.16 | 15 | — | — | — | 73.7 | 0.09 | 23 |
| CONT. | — | 1.14 | — | — | — | — | — | 60.0 | — | — |
| LGA9 | 94220.2 | 1.28 | L | 17 | — | — | — | 68.4 | 0.06 | 19 |
| LGA9 | 94220.3 | 1.21 | 0.24 | 10 | — | — | — | 64.2 | 0.20 | 12 |
| LGA9 | 94223.2 | 1.23 | 0.27 | 12 | — | — | — | 66.4 | 0.13 | 16 |
| LGA9 | 94223.3 | 1.20 | 0.03 | 10 | — | — | — | 66.3 | 0.01 | 16 |
| CONT. | — | 1.10 | — | — | — | — | — | 57.3 | — | — |
| LGB11 | 93849.4 | 0.803 | 0.23 | 6 | — | — | — | 41.7 | 0.29 | 3 |
| CONT. | — | 0.758 | — | — | — | — | — | 40.3 | — | — |
| LGB11 | 93849.4 | 1.31 | 0.14 | 10 | — | — | — | — | — | — |
| CONT. | — | 1.19 | — | — | — | — | — | — | — | — |
| LGB4 | 96492.2 | 0.864 | 0.17 | 11 | — | — | — | 46.0 | 0.11 | 17 |
| LGB4 | 96493.4 | 0.869 | 0.15 | 12 | 9.62 | 0.26 | 5 | 46.4 | 0.10 | 18 |
| CONT. | — | 0.777 | — | — | 9.17 | — | — | 39.4 | — | — |

Table 186.
"CONT." = Control;
"Ave." = Average;
"% Incr." = % increment;
"p-val." = p-value,
L = p < 0.01.

TABLE 187

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGB4 | 96492.3 | — | — | — | 6.82 | 0.17 | 12 | — | — | — |
| CONT. | — | — | — | — | 6.07 | — | — | — | — | — |
| LGA17 | 94216.2 | — | — | — | — | — | — | 0.688 | 0.17 | 14 |
| CONT. | — | — | — | — | — | — | — | 0.605 | — | — |
| LGB1 | 95790.2 | — | — | — | 7.71 | 0.09 | 14 | 0.504 | 0.12 | 12 |
| LGB1 | 95790.4 | 0.907 | 0.25 | 6 | 7.46 | 0.24 | 10 | 0.488 | 0.28 | 8 |
| LGB1 | 95791.1 | 0.973 | 0.27 | 13 | 7.36 | 0.29 | 9 | 0.492 | 0.17 | 9 |
| LGB1 | 95792.2 | — | — | — | 7.64 | 0.10 | 13 | 0.498 | 0.13 | 11 |
| CONT. | — | 0.859 | — | — | 6.77 | — | — | 0.450 | — | — |
| LGA9 | 94223.2 | — | — | — | 12.0 | 0.07 | 22 | 0.484 | 0.27 | 6 |
| CONT. | — | — | — | — | 9.84 | — | — | 0.458 | — | — |
| LGB1 | 95790.2 | 0.613 | 0.19 | 20 | — | — | — | — | — | — |
| LGB1 | 95790.4 | 0.661 | 0.23 | 29 | — | — | — | — | — | — |
| LGB1 | 95792.3 | 0.640 | 0.25 | 25 | — | — | — | — | — | — |
| CONT. | — | 0.511 | — | — | — | — | — | — | — | — |
| LGA9 | 94220.2 | — | — | — | 11.4 | 0.04 | 20 | 0.485 | 0.01 | 8 |
| LGA9 | 94220.3 | — | — | — | 10.6 | 0.20 | 12 | 0.489 | 0.12 | 9 |
| LGA9 | 94223.2 | — | — | — | 10.7 | 0.14 | 13 | — | — | — |
| LGA9 | 94223.3 | — | — | — | 11.0 | 0.06 | 16 | 0.485 | 0.27 | 8 |
| CONT. | — | — | — | — | 9.44 | — | — | 0.447 | — | — |
| LGB11 | 93849.4 | — | — | — | — | — | — | 0.525 | 0.21 | 8 |
| CONT. | — | — | — | — | — | — | — | 0.484 | — | — |

TABLE 187-continued

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGB4 | 96492.2 | — | — | — | 7.54 | 0.07 | 17 | 0.413 | 0.17 | 8 |
| LGB4 | 96493.4 | — | — | — | 7.51 | 0.08 | 17 | — | — | — |
| CONT. | — | — | — | — | 6.42 | — | — | 0.382 | — | — |

Table 187.
"CONT." = Control;
"Ave." = Average;
"% Incr." = % increment;
"p-val." = p-value,
L = p < 0.01.

TABLE 188

Genes showing improved plant performance at Drought growth conditions under regulation of At6669 promoter

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGB4 | 96492.3 | — | — | — | 4.39 | 0.10 | 15 | 3.83 | 0.20 | 5 |
| CONT. | — | — | — | — | 3.82 | — | — | 3.64 | — | — |
| LGA17 | 94216.2 | — | — | — | — | — | — | 6.33 | 0.15 | 9 |
| CONT. | — | — | — | — | — | — | — | 5.84 | — | — |
| LGB1 | 95790.2 | — | — | — | 4.89 | 0.02 | 14 | 4.07 | 0.02 | 8 |
| LGB1 | 95790.4 | — | — | — | 4.66 | 0.15 | 9 | 4.00 | 0.17 | 6 |
| LGB1 | 95791.1 | — | — | — | 4.59 | 0.13 | 7 | 3.96 | 0.08 | 5 |
| LGB1 | 95792.2 | — | — | — | 4.82 | 0.03 | 12 | 4.09 | 0.02 | 8 |
| CONT. | — | — | — | — | 4.29 | — | — | 3.77 | — | — |
| LGA9 | 94220.3 | — | — | — | — | — | — | 4.89 | 0.24 | 6 |
| LGA9 | 94223.2 | — | — | — | 9.21 | 0.09 | 23 | 5.00 | 0.13 | 9 |
| CONT. | — | — | — | — | 7.50 | — | — | 4.60 | — | — |
| LGA9 | 94220.2 | — | — | — | 8.55 | 0.06 | 19 | 5.07 | 0.03 | 8 |
| LGA9 | 94220.3 | — | — | — | 8.03 | 0.20 | 12 | 4.96 | 0.25 | 6 |
| LGA9 | 94223.2 | — | — | — | 8.30 | 0.13 | 16 | 5.07 | 0.14 | 8 |
| LGA9 | 94223.3 | — | — | — | 8.29 | 0.01 | 16 | 5.04 | L | 7 |
| CONT. | — | — | — | — | 7.16 | — | — | 4.69 | — | — |
| LGB11 | 93849.4 | — | — | — | 5.21 | 0.29 | 3 | — | — | — |
| CONT. | — | — | — | — | 5.04 | — | — | — | — | — |
| LGB4 | 96492.2 | — | — | — | 5.75 | 0.11 | 17 | 4.13 | 0.05 | 8 |
| LGB4 | 96492.3 | — | — | — | — | — | — | 4.00 | 0.20 | 5 |
| LGB4 | 96493.4 | — | — | — | 5.80 | 0.10 | 18 | 4.11 | 0.06 | 8 |
| CONT. | — | — | — | — | 4.92 | — | — | 3.81 | — | — |

Table 188.
"CONT." = Control;
"Ave." = Average;
"% Incr." = % increment;
"p-val." = p-value,
L = p < 0.01.

Example 25

Evaluation of Transgenic *Arabidopsis* Abst, Biomass and Plant Growth Rate Under Abiotic Stress as Well as Under Standard Conditions in Greenhouse Assay (GH-SB Assays)

Assay 2: Plant performance improvement measured until bolting stage: plant biomass and plant growth rate under normal greenhouse conditions (GH-SB Assays)—This assay follows the plant biomass formation and the rosette area growth of plants grown in the greenhouse under normal growth conditions. Transgenic *Arabidopsis* seeds were sown in agar media supplemented with 2 MS medium and a selection agent (Kanamycin). The T$_2$ transgenic seedlings were then transplanted to 1.7 trays filled with peat and perlite in a 1:2 ratio and tuff at the bottom of the tray and a net below the trays (in order to facilitate water drainage). Plants were grown under normal conditions which included irrigation of the trays with a solution containing of 6 mM inorganic nitrogen in the form of KNO$_3$ with 1 mM KH$_2$PO$_4$, 1 mM MgSO$_4$, 1.5 mM CaCl$_2$ and microelements. Under normal conditions the plants grow in a controlled environment in a closed transgenic greenhouse; temperature was 18-22° C., humidity around 70%; Irrigation was done by flooding with a water solution containing 6 mM N (nitrogen) (as described hereinabove), and flooding was repeated whenever water loss reached 50%. All plants were grown in the greenhouse until bolting stage. Plant biomass (the above ground tissue) was weighted directly after harvesting the rosette (plant fresh weight [FW]). Following plants were dried in an oven at 50° C. for 48 hours and weighted (plant dry weight [DW]).

Each construct was validated at its T₂ generation (under the control of the At6669 promoter, SEQ ID NO: 6614). Transgenic plants transformed with a construct conformed by an empty vector carrying the At6669 promoter (SEQ ID NO: 6614) and the selectable marker were used as control.

The plants are analyzed for their overall size, growth rate, fresh weight and dry matter. Transgenic plants performance was compared to control plants grown in parallel under the same conditions. Mock-transgenic plants with no gene at all, under the same promoter were used as control.

The experiment is planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) was used for capturing images of plant samples.

The image capturing process is repeated every 2 days starting from day 1 after transplanting till day 16. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data is calculated, including leaf number, rosette area, rosette diameter, leaf blade area, Petiole Relative Area and leaf petiole length.

Vegetative growth rate: the relative growth rate (RGR) of leaf blade area (Formula XII), leaf number (Formula VIII), rosette area (Formula IX), rosette diameter (Formula X), plot coverage (Formula XI) and Petiole Relative Area (LIX) as described above.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants are compared to those obtained from control plants. To identify outperforming genes and constructs, results from the independent transformation events tested are analyzed separately. Data was analyzed using Student's t-test and results were considered significant if the p value is less than 0.1. The JMP statistics software package is used (Version 5.2.1, SAS Institute Inc., Cary, N.C., USA).

Experimental Results Tables 189-191 summarize the observed phenotypes of transgenic plants exogenously expressing the gene constructs using the greenhouse bolting stage (GH-SB) assays under non-stress (normal, standard) growth conditions. The genes listed in these Tables show increased biomass (e.g., increased dry weight, fresh weight, rosette area and diameter), photosynthetic area (e.g., increased leaf number, plot coverage), and increased growth rate (e.g., increased growth rate of leaf number, plot coverage, rosette diameter) under non-stress growth conditions. The evaluation of each gene was performed by testing the performance of different number of events. Event with p-value <0.1 was considered statistically significant.

TABLE 189

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LGD9 | 95072.1 | — | — | — | 541.7 | 0.18 | 17 | — | — | — |
| LGD9 | 95076.1 | 36.2 | 0.22 | 7 | — | — | — | — | — | — |
| LGD9 | 95076.2 | 40.8 | 0.14 | 21 | 516.7 | 0.10 | 12 | — | — | — |
| CONT. | — | 33.8 | — | — | 462.5 | — | — | — | — | — |
| LGD11 | 94073.2 | 34.2 | 0.17 | 22 | — | — | — | — | — | — |
| LGD11 | 94075.1 | 32.1 | 0.21 | 15 | 504.2 | 0.19 | 14 | — | — | — |
| LGD11 | 94076.2 | — | — | — | — | — | — | 10.1 | 0.22 | 6 |
| CONT. | — | 27.9 | — | — | 441.7 | — | — | 9.54 | — | — |
| LGD12 | 94137.2 | 101.7 | 0.17 | 17 | — | — | — | — | — | — |
| CONT. | — | 86.6 | — | — | — | — | — | — | — | — |
| LGM9 | 92733.2 | — | — | — | — | — | — | 10.0 | 0.30 | 3 |
| CONT. | — | — | — | — | — | — | — | 9.71 | — | — |
| LGD12 | 94141.2 | — | — | — | — | — | — | 10.4 | L | 6 |
| CONT. | — | — | — | — | — | — | — | 9.78 | — | — |
| LGM9 | 92729.4 | — | — | — | 400.0 | 0.22 | 7 | — | — | — |
| LGM9 | 92731.1 | 32.1 | 0.18 | 43 | — | — | — | — | — | — |
| LGM9 | 92731.2 | 27.1 | 0.22 | 20 | 391.7 | 0.13 | 4 | — | — | — |
| LGM9 | 92733.1 | 31.7 | 0.07 | 41 | 412.5 | 0.10 | 10 | — | — | — |

TABLE 189-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LGM9 | 92733.2 | 28.3 | 0.14 | 26 | — | — | — | — | — | — |
| CONT. | — | 22.5 | — | — | 375.0 | — | — | — | — | — |

Table 189.
"CONT." = Control;
"Ave." = Average;
"% Incr." = % increment;
"p-val." = p-value,
L = p < 0.01.

TABLE 190

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGD11 | 94075.1 | — | — | — | — | — | — | 5.62 | 0.18 | 3 |
| CONT. | — | — | — | — | — | — | — | 5.46 | — | — |
| LGD9 | 95076.2 | 69.7 | 0.05 | 11 | 8.71 | 0.05 | 11 | 5.20 | 0.19 | 3 |
| CONT. | — | 62.8 | — | — | 7.85 | — | — | 5.04 | — | — |
| LGD11 | 94075.1 | 70.1 | 0.29 | 14 | 8.76 | 0.29 | 14 | — | — | — |
| CONT. | — | 61.4 | — | — | 7.67 | — | — | — | — | — |
| LGM9 | 92729.4 | — | — | — | — | — | — | 4.43 | 0.09 | 1 |
| LGM9 | 92733.1 | 52.0 | 0.25 | 7 | 6.50 | 0.25 | 7 | 4.51 | 0.09 | 3 |
| CONT. | — | 48.8 | — | — | 6.10 | — | — | 4.36 | — | — |

Table 190.
"CONT." = Control;
"Ave." = Average;
"% Incr." = % increment;
"p-val." = p-value,
L = p < 0.01.

TABLE 191

Genes showing improved plant performance at Normal growth conditions under regulation of At6669 promoter

| Gene Name | Event # | RGR OF Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGD9 | 95072.1 | 0.668 | 0.20 | 11 | 8.80 | 0.29 | 11 | — | — | — |
| LGD9 | 95076.2 | — | — | — | 8.83 | 0.04 | 12 | — | — | — |
| CONT. | — | 0.600 | — | — | 7.90 | — | — | — | — | — |
| LGD11 | 94076.2 | 0.661 | 0.23 | 11 | — | — | — | — | — | — |
| CONT. | — | 0.597 | — | — | — | — | — | — | — | — |
| LGD12 | 94141.2 | 0.654 | 0.18 | 7 | — | — | — | — | — | — |
| CONT. | — | 0.610 | — | — | — | — | — | — | — | — |
| LGM9 | 92733.1 | — | — | — | 6.58 | 0.28 | 7 | — | — | — |
| LGM9 | 92731.2 | 0.656 | 0.17 | 19 | — | — | — | — | — | — |
| CONT. | — | 0.549 | — | — | 6.16 | — | — | — | — | — |

Table 191.
"CONT." = Control;
"Ave." = Average;
"% Incr." = % increment;
"p-val." = p-value,
L = p < 0.01.

Example 26

Evaluating Transgenic *Arabidopsis* Under Normal and Low Nitrogen Conditions Using Seedling Analyses of T2 and T1 Plants Seedling analysis of plants growth under low and favorable nitrogen concentration levels—Low nitrogen is an abiotic stress that impact root growth and seedling growth. Therefore, an assay that examines plant performance under low (0.75 mM Nitrogen) and favorable (15 mM Nitrogen) nitrogen concentrations was performed, as follows.

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. For experiments performed in T2 lines, each plate contained 5 seedlings of the same transgenic event, and 3-4 different plates (replicates) for each event. For each polynucleotide of the invention at least four-five independent transformation events were analyzed from each construct. For experiments performed in T1 lines, each plate contained 5 seedlings of 5 independent transgenic events and 3-4 different plates (replicates) were planted. In total, for T1 lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F).

An image analysis system was used, which consists of a personal desktop computer (Intel P4 3.0 GHz processor) and a public domain program—ImageJ 1.39 (Java based image processing program which is developed at the U.S. National Institutes of Health and freely available on the internet at rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data is calculated, including leaf area, root coverage and root length.

The relative growth rate for the various seedling parameters was calculated according to Formulas XIII (RGR leaf area), VI (RGR root length) and XXVIII (RGR root coverage) as described above.

At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor, under osmotic stress, as well as under optimal conditions. Similarly, the effect of the gene introduced on biomass accumulation, under osmotic stress as well as under optimal conditions was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved tolerance to abiotic stresses or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results

Tables 192-194 summarize the observed phenotypes of transgenic plants exogenously expressing the gene constructs using the seedling assays under non-stress (normal, standard) growth conditions. The genes listed in these Tables show increased biomass (e.g., increased dry weight, fresh weight), photosynthetic area (e.g., increased leaf area), increased root biomass (e.g., root length and root coverage) and increased growth rate (e.g., increased growth rate of leaf area, root coverage and root length) under non-stress growth conditions. The evaluation of each gene was performed by testing the performance of different number of events. Event with p-value <0.1 was considered statistically significant.

TABLE 192

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LGD7 | 95622.1 | 11.5 | 0.15 | 29 | 205.2 | 0.12 | 31 |
| LGD7 | 95622.2 | 12.2 | L | 37 | 209.8 | 0.01 | 34 |
| LGD7 | 95625.1 | 12.3 | L | 38 | 208.6 | L | 33 |
| LGD14 | 96776.5 | 10.4 | 0.23 | 17 | — | — | — |
| CONT. | — | 8.92 | — | — | 157.1 | — | — |
| LGB8 | 96534.3 | — | — | — | 191.7 | 0.29 | 19 |
| LGB1 | 95791.1 | — | — | — | 171.1 | 0.22 | 6 |
| LGB1 | 95792.3 | 10.8 | 0.14 | 9 | 177.2 | 0.24 | 10 |
| CONT. | — | 9.87 | — | — | 160.7 | — | — |
| LGB5 | 94192.1 | — | — | — | 130.6 | 0.22 | 8 |
| LGB5 | 94192.3 | 9.30 | 0.16 | 27 | 163.5 | 0.12 | 36 |
| LGB5 | 94193.1 | 8.53 | 0.08 | 16 | — | — | — |
| LGB2 | 94882.3 | 10.1 | 0.18 | 38 | 168.0 | 0.21 | 39 |
| LGB2 | 94884.1 | 8.38 | 0.16 | 14 | 156.6 | L | 30 |
| LGB16 | 94702.2 | — | — | — | 135.7 | 0.09 | 13 |
| LGB16 | 94702.4 | 8.82 | 0.03 | 20 | 141.1 | L | 17 |
| LGB16 | 94702.5 | 8.82 | L | 20 | — | — | — |
| LGB15 | 93971.4 | 8.93 | 0.08 | 22 | 146.2 | 0.15 | 21 |
| LGB15 | 93971.6 | 9.38 | 0.13 | 28 | 153.7 | 0.21 | 28 |
| LGB11 | 93849.4 | 9.25 | 0.24 | 26 | 155.0 | 0.18 | 29 |
| LGB11 | 93849.5 | 8.82 | 0.02 | 20 | 156.8 | L | 30 |
| CONT. | — | 7.34 | — | — | 120.5 | — | — |
| MGP38 | 96042.4 | 9.12 | 0.04 | 25 | 154.8 | 0.14 | 19 |
| MGP38 | 96043.2 | 10.2 | L | 40 | 177.4 | L | 37 |
| MGP38 | 96045.1 | 12.8 | 0.02 | 75 | 195.9 | 0.03 | 51 |

TABLE 192-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| MGP38 | 96045.2 | 8.97 | L | 23 | 151.0 | 0.01 | 16 |
| MGP35 | 96180.3 | 11.8 | L | 62 | 193.1 | 0.04 | 49 |
| MGP35 | 96181.2 | 9.38 | 0.14 | 28 | 163.1 | 0.23 | 26 |
| MGP35 | 96184.1 | 9.55 | L | 30 | 154.2 | 0.09 | 19 |
| MGP35 | 96184.3 | 8.20 | 0.18 | 12 | — | — | — |
| MGP34 | 96354.1 | 13.1 | 0.01 | 79 | 212.5 | 0.07 | 64 |
| MGP34 | 96354.3 | 9.80 | L | 34 | 158.0 | L | 22 |
| MGP34 | 96356.1 | — | — | — | 136.4 | 0.26 | 5 |
| MGP34 | 96356.2 | 9.75 | 0.07 | 33 | 154.2 | 0.18 | 19 |
| MGP34 | 96356.3 | 13.1 | 0.02 | 79 | 208.4 | 0.01 | 61 |
| MGP33 | 96056.2 | 12.3 | L | 69 | 199.5 | L | 54 |
| MGP33 | 96056.3 | 8.97 | L | 23 | 152.9 | 0.11 | 18 |
| MGP33 | 96057.3 | 10.6 | 0.08 | 44 | 185.3 | 0.11 | 43 |
| MGP33 | 96057.4 | 8.40 | 0.27 | 15 | — | — | — |
| MGP28 | 96288.2 | 7.93 | 0.11 | 8 | — | — | — |
| MGP28 | 96289.2 | 9.75 | 0.05 | 33 | 168.3 | 0.10 | 30 |
| MGP28 | 96289.4 | 10.9 | 0.03 | 49 | 177.2 | 0.07 | 37 |
| MGP28 | 96290.3 | 8.30 | 0.19 | 13 | 147.2 | 0.16 | 13 |
| MGP28 | 96290.4 | 7.92 | 0.15 | 8 | — | — | — |
| MGP23 | 96343.4 | 9.10 | L | 24 | 152.4 | 0.06 | 18 |
| MGP23 | 96344.3 | 9.67 | L | 32 | 162.3 | L | 25 |
| MGP17 | 96306.3 | 10.9 | 0.17 | 49 | 186.6 | 0.18 | 44 |
| MGP17 | 96309.3 | 10.9 | 0.02 | 50 | 184.0 | 0.03 | 42 |
| CONT. | — | 7.32 | — | — | 129.6 | — | — |
| RIN44 | 91124.3 | — | — | — | 140.4 | 0.13 | 8 |
| LGM9 | 92729.5 | 8.60 | 0.21 | 27 | — | — | — |
| LGM9 | 92729.6 | 9.78 | 0.28 | 44 | 197.8 | 0.29 | 52 |
| LGM4 | 93995.2 | 7.70 | 0.22 | 13 | — | — | — |
| LGM4 | 93995.3 | 7.85 | 0.09 | 16 | 149.1 | 0.05 | 15 |
| LGM4 | 93995.4 | 8.97 | 0.06 | 32 | 173.2 | 0.07 | 33 |
| LGM4 | 93996.2 | 9.80 | 0.02 | 44 | 185.3 | 0.03 | 42 |
| LGM23 | 96236.3 | 8.57 | 0.05 | 26 | 157.9 | 0.09 | 21 |
| LGM21 | 93794.1 | 8.85 | 0.01 | 30 | 158.3 | 0.06 | 22 |
| LGM21 | 93794.3 | 7.92 | 0.25 | 17 | 150.2 | 0.26 | 15 |
| LGM2 | 92804.3 | 7.50 | 0.24 | 11 | 147.4 | 0.29 | 13 |
| LGM2 | 92806.1 | 9.03 | 0.23 | 33 | 174.7 | 0.11 | 34 |
| LGM2 | 92808.1 | 9.90 | 0.03 | 46 | 199.6 | 0.04 | 53 |
| LGM16 | 92370.1 | 8.75 | 0.12 | 29 | 159.8 | 0.22 | 23 |
| LGM16 | 92372.2 | 8.57 | 0.09 | 26 | 152.7 | 0.09 | 17 |
| LGM16 | 92373.1 | 7.60 | 0.03 | 12 | 155.0 | 0.02 | 19 |
| LGM16 | 92373.2 | 8.20 | 0.12 | 21 | 159.1 | 0.10 | 22 |
| LGM16 | 92373.5 | — | — | — | 145.6 | 0.23 | 12 |
| LGM13 | 92506.2 | 7.40 | 0.03 | 9 | 144.0 | 0.01 | 11 |
| LGM13 | 92507.1 | 7.35 | 0.11 | 8 | — | — | — |
| CONT. | — | 6.79 | — | — | 130.2 | — | — |
| LGM16 | 92369.1 | 9.92 | 0.05 | 22 | 153.6 | 0.11 | 19 |
| LGM16 | 92373.1 | — | — | — | 159.3 | 0.25 | 24 |
| LGM16 | 92373.2 | — | — | — | 141.1 | 0.24 | 10 |
| CONT. | — | 8.13 | — | — | 128.8 | — | — |
| RIN44 | 91123.3 | 11.9 | L | 60 | 202.2 | L | 56 |
| RIN44 | 91124.1 | 9.28 | 0.28 | 25 | — | — | — |
| RIN44 | 91124.3 | 11.4 | 0.01 | 54 | 188.8 | L | 45 |
| LGM23 | 96234.1 | 11.2 | L | 51 | 192.3 | L | 48 |
| LGM23 | 96234.4 | 10.7 | 0.03 | 44 | 174.6 | 0.04 | 34 |
| LGM23 | 96234.5 | 11.3 | 0.06 | 53 | 197.8 | 0.06 | 52 |
| LGM23 | 96236.2 | 9.40 | 0.07 | 27 | 158.0 | 0.09 | 22 |
| LGM23 | 96236.5 | 8.40 | 0.16 | 13 | 150.5 | 0.09 | 16 |
| LGM22 | 96864.2 | 15.2 | L | 105 | 268.1 | 0.02 | 106 |
| LGM22 | 96867.1 | 14.1 | L | 91 | 232.8 | L | 79 |
| LGM22 | 96869.2 | 9.30 | L | 26 | 165.1 | L | 27 |
| LGM22 | 96869.3 | 12.3 | 0.02 | 67 | 221.1 | 0.02 | 70 |
| CONT. | — | 7.40 | — | — | 130.0 | — | — |
| RIN44 | 72527.2 | 6.60 | 0.27 | 34 | 126.7 | 0.10 | 41 |
| CONT. | — | 4.93 | — | — | 89.8 | — | — |
| MGP40 | 96913.3 | 15.5 | 0.04 | 85 | 254.4 | 0.05 | 84 |
| MGP40 | 96914.1 | 12.5 | 0.02 | 49 | 191.6 | 0.02 | 38 |
| MGP40 | 96914.2 | 10.6 | 0.04 | 26 | 163.9 | 0.20 | 18 |
| MGP40 | 96914.3 | 9.32 | 0.30 | 11 | — | — | — |
| MGP27 | 96818.2 | 9.50 | 0.03 | 13 | 147.0 | 0.16 | 6 |
| MGP27 | 96818.3 | 12.7 | 0.06 | 51 | 200.5 | 0.05 | 45 |
| MGP27 | 96820.1 | 12.5 | L | 49 | 203.3 | L | 47 |
| MGP27 | 96820.2 | 10.1 | L | 20 | 162.1 | 0.17 | 17 |
| MGP27 | 96820.6 | 10.7 | 0.21 | 27 | 175.8 | 0.24 | 27 |
| MGP26 | 96924.1 | 13.6 | L | 62 | 219.1 | L | 58 |
| MGP26 | 96924.2 | 11.1 | 0.07 | 32 | 174.1 | 0.25 | 26 |
| MGP26 | 96925.1 | 14.1 | L | 67 | 221.2 | L | 60 |
| MGP26 | 96927.1 | 13.8 | 0.04 | 64 | 238.9 | 0.02 | 73 |
| MGP26 | 96927.4 | 9.45 | 0.12 | 13 | 150.2 | 0.17 | 8 |
| MGP25 | 95718.2 | 11.1 | 0.22 | 32 | 190.3 | 0.29 | 37 |
| MGP25 | 95720.1 | 11.1 | 0.06 | 32 | 177.0 | 0.05 | 28 |
| MGP25 | 95720.4 | 14.8 | 0.08 | 77 | 232.6 | 0.05 | 68 |
| MGP22 | 97008.4 | 10.4 | L | 24 | 170.0 | L | 23 |
| MGP22 | 97009.1 | 13.8 | L | 64 | 215.3 | 0.03 | 56 |
| MGP22 | 97009.2 | 10.7 | 0.03 | 27 | 167.0 | 0.21 | 21 |
| MGP22 | 97009.3 | 12.9 | 0.02 | 53 | 217.2 | 0.04 | 57 |
| MGP22 | 97009.4 | 11.2 | L | 33 | 192.7 | 0.03 | 39 |
| MGP18 | 96854.2 | 10.2 | 0.02 | 22 | 163.4 | 0.05 | 18 |
| MGP18 | 96855.1 | 11.1 | 0.06 | 32 | — | — | — |
| MGP18 | 96856.3 | 14.0 | 0.03 | 66 | 255.9 | 0.02 | 85 |
| MGP18 | 96856.4 | 12.7 | L | 52 | 198.4 | 0.08 | 43 |
| CONT. | — | 8.39 | — | — | 138.5 | — | — |
| RIN44 | 91123.3 | 10.6 | 0.28 | 25 | — | — | — |
| RIN44 | 91123.4 | 11.5 | L | 35 | 209.5 | 0.06 | 37 |
| RIN44 | 91124.1 | 9.23 | 0.21 | 9 | — | — | — |
| LGM9 | 92729.4 | 9.70 | L | 14 | 171.6 | 0.07 | 13 |
| LGM9 | 92731.2 | 10.7 | L | 26 | 189.0 | L | 24 |
| LGM8 | 92647.2 | 10.5 | 0.12 | 24 | 195.9 | 0.05 | 28 |
| LGM8 | 92648.1 | 9.88 | 0.17 | 16 | — | — | — |
| LGM4 | 93995.1 | 9.80 | 0.15 | 16 | 173.8 | 0.10 | 14 |
| LGM4 | 93995.2 | 10.4 | 0.14 | 23 | 186.6 | 0.11 | 22 |
| LGM4 | 93995.3 | 9.83 | 0.29 | 16 | 181.3 | 0.17 | 19 |
| LGM4 | 93996.3 | 12.3 | L | 46 | 213.7 | L | 40 |
| LGM23 | 96234.1 | 9.75 | 0.03 | 15 | 173.0 | 0.04 | 13 |
| LGM23 | 96234.5 | 9.65 | 0.18 | 14 | — | — | — |
| LGM23 | 96236.2 | 10.1 | 0.09 | 18 | — | — | — |
| LGM22 | 96864.1 | 12.0 | 0.10 | 41 | 209.9 | 0.07 | 38 |
| LGM22 | 96864.2 | — | — | — | 182.7 | 0.26 | 20 |
| LGM22 | 96864.4 | 9.53 | 0.17 | 12 | — | — | — |
| LGM22 | 96869.4 | 10.9 | 0.08 | 29 | 188.9 | 0.22 | 24 |
| LGM21 | 93794.1 | 9.90 | 0.09 | 17 | 175.5 | 0.20 | 15 |
| LGM21 | 93794.3 | 9.67 | 0.27 | 14 | — | — | — |
| LGM21 | 93795.2 | 10.0 | 0.15 | 18 | — | — | — |
| LGM21 | 93798.1 | 11.3 | L | 33 | 201.4 | 0.07 | 32 |
| LGM2 | 92804.1 | 10.8 | 0.05 | 27 | 193.1 | 0.02 | 27 |
| LGM2 | 92804.2 | 10.8 | 0.05 | 27 | 185.7 | 0.10 | 22 |
| LGM2 | 92804.3 | 11.4 | L | 35 | 200.7 | 0.01 | 32 |
| LGM16 | 92369.1 | 12.5 | 0.04 | 48 | 197.8 | 0.02 | 30 |
| LGM16 | 92370.1 | 10.8 | 0.22 | 27 | — | — | — |
| LGM16 | 92373.5 | 11.5 | L | 36 | 188.4 | 0.06 | 24 |
| LGM13 | 92504.1 | 9.27 | 0.24 | 9 | — | — | — |
| LGM13 | 92504.2 | 11.8 | 0.08 | 40 | 200.4 | 0.15 | 31 |
| LGM13 | 92507.1 | 10.7 | 0.13 | 26 | 183.9 | 0.25 | 21 |
| LGM13 | 92507.5 | 11.1 | 0.04 | 30 | 192.8 | 0.01 | 26 |
| CONT. | — | 8.48 | — | — | 152.5 | — | — |
| LGD6 | 94015.2 | 8.60 | 0.14 | 16 | 139.8 | 0.22 | 16 |
| LGD6 | 94016.2 | 8.82 | 0.09 | 19 | 153.0 | 0.04 | 27 |
| LGD24 | 94238.3 | 10.8 | L | 46 | 173.2 | L | 44 |
| LGD24 | 94238.4 | 10.0 | L | 35 | 161.0 | L | 33 |
| LGD24 | 94240.2 | 9.28 | 0.15 | 25 | 159.5 | 0.11 | 32 |
| LGD24 | 94240.5 | 8.10 | 0.27 | 9 | — | — | — |
| LGD21 | 94233.1 | 9.38 | 0.05 | 26 | 168.6 | 0.02 | 40 |
| LGD21 | 94233.3 | 10.2 | L | 37 | 157.6 | L | 31 |
| LGD21 | 94236.1 | 9.32 | 0.02 | 26 | 151.0 | L | 25 |
| LGD19 | 93705.1 | 9.65 | L | 30 | 152.1 | 0.08 | 26 |
| LGD19 | 93705.2 | 9.83 | 0.14 | 33 | 169.0 | 0.17 | 40 |
| LGD19 | 93705.3 | 11.1 | 0.06 | 49 | 188.4 | 0.06 | 56 |
| LGD18 | 94694.3 | 9.42 | 0.13 | 27 | 151.5 | 0.11 | 26 |
| LGD18 | 94696.1 | 10.9 | L | 47 | 175.1 | 0.02 | 45 |
| LGD18 | 94699.2 | 8.55 | 0.23 | 15 | — | — | — |
| LGD17 | 94009.1 | 8.00 | 0.24 | 8 | 132.5 | 0.14 | 10 |
| LGD17 | 94011.1 | 10.2 | 0.07 | 38 | 170.1 | 0.10 | 41 |
| LGD17 | 94012.1 | 8.27 | 0.06 | 12 | — | — | — |

TABLE 192-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LGD17 | 94013.4 | 7.80 | 0.24 | 5 | — | — | — |
| LGD16 | 94228.1 | 8.62 | 0.26 | 16 | — | — | — |
| LGD16 | 94228.3 | — | — | — | 137.2 | 0.16 | 14 |
| LGD16 | 94230.4 | 10.6 | 0.08 | 42 | 170.8 | 0.04 | 42 |
| LGD16 | 94230.5 | 10.5 | L | 41 | 165.3 | L | 37 |
| LGD16 | 94230.6 | 8.72 | 0.02 | 18 | 134.2 | 0.29 | 11 |
| LGD15 | 94034.2 | 8.38 | 0.19 | 13 | — | — | — |
| CONT. | — | 7.41 | — | — | 120.7 | — | — |
| MGP42 | 94562.3 | 8.12 | 0.13 | 40 | 161.9 | 0.19 | 38 |
| MGP42 | 94563.4 | 7.95 | 0.12 | 37 | 156.7 | 0.13 | 34 |
| MGP42 | 94566.5 | 6.40 | 0.01 | 10 | 132.1 | 0.04 | 13 |
| MGP39 | 94592.2 | 7.10 | L | 22 | 147.0 | L | 26 |
| MGP34 | 96354.1 | 7.15 | 0.01 | 23 | 137.6 | 0.02 | 18 |
| MGP34 | 96356.1 | 7.62 | 0.12 | 31 | 146.1 | 0.13 | 25 |
| MGP23 | 96343.3 | 6.43 | L | 11 | — | — | — |
| MGP23 | 96344.1 | 6.68 | 0.12 | 15 | 156.2 | 0.21 | 33 |
| MGP23 | 96344.3 | 7.22 | 0.09 | 24 | 140.2 | 0.07 | 20 |
| MGP17 | 96306.1 | 7.22 | 0.26 | 24 | 146.4 | 0.18 | 25 |
| MGP17 | 96306.3 | 8.75 | 0.19 | 51 | 165.2 | 0.27 | 41 |
| MGP17 | 96309.2 | 7.30 | 0.03 | 26 | 149.4 | L | 28 |
| MGP15 | 94826.1 | 6.53 | 0.14 | 12 | 133.7 | 0.14 | 14 |
| MGP15 | 94827.2 | 6.85 | 0.11 | 18 | 178.4 | 0.21 | 52 |
| MGP15 | 94828.2 | 7.30 | L | 26 | 143.1 | 0.01 | 22 |
| MGP15 | 94830.3 | 7.58 | L | 30 | 160.6 | 0.20 | 37 |
| CONT. | — | 5.81 | — | — | 117.1 | — | — |
| MGP42 | 94562.2 | 8.60 | 0.04 | 33 | 142.7 | 0.15 | 23 |
| MGP42 | 94566.3 | 8.60 | 0.14 | 33 | 148.5 | 0.19 | 28 |
| MGP42 | 94566.5 | 7.65 | 0.14 | 18 | — | — | — |
| MGP39 | 94594.1 | 7.85 | 0.12 | 21 | — | — | — |
| MGP39 | 94596.2 | 8.33 | 0.05 | 28 | 137.8 | 0.04 | 19 |
| MGP39 | 94597.2 | 7.75 | 0.18 | 20 | — | — | — |
| MGP21 | 94569.2 | 7.85 | L | 21 | 135.5 | 0.02 | 17 |
| MGP21 | 94572.1 | 7.50 | 0.15 | 16 | — | — | — |
| MGP21 | 94572.2 | 10.5 | 0.03 | 62 | 171.6 | 0.08 | 48 |
| MGP21 | 94573.1 | 9.65 | L | 49 | 160.2 | 0.02 | 38 |
| MGP20 | 94575.1 | 8.72 | L | 35 | 135.7 | 0.24 | 17 |
| MGP20 | 94579.1 | 10.2 | 0.02 | 57 | 158.5 | 0.05 | 37 |
| MGP20 | 94579.4 | 8.78 | 0.03 | 35 | — | — | — |
| MGP16 | 95060.1 | 9.53 | 0.02 | 47 | 173.6 | 0.02 | 50 |
| MGP16 | 95392.1 | 8.68 | L | 34 | 143.7 | 0.13 | 24 |
| MGP16 | 95392.2 | 8.57 | 0.13 | 32 | — | — | — |
| MGP16 | 95393.1 | 9.62 | L | 49 | 157.5 | 0.03 | 36 |
| MGP15 | 94826.1 | 7.85 | 0.01 | 21 | 128.6 | 0.17 | 11 |
| MGP15 | 94827.2 | 8.53 | 0.04 | 32 | 147.7 | 0.19 | 27 |
| MGP15 | 94828.2 | 11.2 | 0.03 | 73 | 190.4 | 0.02 | 64 |
| MGP15 | 94830.3 | 7.73 | 0.06 | 19 | — | — | — |
| CONT. | — | 6.48 | — | — | 115.9 | — | — |
| LGM2 | 92804.2 | 12.4 | L | 34 | 217.5 | L | 41 |
| LGM2 | 92804.4 | 14.5 | 0.03 | 56 | 242.4 | L | 58 |
| LGM2 | 92806.3 | — | — | — | 182.4 | 0.30 | 19 |
| LGM13 | 92504.2 | 10.6 | 0.29 | 14 | 178.3 | 0.25 | 16 |
| CONT. | — | 9.28 | — | — | 153.7 | — | — |

Table 192.
"CONT." = Control;
"Ave." = Average;
"% Incr." = % increment;
"p-val." = p-value,
L = p < 0.01.

TABLE 193

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGD7 | 95622.1 | 0.897 | 0.14 | 30 | 13.8 | 0.04 | 36 | 7.80 | 0.02 | 6 |
| LGD7 | 95622.2 | 0.827 | 0.05 | 20 | 12.8 | 0.02 | 27 | — | — | — |
| LGD7 | 95625.1 | 0.835 | L | 21 | 12.0 | 0.15 | 18 | — | — | — |
| LGD14 | 96776.3 | 0.763 | 0.14 | 11 | 12.6 | L | 24 | 7.74 | L | 6 |
| LGD14 | 96776.5 | 0.824 | 0.15 | 20 | 11.9 | 0.23 | 18 | 7.57 | 0.25 | 3 |
| LGD14 | 96778.1 | — | — | — | 11.6 | 0.26 | 14 | 7.58 | 0.15 | 3 |
| CONT. | — | 0.688 | — | — | 10.1 | — | — | 7.33 | — | — |
| LGB8 | 96534.3 | 0.840 | 0.18 | 11 | — | — | — | — | — | — |
| LGB4 | 96493.1 | — | — | — | — | — | — | 8.17 | 0.19 | 5 |
| LGB14 | 96600.4 | — | — | — | 13.1 | L | 16 | 7.94 | 0.23 | 2 |
| LGB1 | 95791.1 | 0.801 | 0.24 | 5 | — | — | — | — | — | — |
| CONT. | — | 0.760 | — | — | 11.2 | — | — | 7.81 | — | — |
| LGB5 | 94192.1 | — | — | — | 10.5 | 0.09 | 19 | — | — | — |
| LGB5 | 94192.3 | 0.803 | 0.23 | 18 | 10.6 | 0.14 | 20 | — | — | — |
| LGB5 | 94193.1 | — | — | — | 9.56 | 0.23 | 9 | — | — | — |
| LGB5 | 94193.2 | 0.742 | 0.23 | 9 | — | — | — | — | — | — |
| LGB2 | 94882.3 | 0.817 | 0.19 | 20 | 10.7 | 0.15 | 21 | 7.88 | 0.15 | 3 |
| LGB2 | 94884.1 | 0.770 | 0.11 | 13 | — | — | — | — | — | — |
| LGB16 | 94701.3 | — | — | — | 10.2 | 0.25 | 15 | — | — | — |
| LCB16 | 94702.2 | — | — | — | — | — | — | 8.05 | L | 6 |
| LGB16 | 94702.4 | 0.766 | 0.07 | 12 | — | — | — | — | — | — |
| LGB16 | 94702.5 | 0.743 | 0.04 | 9 | — | — | — | — | — | — |
| LGB15 | 93971.4 | 0.824 | L | 21 | — | — | — | — | — | — |
| LGB15 | 93971.6 | 0.889 | 0.11 | 30 | 11.4 | 0.01 | 29 | — | — | — |
| LGB11 | 93849.4 | 0.829 | 0.16 | 21 | — | — | — | 8.01 | 0.02 | 5 |
| LGB11 | 93849.5 | 0.802 | 0.02 | 18 | 11.3 | 0.03 | 29 | — | — | — |
| LGB11 | 93850.1 | 0.782 | 0.16 | 15 | 10.9 | 0.08 | 23 | — | — | — |

TABLE 193-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.682 | — | — | 8.81 | — | — | 7.63 | — | — |
| MGP38 | 96042.4 | 0.662 | 0.14 | 7 | 13.2 | L | 40 | — | — | — |
| MGP38 | 96043.2 | 0.706 | 0.10 | 14 | 12.5 | 0.03 | 33 | 8.11 | 0.11 | 4 |
| MGP38 | 96043.4 | — | — | — | — | — | — | 8.01 | 0.13 | 2 |
| MGP38 | 96045.1 | 0.809 | L | 30 | 15.5 | L | 65 | — | — | — |
| MGP38 | 96045.2 | — | — | — | 12.1 | L | 29 | — | — | — |
| MGP35 | 96180.3 | 0.753 | L | 22 | 13.7 | 0.03 | 45 | 8.29 | 0.04 | 6 |
| MGP35 | 96181.2 | — | — | — | 11.7 | 0.07 | 25 | — | — | — |
| MGP35 | 96184.1 | 0.708 | 0.09 | 14 | 14.4 | L | 53 | 8.24 | 0.02 | 5 |
| MGP35 | 96184.3 | — | — | — | 13.0 | L | 38 | 8.14 | 0.03 | 4 |
| MCP34 | 96354.1 | 0.860 | 0.02 | 39 | 13.8 | L | 47 | — | — | — |
| MGP34 | 96354.3 | 0.692 | 0.06 | 12 | 15.2 | L | 62 | 8.21 | 0.07 | 5 |
| MGP34 | 96356.1 | — | — | — | 10.9 | 0.10 | 16 | — | — | — |
| MGP34 | 96356.2 | 0.698 | 0.24 | 13 | 13.7 | L | 46 | 7.99 | 0.18 | 2 |
| MGP34 | 96356.3 | 0.836 | 0.02 | 35 | 15.1 | L | 61 | — | — | — |
| MGP33 | 96055.3 | — | — | — | 10.5 | 0.11 | 12 | — | — | — |
| MGP33 | 96056.2 | 0.856 | L | 38 | 14.9 | L | 58 | — | — | — |
| MGP33 | 96056.3 | 0.654 | 0.09 | 5 | 11.8 | 0.08 | 25 | — | — | — |
| MGP33 | 96057.3 | 0.766 | 0.12 | 24 | 11.6 | 0.07 | 24 | — | — | — |
| MGP33 | 96057.4 | — | — | — | 12.5 | 0.09 | 33 | — | — | — |
| MGP28 | 96288.2 | — | — | — | 13.5 | 0.04 | 44 | 8.23 | L | 5 |
| MGP28 | 96289.2 | 0.696 | 0.18 | 12 | 12.8 | 0.01 | 37 | — | — | — |
| MGP28 | 96289.4 | 0.764 | 0.05 | 23 | 15.2 | 0.02 | 62 | 8.20 | 0.14 | 5 |
| MGP28 | 96290.3 | — | — | — | 13.1 | L | 39 | — | — | — |
| MGP28 | 96290.4 | — | — | — | 13.0 | L | 39 | — | — | — |
| MGP23 | 96343.3 | — | — | — | 11.5 | 0.15 | 22 | — | — | — |
| MGP23 | 96343.4 | 0.674 | 0.13 | 9 | 15.5 | L | 65 | 8.30 | L | 6 |
| MGP23 | 96344.3 | 0.669 | 0.19 | 8 | 13.5 | 0.05 | 44 | 8.17 | L | 4 |
| MGP17 | 96306.1 | — | — | — | 11.4 | 0.07 | 22 | 8.15 | 0.23 | 4 |
| MGP17 | 96306.3 | 0.752 | 0.27 | 21 | 12.6 | 0.07 | 34 | — | — | — |
| MGP17 | 96309.1 | — | — | — | 12.4 | 0.02 | 32 | — | — | — |
| MGP17 | 96309.2 | — | — | — | 10.4 | 0.27 | 11 | — | — | — |
| MGP17 | 96309.3 | 0.718 | 0.02 | 16 | 14.4 | L | 53 | 8.12 | 0.05 | 4 |
| CONT. | — | 0.620 | — | — | 9.41 | — | — | 7.82 | — | — |
| RIN44 | 91124.3 | 0.768 | 0.20 | 7 | — | — | — | 7.93 | 0.07 | 5 |
| LGM9 | 92729.5 | 0.857 | 0.15 | 19 | 11.7 | 0.27 | 16 | — | — | — |
| LGM8 | 92646.3 | — | — | — | 10.7 | 0.24 | 6 | 8.19 | L | 8 |
| LGM8 | 92647.1 | — | — | — | — | — | — | 7.90 | 0.06 | 4 |
| LGM4 | 93995.2 | 0.798 | 0.22 | 11 | — | — | — | 7.95 | 0.02 | 5 |
| LGM4 | 93995.3 | 0.839 | L | 16 | — | — | — | 7.70 | 0.23 | 2 |
| LGM4 | 93995.4 | 0.930 | 0.01 | 29 | 11.2 | 0.16 | 11 | 7.90 | 0.17 | 4 |
| LGM4 | 93996.2 | 1.01 | L | 40 | 12.7 | 0.07 | 25 | 7.96 | L | 5 |
| LGM23 | 96234.1 | — | — | — | — | — | — | 8.05 | 0.01 | 6 |
| LGM23 | 96236.3 | 0.845 | 0.04 | 17 | — | — | — | — | — | — |
| LGM23 | 96236.5 | — | — | — | — | — | — | 7.81 | 0.11 | 3 |
| LGM21 | 93794.1 | 0.830 | 0.17 | 15 | 13.4 | 0.04 | 32 | — | — | — |
| LGM21 | 93794.3 | 0.785 | 0.22 | 9 | — | — | — | — | — | — |
| LGM2 | 92804.3 | 0.782 | 0.01 | 8 | 12.1 | 0.28 | 19 | — | — | — |
| LGM2 | 92806.1 | 0.878 | 0.13 | 22 | — | — | — | — | — | — |
| LGM2 | 92806.3 | — | — | — | 12.3 | 0.27 | 21 | — | — | — |
| LGM2 | 92808.1 | 0.985 | 0.01 | 37 | 14.9 | L | 47 | — | — | — |
| LGM2 | 92808.2 | — | — | — | 13.8 | 0.14 | 36 | — | — | — |
| LGM16 | 92370.1 | 0.874 | 0.11 | 21 | — | — | — | — | — | — |
| LGM16 | 92372.2 | 0.825 | 0.04 | 14 | 16.3 | L | 61 | — | — | — |
| LGM13 | 92506.2 | 0.796 | L | 10 | — | — | — | 7.85 | 0.12 | 4 |
| LGM13 | 92506.3 | 0.815 | 0.25 | 13 | — | — | — | — | — | — |
| LGM13 | 92507.1 | 0.790 | 0.25 | 10 | — | — | — | — | — | — |
| CONT. | — | 0.721 | — | — | 10.1 | — | — | 7.57 | — | — |
| LGM16 | 92369.1 | 0.772 | 0.03 | 12 | 9.89 | 0.08 | 22 | — | — | — |
| LGM16 | 92373.2 | — | — | — | 8.52 | 0.26 | 5 | — | — | — |
| CONT. | — | 0.690 | — | — | 8.08 | — | — | — | — | — |
| RIN44 | 91123.3 | 0.849 | L | 39 | 11.5 | 0.21 | 28 | — | — | — |
| RIN44 | 91124.3 | 0.856 | L | 40 | 11.2 | 0.15 | 24 | — | — | — |
| LGM23 | 96234.1 | 0.781 | 0.08 | 28 | 11.4 | L | 26 | 7.59 | 0.13 | 9 |
| LGM23 | 96234.4 | 0.781 | 0.02 | 28 | 12.0 | 0.16 | 32 | — | — | — |
| LGM23 | 96234.5 | 0.854 | L | 40 | 13.0 | 0.02 | 44 | 7.54 | 0.10 | 8 |
| LGM23 | 96236.2 | 0.715 | 0.02 | 17 | 10.6 | 0.03 | 17 | — | — | — |
| LGM22 | 96864.2 | 0.952 | 0.02 | 56 | 11.8 | 0.10 | 31 | — | — | — |
| LGM22 | 96867.1 | 0.929 | L | 52 | 10.3 | 0.12 | 14 | — | — | — |
| LGM22 | 96869.2 | 0.772 | L | 26 | 10.8 | 0.13 | 19 | 7.21 | 0.05 | 3 |
| LGM22 | 96869.3 | 0.853 | L | 40 | 12.6 | 0.02 | 40 | 7.74 | 0.07 | 11 |

TABLE 193-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
| --- | --- | --- | --- | --- | --- | --- | --- | --- | --- | --- |
| | | Ave. | P-Val. | % Incr. | Ave. | P-Val. | % Incr. | Ave. | P-Val. | % Incr. |
| CONT. | — | 0.611 | — | — | 9.05 | — | — | 6.98 | — | — |
| MGP40 | 96913.3 | 0.890 | 0.05 | 42 | 16.6 | L | 60 | 8.22 | L | 14 |
| MGP40 | 96914.1 | 0.792 | 0.01 | 26 | 16.7 | L | 60 | 7.85 | 0.07 | 9 |
| MGP40 | 96914.2 | 0.754 | 0.04 | 20 | 14.7 | L | 42 | 7.78 | L | 8 |
| MGP40 | 96914.3 | — | — | — | 13.2 | 0.10 | 27 | — | — | — |
| MGP27 | 96818.2 | 0.671 | 0.24 | 7 | 14.2 | L | 37 | 7.82 | L | 9 |
| MGP27 | 96818.3 | 0.810 | 0.04 | 29 | 16.2 | 0.02 | 56 | 7.70 | 0.07 | 7 |
| MGP27 | 96820.1 | 0.757 | L | 20 | 15.1 | L | 46 | 7.62 | 0.08 | 6 |
| MGP27 | 96820.2 | 0.743 | L | 18 | 15.1 | L | 46 | 8.00 | L | 11 |
| MGP27 | 96820.6 | 0.714 | 0.20 | 14 | 16.1 | 0.08 | 55 | 8.05 | L | 12 |
| MGP26 | 96924.1 | 0.882 | L | 40 | 13.6 | L | 31 | 7.59 | 0.16 | 5 |
| MGP26 | 96924.2 | 0.706 | 0.25 | 12 | 13.3 | 0.10 | 28 | — | — | — |
| MGP26 | 96925.1 | 0.831 | L | 32 | 14.5 | L | 39 | — | — | — |
| MGP26 | 96927.1 | 0.876 | 0.01 | 39 | 15.2 | L | 46 | 7.71 | L | 7 |
| MGP26 | 96927.4 | — | — | — | 15.6 | 0.02 | 50 | 7.68 | 0.03 | 7 |
| MGP25 | 95718.2 | 0.776 | 0.24 | 23 | 13.2 | 0.25 | 27 | — | — | — |
| MGP25 | 95720.1 | 0.763 | 0.03 | 21 | 14.7 | 0.03 | 42 | 7.60 | 0.16 | 6 |
| MGP25 | 95720.4 | 0.841 | 0.05 | 34 | 15.6 | 0.03 | 50 | 7.81 | 0.13 | 8 |
| MGP22 | 97008.4 | 0.711 | L | 13 | 12.8 | 0.15 | 23 | — | — | — |
| MGP22 | 97009.1 | 0.921 | 0.02 | 46 | 17.5 | 0.01 | 68 | 7.79 | L | 8 |
| MGP22 | 97009.2 | 0.755 | 0.04 | 20 | 16.1 | 0.06 | 55 | 7.86 | L | 9 |
| MGP22 | 97009.3 | 0.842 | L | 34 | 15.4 | L | 48 | 7.65 | 0.01 | 6 |
| MGP22 | 97009.4 | 0.808 | L | 29 | 14.5 | 0.02 | 40 | 7.84 | 0.02 | 9 |
| MGP18 | 96854.2 | — | — | — | 11.8 | 0.13 | 14 | — | — | — |
| MGP18 | 96856.3 | 0.878 | 0.02 | 40 | 15.2 | 0.01 | 46 | 7.70 | 0.03 | 7 |
| MGP18 | 96856.4 | 0.793 | 0.18 | 26 | 14.4 | 0.22 | 38 | — | — | — |
| CONT. | — | 0.629 | — | — | 10.4 | — | — | 7.20 | — | — |
| RIN44 | 91123.4 | 0.942 | L | 12 | — | — | — | — | — | — |
| RIN44 | 91124.1 | 0.923 | 0.09 | 9 | — | — | — | 7.99 | 0.06 | 5 |
| LGM9 | 92729.4 | 1.08 | L | 27 | — | — | — | — | — | — |
| LGM9 | 92731.2 | 0.985 | 0.01 | 17 | 14.6 | L | 17 | 7.98 | 0.02 | 5 |
| LGM8 | 92646.3 | — | — | — | — | — | — | 8.04 | L | 5 |
| LGM8 | 92647.1 | 1.01 | 0.01 | 19 | — | — | — | 7.89 | 0.22 | 3 |
| LGM8 | 92647.2 | 1.02 | 0.04 | 21 | 14.0 | 0.19 | 12 | 8.16 | L | 7 |
| LGM8 | 92648.1 | 0.947 | 0.18 | 12 | — | — | — | 8.11 | 0.15 | 6 |
| LGM4 | 93995.1 | 1.03 | 0.03 | 22 | — | — | — | — | — | — |
| LGM4 | 93995.2 | 1.03 | 0.05 | 22 | 14.1 | 0.28 | 12 | 8.17 | L | 7 |
| LGM4 | 93995.3 | 0.953 | 0.19 | 13 | — | — | — | 7.89 | 0.18 | 3 |
| LGM4 | 93995.4 | 1.05 | 0.13 | 24 | — | — | — | — | — | — |
| LGM4 | 93996.3 | 1.09 | L | 29 | 16.7 | L | 34 | 7.91 | 0.28 | 4 |
| LGM23 | 96234.1 | 1.05 | L | 24 | — | — | — | — | — | — |
| LGM23 | 96234.5 | 1.04 | 0.16 | 23 | — | — | — | — | — | — |
| LGM23 | 96236.2 | 0.979 | 0.14 | 16 | — | — | — | — | — | — |
| LGM23 | 96236.3 | 0.895 | 0.29 | 6 | — | — | — | — | — | — |
| LGM22 | 96864.1 | 1.05 | L | 24 | 15.0 | 0.06 | 20 | — | — | — |
| LGM22 | 96864.2 | 0.986 | 0.10 | 17 | — | — | — | — | — | — |
| LGM22 | 96864.4 | 0.987 | 0.05 | 17 | 13.9 | 0.25 | 11 | 8.19 | 0.04 | 7 |
| LGM22 | 96869.2 | 0.920 | 0.12 | 9 | 13.6 | 0.15 | 9 | 7.89 | 0.30 | 3 |
| LGM22 | 96869.4 | 0.958 | 0.05 | 13 | — | — | — | — | — | — |
| LGM21 | 93794.1 | 0.906 | 0.24 | 7 | — | — | — | — | — | — |
| LGM21 | 93794.3 | 0.972 | 0.15 | 15 | — | — | — | — | — | — |
| LGM21 | 93795.2 | 0.945 | 0.23 | 12 | 13.7 | 0.16 | 9 | 8.11 | L | 6 |
| LGM21 | 93798.1 | 1.02 | L | 21 | 14.7 | 0.11 | 17 | 8.00 | 0.16 | 5 |
| LGM12 | 92804.1 | 1.03 | L | 22 | 15.5 | L | 24 | — | — | — |
| LGM2 | 92804.2 | 0.998 | L | 18 | 15.8 | L | 26 | — | — | — |
| LGM2 | 92804.3 | 1.12 | 0.01 | 32 | 16.8 | L | 35 | — | — | — |
| LGM2 | 92806.3 | 0.897 | 0.19 | 6 | 16.5 | 0.02 | 32 | — | — | — |
| LGM16 | 92369.1 | 1.03 | 0.03 | 22 | — | — | — | — | — | — |
| LGM16 | 92370.1 | 0.998 | 0.11 | 18 | — | — | — | — | — | — |
| LGM16 | 92373.5 | 1.02 | L | 21 | 14.9 | 0.03 | 19 | 7.87 | 0.10 | 3 |
| LGM13 | 92504.1 | 0.989 | L | 17 | — | — | — | 7.79 | 0.26 | 2 |
| LGM13 | 92504.2 | 1.06 | 0.07 | 25 | — | — | — | — | — | — |
| LGM13 | 92506.3 | 0.960 | 0.12 | 14 | — | — | — | — | — | — |
| LGM13 | 92507.1 | 1.05 | 0.07 | 24 | — | — | — | — | — | — |
| LGM13 | 92507.5 | 1.02 | 0.04 | 21 | 14.4 | 0.05 | 15 | 7.96 | 0.09 | 4 |
| CONT. | — | 0.845 | — | — | 12.5 | — | — | 7.63 | — | — |
| LGD6 | 94014.1 | — | — | — | 12.6 | 0.07 | 17 | 7.63 | 0.06 | 5 |
| LGD6 | 94015.2 | 0.745 | 0.15 | 6 | — | — | — | 7.57 | L | 4 |
| LGD6 | 94016.2 | 0.762 | 0.14 | 9 | — | — | — | 7.65 | 0.11 | 5 |
| LGD6 | 94018.1 | — | — | — | 12.5 | L | 16 | — | — | — |
| LGD24 | 94238.3 | 0.896 | L | 28 | — | — | — | — | — | — |

TABLE 193-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGD24 | 94238.4 | 0.878 | L | 26 | — | — | — | 7.45 | 0.25 | 3 |
| LGD24 | 94240.2 | 0.805 | 0.22 | 15 | — | — | — | — | — | — |
| LGD24 | 94240.4 | — | — | — | — | — | — | 7.66 | L | 6 |
| LGD24 | 94240.5 | 0.800 | 0.06 | 14 | — | — | — | — | — | — |
| LGD21 | 94233.1 | 0.879 | 0.01 | 26 | — | — | — | 7.80 | L | 8 |
| LGD21 | 94233.3 | 0.885 | 0.01 | 26 | 11.7 | 0.26 | 9 | 7.79 | 0.01 | 7 |
| LGD21 | 94233.4 | 0.756 | 0.24 | 8 | — | — | — | 7.61 | 0.02 | 5 |
| LGD21 | 94235.2 | 0.846 | L | 21 | — | — | — | 7.79 | 0.02 | 7 |
| LGD21 | 94236.1 | 0.806 | 0.05 | 15 | — | — | — | 7.55 | 0.06 | 4 |
| LGD19 | 93705.1 | 0.832 | 0.02 | 19 | — | — | — | — | — | — |
| LGD19 | 93705.2 | 0.844 | 0.03 | 21 | — | — | — | — | — | — |
| LGD19 | 93705.3 | 0.882 | 0.07 | 26 | — | — | — | — | — | — |
| LGD19 | 93709.2 | — | — | — | 12.4 | 0.23 | 16 | — | — | — |
| LGD18 | 94694.3 | 0.801 | 0.17 | 14 | — | — | — | 7.60 | 0.16 | 5 |
| LGD18 | 94696.1 | 0.954 | L | 36 | 12.2 | 0.29 | 13 | — | — | — |
| LGD18 | 94698.3 | — | — | — | — | — | — | 7.43 | 0.22 | 2 |
| LGD18 | 94699.2 | 0.835 | 0.03 | 19 | 13.0 | 0.06 | 21 | 7.83 | L | 8 |
| LGD17 | 94009.1 | 0.774 | 0.19 | 11 | — | — | — | 7.57 | 0.06 | 4 |
| LGD17 | 94011.1 | 0.878 | 0.06 | 25 | 12.3 | 0.19 | 15 | — | — | — |
| LGD17 | 94012.1 | — | — | — | 13.0 | 0.16 | 21 | — | — | — |
| LGD16 | 94228.1 | 0.791 | 0.17 | 13 | — | — | — | — | — | — |
| LGD16 | 94228.3 | 0.831 | 0.26 | 19 | — | — | — | 7.52 | 0.09 | 4 |
| LGD16 | 94230.4 | 0.851 | 0.05 | 22 | — | — | — | — | — | — |
| LGD16 | 94230.5 | 0.858 | L | 23 | 11.9 | 0.28 | 10 | 7.73 | 0.02 | 7 |
| LGD16 | 94230.6 | 0.750 | 0.22 | 7 | — | — | — | 7.63 | 0.24 | 5 |
| LGD15 | 94007.2 | — | — | — | — | — | — | 7.46 | 0.13 | 3 |
| LGD15 | 94034.1 | — | — | — | 12.8 | 0.03 | 19 | 7.54 | 0.02 | 4 |
| LGD15 | 94034.2 | — | — | — | — | — | — | 7.79 | L | 7 |
| LGD10 | 93829.1 | — | — | — | 12.2 | 0.29 | 14 | 7.53 | 0.24 | 4 |
| LGD10 | 93830.3 | — | — | — | — | — | — | 7.50 | 0.23 | 3 |
| LGD10 | 93832.1 | 0.738 | 0.16 | 6 | — | — | — | — | — | — |
| LGD10 | 93833.1 | — | — | — | 12.9 | 0.16 | 20 | — | — | — |
| CONT. | — | 0.700 | — | — | 10.7 | — | — | 7.25 | — | — |
| MGP42 | 94562.2 | — | — | — | 13.4 | L | 37 | 8.23 | 0.03 | 8 |
| MGP42 | 94562.3 | 0.742 | 0.20 | 12 | 12.8 | 0.05 | 30 | — | — | — |
| MGP42 | 94563.4 | — | — | — | 14.9 | 0.06 | 52 | 8.05 | 0.22 | 5 |
| MGP42 | 94566.3 | — | — | — | 11.2 | 0.07 | 14 | — | — | — |
| MGP42 | 94566.5 | — | — | — | 12.8 | 0.06 | 30 | — | — | — |
| MGP39 | 94592.2 | 0.748 | 0.06 | 13 | 12.9 | 0.02 | 32 | 8.06 | 0.02 | 5 |
| MGP39 | 94594.1 | — | — | — | 12.2 | 0.16 | 24 | — | — | — |
| MGP39 | 94596.2 | — | — | — | 12.6 | 0.15 | 28 | — | — | — |
| MGP39 | 94596.3 | — | — | — | 11.3 | 0.24 | 15 | — | — | — |
| MGP39 | 94597.2 | — | — | — | 11.2 | 0.02 | 14 | 7.99 | L | 5 |
| MGP34 | 96354.1 | — | — | — | 12.4 | 0.03 | 26 | — | — | — |
| MGP34 | 96354.3 | — | — | — | — | — | — | 8.05 | 0.26 | 5 |
| MGP34 | 96356.1 | 0.752 | 0.24 | 14 | 13.3 | 0.02 | 35 | 8.11 | 0.02 | 6 |
| MGP34 | 96356.2 | — | — | — | 11.7 | 0.20 | 19 | 7.86 | 0.14 | 3 |
| MGP34 | 96356.3 | — | — | — | 11.9 | 0.15 | 21 | — | — | — |
| MGP23 | 96343.3 | — | — | — | 11.3 | 0.07 | 15 | — | — | — |
| MGP23 | 96343.4 | — | — | — | 12.1 | 0.10 | 23 | — | — | — |
| MGP23 | 96344.1 | — | — | — | 12.3 | L | 26 | — | — | — |
| MGP23 | 96344.3 | 0.720 | 0.27 | 9 | 12.8 | 0.03 | 30 | 8.13 | L | 6 |
| MGP17 | 96306.1 | — | — | — | 13.3 | 0.07 | 36 | — | — | — |
| MGP17 | 96306.3 | 0.799 | 0.04 | 21 | 13.4 | 0.03 | 36 | 7.99 | 0.13 | 5 |
| MGP17 | 96309.1 | — | — | — | 11.4 | 0.09 | 16 | — | — | — |
| MGP17 | 96309.2 | 0.708 | 0.23 | 7 | 13.9 | L | 41 | — | — | — |
| MGP15 | 94827.1 | — | — | — | 12.5 | 0.14 | 27 | — | — | — |
| MGP15 | 94827.2 | — | — | — | 12.2 | 0.23 | 25 | — | — | — |
| MGP15 | 94828.2 | 0.752 | 0.04 | 14 | 13.1 | L | 33 | — | — | — |
| MGP15 | 94830.3 | 0.727 | 0.11 | 10 | 13.4 | L | 36 | 8.23 | 0.06 | 8 |
| CONT. | — | 0.660 | — | — | 9.82 | — | — | 7.64 | — | — |
| MGP42 | 94562.2 | 0.700 | 0.19 | 14 | 12.3 | 0.04 | 29 | — | — | — |
| MGP42 | 94563.4 | — | — | — | 10.9 | 0.29 | 15 | — | — | — |
| MGP42 | 94566.3 | 0.722 | 0.09 | 18 | 12.4 | 0.01 | 30 | 8.20 | 0.12 | 4 |
| MGP42 | 94566.5 | — | — | — | 11.5 | 0.07 | 21 | 8.23 | 0.18 | 4 |
| MGP39 | 94592.2 | — | — | — | 10.7 | 0.19 | 13 | 8.21 | 0.12 | 4 |
| MGP39 | 94594.1 | 0.744 | 0.03 | 21 | 11.4 | L | 20 | 8.17 | 0.08 | 4 |
| MGP39 | 94596.2 | 0.720 | 0.02 | 18 | 11.5 | 0.13 | 21 | — | — | — |
| MGP39 | 94596.3 | — | — | — | 11.7 | 0.03 | 23 | 8.43 | L | 7 |
| MGP21 | 94569.2 | 0.725 | L | 18 | 12.0 | 0.02 | 26 | — | — | — |
| MGP21 | 94571.2 | — | — | — | 11.1 | 0.14 | 17 | — | — | — |

TABLE 193-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| MGP21 | 94572.1 | 0.695 | 0.08 | 13 | 11.3 | L | 19 | 8.55 | 0.08 | 8 |
| MGP21 | 94572.2 | 0.883 | L | 44 | 14.3 | L | 50 | 8.39 | L | 6 |
| MGP21 | 94573.1 | 0.799 | L | 30 | 12.8 | L | 34 | 8.08 | 0.13 | 2 |
| MGP20 | 94574.1 | — | — | — | 11.0 | 0.05 | 16 | — | — | — |
| MGP20 | 94574.2 | — | — | — | 12.2 | L | 28 | 8.31 | 0.02 | 5 |
| MGP20 | 94575.1 | 0.733 | L | 20 | 10.4 | 0.21 | 10 | — | — | — |
| MGP20 | 94579.1 | 0.790 | 0.12 | 29 | 14.0 | L | 47 | 8.52 | L | 8 |
| MGP20 | 94579.4 | 0.688 | 0.10 | 12 | 13.4 | 0.03 | 41 | 8.33 | 0.30 | 6 |
| MGP16 | 95060.1 | 0.765 | 0.02 | 25 | 11.3 | 0.17 | 19 | — | — | — |
| MGP16 | 95392.1 | 0.725 | L | 18 | 12.1 | 0.03 | 27 | 8.16 | 0.25 | 3 |
| MGP16 | 95392.2 | — | — | — | 11.5 | 0.14 | 22 | — | — | — |
| MGP16 | 95392.3 | — | — | — | 11.2 | 0.04 | 18 | — | — | — |
| MGP16 | 95393.1 | 0.811 | L | 32 | 12.1 | 0.11 | 27 | — | — | — |
| MGP15 | 94826.1 | — | — | — | 11.4 | 0.02 | 20 | — | — | — |
| MGP15 | 94827.1 | — | — | — | 11.1 | 0.11 | 16 | 8.11 | 0.09 | 3 |
| MGP15 | 94827.2 | 0.676 | 0.10 | 10 | — | — | — | — | — | — |
| MGP15 | 94828.2 | 0.890 | 0.01 | 45 | 14.7 | 0.01 | 55 | 8.37 | 0.09 | 6 |
| MGP15 | 94830.3 | 0.675 | 0.12 | 10 | 11.7 | 0.02 | 23 | — | — | — |
| CONT. | — | 0.613 | — | — | 9.50 | — | — | 7.89 | — | — |
| LGM2 | 92804.2 | 0.894 | L | 20 | 11.9 | L | 20 | — | — | — |
| LGM2 | 92804.3 | 0.797 | 0.19 | 7 | — | — | — | — | — | — |
| LGM2 | 92804.4 | 0.955 | 0.01 | 28 | 13.6 | 0.07 | 37 | — | — | — |
| LGM2 | 92806.3 | 0.902 | 0.15 | 21 | 12.4 | 0.03 | 26 | — | — | — |
| LGM13 | 92504.1 | 0.811 | 0.24 | 9 | — | — | — | — | — | — |
| LGM13 | 92504.2 | 0.901 | 0.08 | 21 | — | — | — | — | — | — |
| LGM13 | 92507.1 | 0.908 | 0.04 | 22 | — | — | — | — | — | — |
| LGM13 | 92507.5 | 0.803 | 0.27 | 8 | — | — | — | — | — | — |
| CONT. | — | 0.746 | — | — | 9.87 | — | — | — | — | — |

Table 193.
"CONT." = Control;
"Ave." = Average;
"% Incr." = % increment;
"p-val." = p-value,
L = p < 0.01.

TABLE 194

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGD7 | 95622.1 | 0.0922 | 0.01 | 29 | 1.68 | L | 36 | — | — | — |
| LGD7 | 95622.2 | 0.0881 | 0.02 | 23 | 1.58 | 0.02 | 27 | — | — | — |
| LGD7 | 95625.1 | 0.0874 | 0.02 | 22 | 1.47 | 0.10 | 19 | — | — | — |
| LGD14 | 96776.3 | — | — | — | 1.54 | 0.03 | 24 | — | — | — |
| LGD14 | 96776.5 | 0.0885 | 0.02 | 24 | 1.46 | 0.13 | 18 | — | — | — |
| LGD14 | 96778.1 | — | — | — | 1.42 | 0.20 | 15 | — | — | — |
| CONT. | — | 0.0716 | — | — | 1.24 | — | — | — | — | — |
| LGB14 | 96600.4 | 0.0900 | 0.29 | 13 | 1.60 | 0.19 | 16 | — | — | — |
| CONT. | — | 0.0795 | — | — | 1.37 | — | — | — | — | — |
| LGB5 | 94192.1 | — | — | — | 1.25 | 0.06 | 18 | — | — | — |
| LGB5 | 94192.3 | 0.0870 | 0.22 | 21 | 1.27 | 0.03 | 20 | 0.802 | 0.17 | 7 |
| LGB5 | 94193.1 | — | — | — | 1.17 | 0.27 | 10 | — | — | — |
| LGB5 | 94193.2 | 0.0786 | 0.21 | 9 | — | — | — | — | — | — |
| LGB2 | 94882.3 | 0.0858 | 0.22 | 20 | 1.31 | 0.02 | 23 | 0.834 | 0.02 | 12 |
| LGB2 | 94884.1 | 0.0825 | 0.25 | 15 | 1.16 | 0.28 | 10 | — | — | — |
| LGB16 | 94701.3 | — | — | — | 1.20 | 0.16 | 13 | — | — | — |
| LGB16 | 94702.2 | — | — | — | — | — | — | 0.767 | 0.10 | 3 |
| LGB16 | 94702.4 | 0.0807 | 0.10 | 12 | 1.18 | 0.22 | 11 | — | — | — |
| LGB16 | 94702.5 | 0.0756 | 0.24 | 5 | — | — | — | — | — | — |
| LGB15 | 93971.4 | 0.0877 | 0.08 | 22 | — | — | — | — | — | — |
| LGB15 | 93971.6 | 0.0943 | 0.02 | 31 | 1.36 | L | 28 | — | — | — |
| LGB11 | 93849.4 | 0.0873 | 0.11 | 22 | 1.17 | 0.26 | 10 | — | — | — |

TABLE 194-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGB11 | 93849.5 | 0.0853 | 0.02 | 19 | 1.37 | L | 30 | — | — | — |
| LGB11 | 93850.1 | 0.0830 | 0.23 | 16 | 1.31 | 0.01 | 24 | — | — | — |
| CONT. | — | 0.0718 | — | — | 1.06 | — | — | 0.748 | — | — |
| MGP38 | 96042.4 | — | — | — | 1.62 | L | 41 | — | — | — |
| MGP38 | 96043.2 | 0.0769 | 0.11 | 17 | 1.52 | L | 32 | 0.819 | 0.18 | 7 |
| MGP38 | 96043.4 | — | — | — | 1.31 | 0.20 | 14 | — | — | — |
| MGP38 | 96045.1 | 0.0877 | L | 33 | 1.90 | L | 65 | — | — | — |
| MGP38 | 96045.2 | — | — | — | 1.49 | L | 30 | — | — | — |
| MGP35 | 96180.3 | 0.0811 | 0.02 | 23 | 1.68 | L | 46 | 0.829 | 0.13 | 8 |
| MGP35 | 96181.2 | — | — | — | 1.44 | 0.02 | 25 | — | — | — |
| MGP35 | 96184.1 | 0.0745 | 0.19 | 13 | 1.77 | L | 53 | — | — | — |
| MGP35 | 96184.3 | — | — | — | 1.60 | L | 39 | — | — | — |
| MGP34 | 96354.1 | 0.0920 | L | 40 | 1.67 | L | 45 | — | — | — |
| MGP34 | 96354.3 | 0.0731 | 0.26 | 11 | 1.87 | L | 62 | — | — | — |
| MGP34 | 96356.1 | — | — | — | 1.34 | 0.11 | 16 | — | — | — |
| MGP34 | 96356.2 | 0.0736 | 0.26 | 12 | 1.68 | L | 46 | — | — | — |
| MGP34 | 96356.3 | 0.0920 | L | 40 | 1.86 | L | 62 | — | — | — |
| MGP33 | 96055.3 | — | — | — | 1.29 | 0.23 | 12 | — | — | — |
| MGP33 | 96056.2 | 0.0918 | L | 39 | 1.83 | L | 59 | — | — | — |
| MGP33 | 96056.3 | — | — | — | 1.43 | 0.02 | 24 | — | — | — |
| MGP33 | 96057.3 | 0.0810 | 0.04 | 23 | 1.42 | 0.03 | 23 | — | — | — |
| MGP33 | 96057.4 | — | — | — | 1.54 | L | 34 | — | — | — |
| MGP28 | 96288.2 | — | — | — | 1.64 | L | 43 | — | — | — |
| MGP28 | 96289.2 | — | — | — | 1.56 | L | 36 | — | — | — |
| MGP28 | 96289.4 | 0.0816 | 0.03 | 24 | 1.87 | L | 62 | — | — | — |
| MGP28 | 96290.3 | — | — | — | 1.59 | L | 38 | — | — | — |
| MGP28 | 96290.4 | — | — | — | 1.60 | L | 39 | — | — | — |
| MGP23 | 96343.3 | — | — | — | 1.39 | 0.07 | 21 | — | — | — |
| MGP23 | 96343.4 | 0.0730 | 0.26 | 11 | 1.91 | L | 66 | — | — | — |
| MGP23 | 96344.3 | — | — | — | 1.65 | L | 43 | — | — | — |
| MGP17 | 96306.1 | — | — | — | 1.41 | 0.03 | 22 | — | — | — |
| MGP17 | 96306.3 | 0.0805 | 0.07 | 22 | 1.55 | L | 34 | — | — | — |
| MGP17 | 96309.1 | — | — | — | 1.53 | L | 33 | — | — | — |
| MGP17 | 96309.3 | 0.0757 | 0.13 | 15 | 1.76 | L | 53 | — | — | — |
| CONT. | — | 0.0659 | — | — | 1.15 | — | — | 0.768 | — | — |
| RIN44 | 91124.3 | 0.0810 | 0.24 | 7 | — | — | — | — | — | — |
| LGM9 | 92729.5 | 0.0921 | 0.04 | 22 | 1.36 | 0.19 | 14 | — | — | — |
| LGM9 | 92729.6 | 0.0946 | 0.04 | 25 | — | — | — | 0.703 | 0.23 | 4 |
| LGM8 | 92646.3 | — | — | — | — | — | — | 0.722 | 0.06 | 7 |
| LGM8 | 92646.4 | — | — | — | — | — | — | 0.731 | 0.02 | 8 |
| LGM8 | 92647.2 | — | — | — | — | — | — | 0.698 | 0.04 | 3 |
| LGM8 | 92648.1 | — | — | — | — | — | — | 0.699 | 0.01 | 3 |
| LGM4 | 93995.2 | 0.0835 | 0.25 | 11 | — | — | — | 0.729 | 0.24 | 8 |
| LGM4 | 93995.3 | 0.0925 | 0.02 | 23 | — | — | — | 0.718 | 0.07 | 6 |
| LGM4 | 93995.4 | 0.0974 | L | 29 | — | — | — | 0.704 | 0.06 | 4 |
| LGM4 | 93996.2 | 0.106 | L | 40 | 1.47 | 0.03 | 24 | 0.716 | 0.19 | 6 |
| LGM23 | 96234.1 | — | — | — | — | — | — | 0.691 | 0.16 | 2 |
| LGM23 | 96236.3 | 0.0906 | 0.05 | 20 | — | — | — | 0.711 | 0.24 | 5 |
| LGM23 | 96236.5 | — | — | — | — | — | — | 0.708 | 0.10 | 5 |
| LGM21 | 93794.1 | 0.0879 | 0.11 | 17 | 1.60 | L | 35 | — | — | — |
| LGM21 | 93794.3 | 0.0840 | 0.26 | 11 | — | — | — | — | — | — |
| LGM2 | 92804.3 | 0.0793 | 0.19 | 5 | 1.39 | 0.13 | 17 | — | — | — |
| LGM2 | 92806.1 | 0.0908 | 0.06 | 20 | 1.46 | 0.06 | 22 | — | — | — |
| LGM2 | 92806.3 | — | — | — | 1.46 | 0.05 | 23 | — | — | — |
| LGM2 | 92808.1 | 0.104 | 0.02 | 38 | 1.79 | L | 50 | — | — | — |
| LGM2 | 92808.2 | — | — | — | 1.64 | L | 38 | — | — | — |
| LGM16 | 92370.1 | 0.0937 | 0.02 | 24 | — | — | — | 0.726 | 0.24 | 7 |
| LGM16 | 92372.2 | 0.0910 | L | 21 | 2.01 | L | 69 | 0.743 | 0.04 | 10 |
| LGM16 | 92373.2 | 0.0847 | 0.24 | 12 | — | — | — | 0.743 | 0.15 | 10 |
| LGM13 | 92506.2 | 0.0827 | L | 10 | — | — | — | 0.704 | 0.18 | 4 |
| LGM13 | 92506.3 | 0.0874 | 0.13 | 16 | — | — | — | — | — | — |
| LGM13 | 92507.1 | 0.0841 | 0.26 | 11 | — | — | — | — | — | — |
| CONT. | — | 0.0755 | — | — | 1.19 | — | — | 0.677 | — | — |
| LGM16 | 92369.1 | 0.0778 | 0.07 | 12 | 1.21 | 0.08 | 24 | 0.750 | 0.14 | 11 |
| LGM16 | 92373.1 | — | — | — | — | — | — | 0.717 | 0.19 | 6 |
| LGM16 | 92373.2 | — | — | — | 1.03 | 0.20 | 6 | — | — | — |
| CONT. | — | 0.0698 | — | — | 0.977 | — | — | 0.677 | — | — |
| RIN44 | 91123.3 | 0.0901 | L | 42 | 1.42 | 0.03 | 28 | — | — | — |
| RIN44 | 91124.3 | 0.0884 | L | 40 | 1.37 | 0.06 | 23 | — | — | — |
| LGM23 | 96234.1 | 0.0825 | L | 30 | 1.40 | 0.03 | 26 | 0.776 | L | 16 |
| LGM23 | 96234.4 | 0.0819 | L | 29 | 1.46 | 0.02 | 31 | — | — | — |

TABLE 194-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGM23 | 96234.5 | 0.0881 | L | 39 | 1.60 | L | 44 | 0.715 | 0.26 | 7 |
| LGM23 | 96236.2 | 0.0734 | 0.14 | 16 | 1.31 | 0.14 | 18 | — | — | — |
| LGM22 | 96864.2 | 0.0992 | L | 57 | 1.46 | 0.01 | 31 | 0.744 | 0.06 | 11 |
| LGM22 | 96867.1 | 0.0971 | L | 53 | 1.27 | 0.23 | 15 | 0.725 | 0.16 | 8 |
| LGM22 | 96869.2 | 0.0810 | 0.01 | 28 | 1.31 | 0.14 | 18 | — | — | — |
| LGM22 | 96869.3 | 0.0894 | L | 41 | 1.55 | L | 39 | 0.744 | 0.06 | 11 |
| CONT. | — | 0.0633 | — | — | 1.11 | — | — | 0.670 | — | — |
| MGP40 | 96912.2 | — | — | — | 1.44 | 0.25 | 13 | — | — | — |
| MGP40 | 96913.3 | 0.0940 | 0.05 | 43 | 2.04 | L | 60 | 0.829 | 0.01 | 15 |
| MGP40 | 96914.1 | 0.0859 | L | 31 | 2.05 | L | 60 | 0.763 | 0.20 | 6 |
| MGP40 | 96914.2 | 0.0785 | 0.05 | 20 | 1.80 | L | 41 | 0.753 | 0.10 | 5 |
| MGP40 | 96914.3 | — | — | — | 1.63 | 0.01 | 27 | — | — | — |
| MGP27 | 96818.2 | — | — | — | 1.75 | L | 37 | 0.750 | 0.21 | 4 |
| MGP27 | 96818.3 | 0.0863 | L | 32 | 2.00 | L | 56 | — | — | — |
| MGP27 | 96820.1 | 0.0806 | 0.02 | 23 | 1.86 | L | 45 | — | — | — |
| MGP27 | 96820.2 | 0.0780 | L | 19 | 1.86 | L | 46 | 0.737 | 0.29 | 3 |
| MGP27 | 96820.6 | 0.0736 | 0.22 | 12 | 1.98 | L | 55 | 0.774 | 0.22 | 8 |
| MGP26 | 96924.1 | 0.0911 | L | 39 | 1.67 | L | 31 | 0.803 | 0.06 | 12 |
| MGP26 | 96924.2 | — | — | — | 1.64 | 0.01 | 28 | 0.768 | 0.28 | 7 |
| MGP26 | 96925.1 | 0.0849 | L | 29 | 1.78 | L | 39 | — | — | — |
| MGP26 | 96927.1 | 0.0920 | L | 40 | 1.86 | L | 45 | 0.769 | 0.25 | 7 |
| MGP26 | 96927.4 | — | — | — | 1.92 | L | 50 | — | — | — |
| MGP25 | 95718.2 | 0.0771 | 0.14 | 18 | 1.62 | 0.04 | 26 | — | — | — |
| MGP25 | 95720.1 | 0.0803 | 0.02 | 23 | 1.82 | L | 42 | 0.749 | 0.22 | 4 |
| MGP25 | 95720.4 | 0.0853 | 0.07 | 30 | 1.90 | L | 49 | — | — | — |
| MGP22 | 97008.4 | 0.0733 | 0.22 | 12 | 1.58 | 0.04 | 23 | — | — | — |
| MGP22 | 97009.1 | 0.0992 | L | 51 | 2.15 | L | 68 | 0.771 | 0.23 | 7 |
| MGP22 | 97009.2 | 0.0809 | 0.04 | 23 | 1.99 | L | 56 | 0.797 | 0.13 | 11 |
| MGP22 | 97009.3 | 0.0900 | L | 37 | 1.89 | L | 48 | — | — | — |
| MGP22 | 97009.4 | 0.0829 | L | 27 | 1.78 | L | 39 | — | — | — |
| MGP18 | 96854.2 | — | — | — | 1.46 | 0.19 | 14 | — | — | — |
| MGP18 | 96855.1 | — | — | — | 1.48 | 0.24 | 16 | — | — | — |
| MGP18 | 96855.2 | — | — | — | 1.60 | 0.05 | 25 | — | — | — |
| MGP18 | 96856.3 | 0.0929 | L | 42 | 1.88 | L | 47 | 0.790 | 0.11 | 10 |
| MGP18 | 96856.4 | 0.0825 | 0.02 | 26 | 1.76 | L | 38 | — | — | — |
| CONT. | — | 0.0656 | — | — | 1.28 | — | — | 0.719 | — | — |
| RIN44 | 91123.4 | 0.0974 | 0.17 | 13 | 1.64 | 0.28 | 10 | — | — | — |
| RIN44 | 91124.1 | 0.0956 | 0.25 | 11 | — | — | — | — | — | — |
| LGM9 | 92729.4 | 0.111 | L | 29 | — | — | — | — | — | — |
| LGM9 | 92731.2 | 0.100 | 0.08 | 16 | 1.73 | 0.06 | 16 | — | — | — |
| LGM8 | 92647.1 | 0.102 | 0.05 | 18 | — | — | — | — | — | — |
| LGM8 | 92647.2 | 0.106 | 0.02 | 23 | 1.65 | 0.21 | 11 | — | — | — |
| LGM8 | 92648.1 | 0.0970 | 0.19 | 12 | 1.76 | 0.06 | 18 | — | — | — |
| LGM4 | 93995.1 | 0.108 | L | 25 | — | — | — | — | — | — |
| LGM4 | 93995.2 | 0.107 | 0.01 | 24 | 1.69 | 0.13 | 14 | 0.751 | 0.29 | 8 |
| LGM4 | 93995.3 | 0.0998 | 0.10 | 16 | — | — | — | — | — | — |
| LGM4 | 93995.4 | 0.111 | L | 29 | — | — | — | — | — | — |
| LGM4 | 93996.3 | 0.113 | L | 31 | 2.01 | L | 35 | — | — | — |
| LGM23 | 96234.1 | 0.107 | 0.01 | 24 | — | — | — | — | — | — |
| LGM23 | 96234.5 | 0.104 | 0.05 | 21 | — | — | — | — | — | — |
| LGM23 | 96236.2 | 0.100 | 0.09 | 16 | — | — | — | — | — | — |
| LGM22 | 96864.1 | 0.108 | L | 25 | 1.79 | 0.03 | 20 | — | — | — |
| LGM22 | 96864.2 | 0.0989 | 0.12 | 15 | 1.66 | 0.22 | 12 | — | — | — |
| LGM22 | 96864.4 | 0.102 | 0.06 | 18 | 1.65 | 0.23 | 11 | — | — | — |
| LGM22 | 96869.4 | 0.0970 | 0.18 | 12 | — | — | — | — | — | — |
| LGM21 | 93794.1 | — | — | — | 1.63 | 0.29 | 9 | — | — | — |
| LGM21 | 93794.3 | 0.0984 | 0.14 | 14 | — | — | — | — | — | — |
| LGM21 | 93798.1 | 0.107 | 0.01 | 23 | 1.75 | 0.05 | 18 | — | — | — |
| LGM2 | 92804.1 | 0.103 | 0.03 | 20 | 1.88 | L | 26 | 0.751 | 0.27 | 8 |
| LGM2 | 92804.2 | 0.101 | 0.06 | 18 | 1.89 | L | 27 | — | — | — |
| LGM2 | 92804.3 | 0.112 | L | 29 | 2.01 | L | 35 | — | — | — |
| LGM2 | 92806.3 | — | — | — | 1.98 | L | 33 | — | — | — |
| LGM16 | 92369.1 | 0.106 | 0.02 | 23 | — | — | — | — | — | — |
| LGM16 | 92370.1 | 0.103 | 0.05 | 19 | — | — | — | — | — | — |
| LGM16 | 92373.5 | 0.105 | 0.02 | 22 | 1.80 | 0.02 | 21 | — | — | — |
| LGM13 | 92504.1 | 0.102 | 0.09 | 18 | — | — | — | — | — | — |
| LGM13 | 92504.2 | 0.106 | 0.02 | 22 | — | — | — | — | — | — |
| LGM13 | 92506.3 | 0.101 | 0.08 | 17 | — | — | — | — | — | — |
| LGM13 | 92507.1 | 0.107 | 0.02 | 24 | — | — | — | — | — | — |
| LGM13 | 92507.5 | 0.105 | 0.03 | 21 | 1.73 | 0.06 | 16 | — | — | — |
| CONT. | — | 0.0863 | — | — | 1.49 | — | — | 0.695 | — | — |

TABLE 194-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGD6 | 94014.1 | — | — | — | 1.49 | 0.20 | 16 | — | — | — |
| LGD6 | 94018.1 | — | — | — | 1.48 | 0.24 | 15 | — | — | — |
| LGD24 | 94238.3 | 0.0940 | L | 28 | — | — | — | 0.714 | 0.26 | 9 |
| LGD24 | 94238.4 | 0.0933 | L | 27 | — | — | — | — | — | — |
| LGD24 | 94240.2 | 0.0853 | 0.09 | 16 | — | — | — | — | — | — |
| LGD24 | 94240.5 | 0.0813 | 0.24 | 10 | — | — | — | — | — | — |
| LGD21 | 94233.1 | 0.0928 | L | 26 | — | — | — | 0.718 | 0.21 | 9 |
| LGD21 | 94233.3 | 0.0918 | L | 25 | — | — | — | 0.715 | 0.24 | 9 |
| LGD21 | 94235.2 | 0.0899 | 0.01 | 22 | — | — | — | — | — | — |
| LGD21 | 94236.1 | 0.0833 | 0.14 | 13 | — | — | — | — | — | — |
| LGD19 | 93705.1 | 0.0877 | 0.04 | 19 | — | — | — | — | — | — |
| LGD19 | 93705.2 | 0.0872 | 0.04 | 19 | — | — | — | 0.729 | 0.14 | 11 |
| LGD19 | 93705.3 | 0.0912 | 0.01 | 24 | — | — | — | — | — | — |
| LGD19 | 93709.2 | — | — | — | 1.47 | 0.26 | 15 | — | — | — |
| LGD18 | 94694.3 | 0.0824 | 0.19 | 12 | 1.48 | 0.24 | 15 | — | — | — |
| LGD18 | 94696.1 | 0.100 | L | 36 | — | — | — | — | — | — |
| LGD18 | 94699.2 | 0.0892 | 0.02 | 21 | 1.55 | 0.10 | 21 | 0.708 | 0.30 | 8 |
| LGD17 | 94009.1 | 0.0811 | 0.26 | 10 | — | — | — | — | — | — |
| LGD17 | 94011.1 | 0.0943 | L | 28 | 1.50 | 0.20 | 16 | — | — | — |
| LGD17 | 94012.1 | — | — | — | 1.56 | 0.10 | 21 | — | — | — |
| LGD16 | 94228.1 | 0.0822 | 0.20 | 12 | — | — | — | — | — | — |
| LGD16 | 94228.3 | 0.0905 | 0.02 | 23 | — | — | — | — | — | — |
| LGD16 | 94230.4 | 0.0918 | L | 25 | 1.52 | 0.17 | 18 | — | — | — |
| LGD16 | 94230.5 | 0.0920 | L | 25 | — | — | — | 0.720 | 0.21 | 9 |
| LGD15 | 94034.1 | — | — | — | 1.54 | 0.12 | 20 | — | — | — |
| LGD10 | 93833.1 | — | — | — | 1.57 | 0.09 | 22 | — | — | — |
| CONT. | — | 0.0736 | — | — | 1.28 | — | — | 0.658 | — | — |
| MGP42 | 94562.2 | — | — | — | 1.57 | L | 37 | — | — | — |
| MGP42 | 94562.3 | 0.0762 | 0.17 | 12 | 1.53 | L | 33 | — | — | — |
| MGP42 | 94563.4 | 0.0746 | 0.30 | 10 | 1.76 | L | 53 | — | — | — |
| MGP42 | 94566.3 | — | — | — | 1.33 | 0.13 | 16 | — | — | — |
| MGP42 | 94566.5 | — | — | — | 1.54 | L | 34 | — | — | — |
| MGP39 | 94592.2 | 0.0760 | 0.16 | 12 | 1.52 | L | 32 | — | — | — |
| MGP39 | 94594.1 | — | — | — | 1.42 | 0.04 | 23 | — | — | — |
| MGP39 | 94596.2 | — | — | — | 1.48 | 0.01 | 28 | — | — | — |
| MGP39 | 94596.3 | — | — | — | 1.30 | 0.23 | 13 | — | — | — |
| MGP39 | 94597.2 | — | — | — | 1.30 | 0.24 | 13 | — | — | — |
| MGP34 | 96354.1 | — | — | — | 1.47 | L | 28 | — | — | — |
| MGP34 | 96354.3 | — | — | — | 1.35 | 0.15 | 17 | — | — | — |
| MGP34 | 96356.1 | 0.0773 | 0.12 | 14 | 1.52 | L | 33 | — | — | — |
| MGP34 | 96356.2 | 0.0771 | 0.15 | 14 | 1.33 | 0.14 | 16 | — | — | — |
| MGP34 | 96356.3 | 0.0754 | 0.27 | 11 | 1.42 | 0.06 | 23 | — | — | — |
| MGP23 | 96343.3 | — | — | — | 1.35 | 0.15 | 17 | — | — | — |
| MGP23 | 96343.4 | — | — | — | 1.39 | 0.06 | 21 | — | — | — |
| MGP23 | 96344.1 | — | — | — | 1.44 | 0.02 | 25 | — | — | — |
| MGP23 | 96344.3 | 0.0747 | 0.25 | 10 | 1.54 | L | 34 | — | — | — |
| MGP17 | 96306.1 | — | — | — | 1.60 | L | 39 | — | — | — |
| MGP17 | 96306.3 | 0.0829 | 0.01 | 22 | 1.55 | L | 35 | — | — | — |
| MGP17 | 96309.1 | — | — | — | 1.32 | 0.16 | 15 | — | — | — |
| MGP17 | 96309.2 | — | — | — | 1.66 | L | 44 | — | — | — |
| MGP15 | 94827.1 | — | — | — | 1.51 | L | 31 | — | — | — |
| MGP15 | 94827.2 | — | — | — | 1.48 | 0.02 | 28 | — | — | — |
| MGP15 | 94828.2 | 0.0749 | 0.22 | 10 | 1.57 | L | 37 | — | — | — |
| MGP15 | 94830.3 | 0.0771 | 0.11 | 14 | 1.57 | L | 37 | 0.766 | 0.23 | 8 |
| CONT. | — | 0.0678 | — | — | 1.15 | — | — | 0.707 | — | — |
| MGP42 | 94562.2 | 0.0708 | 0.30 | 11 | 1.50 | L | 32 | — | — | — |
| MGP42 | 94563.4 | — | — | — | 1.33 | 0.17 | 17 | — | — | — |
| MGP42 | 94566.3 | 0.0735 | 0.17 | 16 | 1.50 | L | 32 | 0.827 | 0.07 | 9 |
| MGP42 | 94566.5 | — | — | — | 1.39 | 0.06 | 22 | 0.815 | 0.15 | 8 |
| MGP39 | 94592.2 | — | — | — | 1.30 | 0.21 | 14 | — | — | — |
| MGP39 | 94594.1 | 0.0762 | 0.07 | 20 | 1.37 | 0.08 | 20 | — | — | — |
| MGP39 | 94596.2 | 0.0733 | 0.15 | 15 | 1.37 | 0.09 | 21 | — | — | — |
| MGP39 | 94596.3 | — | — | — | 1.43 | 0.03 | 26 | 0.794 | L | 5 |
| MGP21 | 94569.2 | 0.0730 | L | 15 | 1.46 | 0.02 | 28 | — | — | — |
| MGP21 | 94571.2 | — | — | — | 1.36 | 0.10 | 20 | — | — | — |
| MGP21 | 94572.1 | 0.0707 | 0.28 | 11 | 1.35 | 0.10 | 19 | 0.811 | 0.16 | 7 |
| MGP21 | 94572.2 | 0.0888 | L | 40 | 1.74 | L | 53 | 0.803 | 0.21 | 6 |
| MGP21 | 94573.1 | 0.0821 | L | 29 | 1.57 | L | 38 | 0.897 | L | 19 |
| MGP20 | 94574.1 | — | — | — | 1.30 | 0.20 | 15 | — | — | — |
| MGP20 | 94574.2 | — | — | — | 1.50 | L | 32 | — | — | — |
| MGP20 | 94575.1 | 0.0743 | 0.11 | 17 | — | — | — | — | — | — |

TABLE 194-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| MGP20 | 94579.1 | 0.0820 | 0.15 | 29 | 1.69 | L | 49 | 0.853 | 0.02 | 13 |
| MGP20 | 94579.4 | 0.0705 | 0.17 | 11 | 1.62 | L | 43 | 0.781 | 0.30 | 3 |
| MGP16 | 95060.1 | 0.0784 | 0.04 | 23 | 1.36 | 0.12 | 20 | — | — | — |
| MGP16 | 95392.1 | 0.0738 | 0.12 | 16 | 1.46 | 0.02 | 29 | 0.781 | 0.04 | 3 |
| MGP16 | 95392.2 | — | — | — | 1.39 | 0.07 | 23 | — | — | — |
| MGP16 | 95392.3 | — | — | — | 1.35 | 0.11 | 19 | 0.793 | 0.18 | 5 |
| MGP16 | 95393.1 | 0.0836 | L | 31 | 1.46 | 0.02 | 29 | 0.798 | 0.29 | 6 |
| MGP15 | 94826.1 | — | — | — | 1.37 | 0.07 | 21 | 0.792 | 0.30 | 5 |
| MGP15 | 94827.1 | — | — | — | 1.31 | 0.19 | 15 | — | — | — |
| MGP15 | 94827.2 | 0.0689 | 0.19 | 8 | 1.45 | 0.06 | 28 | — | — | — |
| MGP15 | 94828.2 | 0.0921 | L | 45 | 1.78 | L | 57 | 0.787 | 0.10 | 4 |
| MGP15 | 94830.3 | — | — | — | 1.42 | 0.03 | 25 | — | — | — |
| CONT. | — | 0.0636 | — | — | 1.14 | — | — | 0.755 | — | — |
| LGM2 | 92804.2 | 0.0911 | 0.01 | 17 | 1.45 | L | 22 | — | — | — |
| LGM2 | 92804.4 | 0.0979 | 0.01 | 26 | 1.68 | 0.06 | 41 | — | — | — |
| LGM2 | 92806.3 | 0.0908 | 0.21 | 17 | 1.49 | 0.05 | 25 | — | — | — |
| LGM13 | 92504.2 | 0.0930 | 0.12 | 20 | — | — | — | — | — | — |
| LGM13 | 92507.1 | 0.0961 | 0.05 | 23 | — | — | — | — | — | — |
| LGM13 | 92507.5 | — | — | — | — | — | — | 0.776 | 0.12 | 10 |
| CONT. | — | 0.0778 | — | — | 1.19 | — | — | 0.706 | — | — |

Table 194.
"CONT." = Control;
"Ave." = Average;
"% Incr." = % increment;
"p-val." = p-value,
L = p < 0.01.

Tables 195-197 summarize the observed phenotypes of transgenic plants exogenously expressing the gene constructs using the seedling assays under nitrogen deficient growth conditions. The genes listed in these Tables show increased biomass (e.g., increased dry weight, fresh weight), photosynthetic area (e.g., increased leaf area), increased root biomass (e.g., root length and root coverage) and increased growth rate (e.g., increased growth rate of leaf area, root coverage and root length) under nitrogen deficient growth conditions. The evaluation of each gene was performed by testing the performance of different number of events. Event with p-value <0.1 was considered statistically significant.

TABLE 195

Genes showing improved plant performance at Low Nitrogen growth conditions under regulation of Ar6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| RIN44 | 72525.4 | 5.22 | 0.17 | 45 | 103.2 | 0.04 | 43 |
| RIN44 | 72527.2 | — | — | — | 92.4 | 0.19 | 28 |
| CONT. | — | 3.60 | — | — | 72.4 | — | — |
| LGB8 | 96534.3 | — | — | — | 75.5 | 0.13 | 10 |
| LGB8 | 96534.5 | 5.70 | 0.08 | 25 | 85.7 | 0.02 | 25 |
| LGB8 | 96538.1 | 5.62 | 0.04 | 23 | — | — | — |
| LGB4 | 96493.1 | — | — | — | 73.8 | 0.20 | 7 |
| LGB4 | 96493.2 | 5.03 | 0.04 | 10 | 75.0 | 0.07 | 9 |
| LGB4 | 96493.3 | — | — | — | 75.9 | 0.21 | 10 |
| LGB14 | 96600.4 | 4.95 | 0.03 | 8 | 74.9 | 0.07 | 9 |
| LGB14 | 96601.1 | 5.25 | L | 15 | 84.3 | 0.03 | 23 |
| LGB14 | 96601.2 | 5.60 | 0.13 | 23 | 80.2 | 0.13 | 17 |
| LGB14 | 96601.3 | — | — | — | 73.0 | 0.25 | 6 |
| LGB14 | 96602.1 | 4.95 | 0.23 | 8 | 75.1 | 0.21 | 9 |
| LGB1 | 95790.2 | 5.00 | 0.28 | 10 | — | — | — |
| LGB1 | 95791.1 | 5.03 | 0.26 | 10 | 74.6 | 0.26 | 9 |
| LGB1 | 95792.3 | 5.12 | 0.10 | 12 | — | — | — |
| CONT. | — | 4.56 | — | — | 68.7 | — | — |
| LGB5 | 94192.1 | — | — | — | 65.5 | 0.03 | 10 |
| LGB5 | 94195.1 | 4.45 | 0.25 | 11 | 72.5 | 0.21 | 22 |
| LGB2 | 94882.3 | 4.72 | 0.23 | 18 | 68.6 | 0.15 | 15 |
| LGB11 | 93849.4 | 4.55 | 0.09 | 13 | 63.7 | 0.13 | 7 |
| LGB11 | 93850.1 | 4.47 | L | 12 | — | — | — |
| CONT. | — | 4.01 | — | — | 59.4 | — | — |

"CONT." = Control; "Ave." = Average; "% Incr." = % increment; "p-val." = p-value, L = p < 0.01.

TABLE 196

Genes showing improved plant performance at Low Nitrogen growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| RIN44 | 72525.4 | 0.414 | 0.12 | 22 | 19.8 | 0.11 | 55 | 8.48 | 0.07 | 16 |
| RIN44 | 72527.2 | 0.430 | 0.11 | 27 | — | — | — | — | — | — |
| CONT. | — | 0.338 | — | — | 12.8 | — | — | 7.29 | — | — |
| LGB8 | 96534.3 | 0.390 | 0.05 | 6 | — | — | — | — | — | — |
| LGB8 | 96534.5 | 0.457 | 0.04 | 25 | — | — | — | 8.39 | 0.18 | 5 |
| LGB8 | 96537.2 | — | — | — | 16.0 | 0.17 | 11 | 8.24 | 0.09 | 3 |
| LGB4 | 96492.3 | 0.429 | 0.04 | 17 | — | — | — | 8.33 | 0.01 | 4 |
| LGB4 | 96493.1 | 0.394 | 0.04 | 8 | — | — | — | — | — | — |
| LGB4 | 96493.2 | 0.407 | 0.06 | 11 | — | — | — | — | — | — |
| LGB4 | 96493.3 | — | — | — | 15.3 | 0.30 | 6 | — | — | — |
| LGB14 | 96600.4 | 0.409 | 0.01 | 12 | 17.8 | L | 24 | 8.32 | 0.09 | 4 |
| LGB14 | 96601.1 | 0.433 | 0.01 | 18 | 15.9 | 0.15 | 10 | — | — | — |
| LGB14 | 96601.2 | 0.425 | L | 16 | 18.9 | L | 32 | 8.50 | L | 6 |
| LGB14 | 96602.1 | 0.451 | 0.02 | 23 | 18.3 | 0.09 | 27 | 8.38 | 0.02 | 5 |
| LGB1 | 95790.2 | 0.406 | 0.25 | 11 | — | — | — | — | — | — |
| LGB1 | 95790.5 | 0.407 | 0.09 | 11 | — | — | — | 8.17 | 0.13 | 2 |
| LGB1 | 95791.1 | 0.454 | 0.29 | 24 | — | — | — | — | — | — |
| LGB1 | 95792.3 | — | — | — | 17.2 | L | 19 | 8.44 | 0.06 | 6 |
| CONT. | — | 0.366 | — | — | 14.4 | — | — | 7.99 | — | — |
| LGB5 | 94192.1 | 0.371 | 0.07 | 7 | 16.2 | 0.04 | 30 | 8.27 | 0.03 | 5 |
| LGB5 | 94193.1 | — | — | — | — | — | — | 8.09 | 0.22 | 3 |
| LGB5 | 94193.2 | 0.372 | 0.30 | 8 | — | — | — | 8.23 | 0.12 | 4 |
| LGB5 | 94195.1 | 0.376 | 0.03 | 9 | 15.9 | 0.01 | 27 | 8.23 | 0.07 | 4 |
| LGB2 | 94882.1 | 0.372 | 0.27 | 8 | — | — | — | — | — | — |
| LGB2 | 94882.3 | — | — | — | 15.5 | 0.11 | 24 | 8.27 | 0.13 | 5 |
| LGB2 | 94884.3 | — | — | — | — | — | — | 8.05 | 0.16 | 2 |
| LGB16 | 94701.3 | 0.363 | 0.19 | 5 | — | — | — | — | — | — |
| LGB16 | 94702.2 | 0.369 | 0.18 | 7 | 13.6 | 0.21 | 9 | 8.26 | 0.03 | 5 |
| LGB16 | 94702.4 | — | — | — | — | — | — | 8.16 | 0.19 | 3 |
| LGB15 | 93970.1 | 0.367 | 0.04 | 6 | 13.8 | 0.11 | 10 | — | — | — |
| LGB15 | 93971.4 | — | — | — | 15.6 | 0.17 | 25 | — | — | — |
| LGB15 | 93971.6 | 0.384 | 0.03 | 11 | — | — | — | — | — | — |
| LGB11 | 93849.4 | 0.423 | 0.03 | 23 | 14.8 | 0.18 | 18 | 8.41 | 0.16 | 7 |
| LGB11 | 93850.1 | 0.372 | 0.16 | 8 | — | — | — | — | — | — |
| LGB11 | 93850.3 | — | — | — | — | — | — | 8.07 | 0.28 | 2 |
| CONT. | — | 0.345 | — | — | 12.5 | — | — | 7.89 | — | — |

"CONT." = Control; "Ave." = Average; "% Incr." = % increment; "p-val." = p-value, L = p < 0.01.

TABLE 197

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| RIN44 | 72525.4 | 0.0451 | 0.09 | 29 | 2.43 | 0.05 | 55 | 0.794 | 0.21 | 14 |
| RIN44 | 72527.2 | 0.0435 | 0.19 | 25 | — | — | — | — | — | — |
| RIN44 | 72528.4 | — | — | — | — | — | — | 0.811 | 0.14 | 16 |
| CONT. | — | 0.0349 | — | — | 1.57 | — | — | 0.697 | — | — |
| LGB4 | 96492.3 | 0.0365 | 0.08 | 19 | — | — | — | — | — | — |
| LGB14 | 96600.4 | 0.0346 | 0.23 | 13 | 2.19 | 0.04 | 23 | — | — | — |
| LGB14 | 96601.1 | 0.0363 | 0.09 | 18 | — | — | — | — | — | — |
| LGB14 | 96601.2 | 0.0358 | 0.12 | 17 | 2.34 | L | 32 | 0.898 | 0.14 | 10 |
| LGB14 | 96602.1 | 0.0381 | 0.03 | 24 | 2.24 | 0.03 | 26 | — | — | — |
| LGB1 | 95790.2 | 0.0353 | 0.17 | 15 | — | — | — | — | — | — |
| LGB1 | 95791.1 | 0.0405 | 0.02 | 32 | — | — | — | — | — | — |
| LGB1 | 95792.3 | — | — | — | 2.10 | 0.10 | 18 | — | — | — |
| CONT. | — | 0.0307 | — | — | 1.78 | — | — | 0.819 | — | — |
| LGB5 | 94192.1 | — | — | — | 1.97 | L | 30 | — | — | — |
| LGB5 | 94193.1 | — | — | — | — | — | — | 0.845 | 0.12 | 8 |
| LGB5 | 94193.2 | 0.0330 | 0.17 | 13 | 1.74 | 0.18 | 15 | 0.812 | 0.23 | 4 |
| LGB5 | 94195.1 | 0.0313 | 0.14 | 8 | 1.94 | L | 28 | 0.848 | 0.10 | 8 |
| LGB2 | 94881.2 | 0.0333 | 0.12 | 15 | — | — | — | 0.906 | L | 16 |

TABLE 197-continued

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGB2 | 94882.1 | 0.0316 | 0.23 | 9 | — | — | — | — | — | — |
| LGB2 | 94882.3 | — | — | — | 1.89 | 0.03 | 25 | 0.864 | 0.04 | 10 |
| LGB2 | 94884.3 | 0.0320 | 0.10 | 10 | — | — | — | — | — | — |
| LGB16 | 94701.3 | 0.0317 | 0.02 | 9 | — | — | — | — | — | — |
| LGB16 | 94702.1 | 0.0325 | 0.11 | 12 | — | — | — | — | — | — |
| LGB16 | 94702.2 | 0.0343 | 0.05 | 18 | — | — | — | — | — | — |
| LGB16 | 94702.4 | — | — | — | — | — | — | 0.820 | 0.02 | 5 |
| LGB16 | 94702.5 | — | — | — | — | — | — | 0.821 | 0.26 | 5 |
| LGB15 | 93970.1 | 0.0308 | 0.15 | 6 | — | — | — | — | — | — |
| LGB15 | 93971.4 | — | — | — | 1.93 | 0.02 | 27 | — | — | — |
| LGB11 | 93849.4 | 0.0347 | 0.05 | 19 | 1.79 | 0.10 | 18 | — | — | — |
| LGB11 | 93849.7 | 0.0337 | 0.03 | 16 | — | — | — | — | — | — |
| LGB11 | 93850.1 | 0.0308 | 0.08 | 6 | — | — | — | — | — | — |
| LGB11 | 93850.3 | 0.0324 | 0.23 | 12 | — | — | — | — | — | — |
| CONT. | — | 0.0291 | — | — | 1.51 | — | — | 0.783 | — | — |

"CONT." = Control; "Ave." = Average; "% Incr." = % increment; "p-val." = p-value, L = p < 0.01.

Results from T1 Plants

Tables 198-203 summarize the observed phenotypes of transgenic plants expressing the gene constructs using the TC-T1 Assays (seedling analysis of T1 plants).

The genes presented in Tables 198-203 showed a significant improvement in plant biomass and root development since they produced a higher biomass (dry weight, Tables 198 and 201), a larger leaf and root biomass (leaf area, root length and root coverage) (Tables 199 and 202), and a higher relative growth rate of leaf area, and root coverage (Tables 200 and 203) when grown under normal growth conditions (Tables 198-200) or under low nitrogen growth conditions (nitrogen deficiency) (Tables 201-203) as compared to control plants grown under identical growth conditions. Plants producing larger root biomass have better possibilities to absorb larger amount of nitrogen from soil. Plants producing larger leaf biomass have better ability to produce assimilates. The genes were cloned under the regulation of a constitutive promoter (At6669; SEQ ID NO: 6614). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 198

Genes showing improved plant performance at Normal growth conditions under regulation of At6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| MGP30_H3 | 11.1 | 0.24 | 7 | — | — | — |
| CONT. | 10.3 | — | — | — | — | — |
| LGD9 | 9.57 | 0.08 | 31 | 170.8 | 0.10 | 25 |
| LGD9 | 10.3 | 0.01 | 41 | 192.4 | 0.02 | 41 |
| LGD9 | 8.33 | 0.13 | 14 | 156.5 | 0.10 | 15 |
| LGD8 | 10.8 | 0.01 | 47 | 189.5 | 0.03 | 39 |
| LGD8 | 10.4 | 0.25 | 43 | 189.3 | 0.25 | 39 |
| LGD8 | 12.8 | 0.02 | 75 | 234.5 | 0.02 | 72 |
| LGD6 | 10.7 | L | 46 | 180.5 | L | 32 |
| LGD6 | 9.72 | 0.05 | 33 | 171.1 | 0.05 | 25 |

TABLE 198-continued

Genes showing improved plant performance at Normal growth conditions under regulation of At6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LGD6 | 10.7 | 0.04 | 45 | 175.0 | 0.12 | 28 |
| LGD24 | 12.0 | 0.02 | 63 | 219.2 | 0.03 | 60 |
| LGD24 | 9.57 | 0.04 | 31 | 170.4 | 0.14 | 25 |
| LGD24 | 10.8 | 0.03 | 47 | 185.0 | 0.16 | 35 |
| LGD24 | 11.8 | 0.05 | 61 | 200.8 | 0.06 | 47 |
| LGD21 | 12.1 | 0.04 | 65 | 218.7 | 0.05 | 60 |
| LGD21 | 10.1 | L | 38 | 177.0 | 0.03 | 30 |
| LGD21 | 12.7 | L | 73 | 233.4 | L | 71 |
| LGD21 | 10.1 | 0.02 | 38 | 212.4 | 0.12 | 55 |
| LGD21 | 8.78 | 0.06 | 20 | 154.3 | 0.03 | 13 |
| LGD19 | 8.12 | 0.21 | 11 | 152.8 | 0.19 | 12 |
| LGD19 | 8.05 | 0.08 | 10 | — | — | — |
| LGD19 | 9.10 | 0.01 | 24 | 169.6 | 0.07 | 24 |
| LGD18 | 9.70 | L | 32 | 170.1 | L | 24 |
| LGD18 | 8.15 | 0.19 | 11 | — | — | — |
| LGD18 | 9.60 | 0.03 | 31 | 152.4 | 0.20 | 11 |
| LGD18 | 9.88 | 0.06 | 35 | — | — | — |
| LGD17 | 10.0 | 0.28 | 36 | — | — | — |
| LGD17 | 9.38 | L | 28 | 163.6 | L | 20 |
| LGD17 | 11.0 | 0.11 | 50 | 180.5 | 0.11 | 32 |
| LGD17 | 9.57 | 0.06 | 31 | 174.2 | 0.13 | 27 |
| LGD16 | 8.27 | 0.14 | 13 | — | — | — |
| LGD16 | 10.8 | 0.02 | 48 | 199.4 | 0.02 | 46 |
| LGD16 | 10.1 | 0.11 | 38 | 205.1 | 0.12 | 50 |
| LGD16 | 8.62 | 0.17 | 18 | — | — | — |
| LGD16 | 9.97 | 0.02 | 36 | 155.5 | 0.06 | 14 |
| LGD15 | 10.9 | 0.02 | 48 | 195.8 | 0.04 | 43 |
| LGD15 | 9.88 | L | 35 | 177.5 | 0.02 | 30 |
| LGD12 | 8.60 | 0.23 | 17 | — | — | — |
| LGD12 | 8.75 | 0.10 | 19 | 162.2 | 0.18 | 19 |
| LGD12 | 10.3 | 0.02 | 41 | 189.1 | L | 38 |
| LGD11 | 8.95 | 0.08 | 22 | 157.1 | 0.25 | 15 |
| LGD11 | 8.82 | 0.21 | 20 | — | — | — |
| LGD11 | 12.7 | 0.02 | 73 | 283.1 | 0.14 | 107 |
| LGD11 | 10.4 | 0.08 | 43 | 189.1 | 0.07 | 38 |
| LGD10 | 8.85 | L | 21 | 164.0 | L | 20 |
| LGD10 | 9.85 | 0.06 | 34 | 184.4 | 0.05 | 35 |
| LGD10 | 10.1 | 0.02 | 38 | 173.2 | 0.08 | 27 |
| LGD10 | 9.85 | 0.01 | 34 | 157.5 | 0.08 | 15 |
| CONT. | 7.33 | — | — | 136.6 | — | — |
| LGB8 | 7.73 | L | 22 | 129.4 | 0.08 | 17 |
| LGB8 | 9.38 | 0.24 | 47 | — | — | — |

TABLE 198-continued

Genes showing improved plant performance at Normal growth conditions under regulation of At6669 promoter

| Gene Name | Dry Weight [mg] Ave. | P-Val. | % Incr. | Fresh Weight [mg] Ave. | P-Val. | % Incr. |
|---|---|---|---|---|---|---|
| LGB8 | 8.90 | 0.05 | 40 | 148.4 | 0.15 | 34 |
| LGB8 | 7.38 | 0.12 | 16 | 127.9 | 0.18 | 16 |
| LGB5 | 8.72 | 0.24 | 37 | 147.1 | 0.30 | 33 |
| LGB5 | 9.53 | 0.05 | 50 | 173.4 | 0.05 | 57 |
| LGB2 | 9.70 | 0.01 | 53 | 167.1 | 0.02 | 51 |
| LGB2 | 10.7 | 0.03 | 68 | 179.7 | 0.04 | 63 |
| LGB16 | 8.25 | 0.09 | 30 | — | — | — |
| LGB16 | 8.50 | L | 34 | 144.9 | L | 31 |
| LGB15 | 9.80 | L | 54 | 159.6 | L | 44 |
| LGB15 | 8.90 | 0.02 | 40 | 147.2 | 0.05 | 33 |
| LGB15 | 8.33 | 0.06 | 31 | 140.6 | 0.10 | 27 |
| LGB15 | 8.50 | 0.04 | 34 | 142.0 | 0.12 | 29 |
| LGB14 | 8.02 | 0.09 | 26 | 140.3 | 0.05 | 27 |
| LGB14 | 9.15 | L | 44 | 152.4 | 0.04 | 38 |
| LGB14 | 7.60 | 0.07 | 20 | — | — | — |
| CONT. | 6.36 | — | — | 110.4 | — | — |
| LGB9 | 12.0 | 0.06 | 24 | 256.1 | 0.23 | 59 |
| LGB9 | 17.0 | L | 77 | 280.7 | L | 74 |
| LGB9 | 12.8 | 0.19 | 33 | 217.0 | 0.21 | 35 |
| LGB9 | 13.4 | 0.20 | 38 | 219.1 | 0.20 | 36 |
| LGB18_H2 | 13.4 | 0.08 | 40 | 237.0 | 0.07 | 47 |
| LGB18_H2 | 12.0 | L | 24 | 190.8 | 0.03 | 18 |
| CONT. | 9.64 | — | — | 161.0 | — | — |
| LGM9 | 9.40 | 0.07 | 21 | 150.1 | 0.04 | 21 |
| LGM8 | — | — | — | 144.3 | 0.25 | 16 |
| LGM8 | 10.3 | 0.01 | 33 | 152.9 | 0.24 | 23 |
| LGM8 | 11.2 | 0.01 | 45 | 181.5 | 0.05 | 46 |
| LGM8 | 10.2 | L | 32 | 151.3 | 0.17 | 22 |
| LGM4 | 8.82 | 0.24 | 14 | 158.8 | 0.12 | 28 |
| LGM4 | 11.2 | 0.03 | 44 | 173.2 | 0.12 | 40 |
| LGM4 | 9.97 | 0.06 | 29 | 147.2 | 0.22 | 19 |
| LGM4 | 8.70 | 0.14 | 12 | 142.1 | 0.13 | 15 |
| LGM21 | 10.4 | 0.01 | 34 | 163.1 | L | 31 |
| LGM21 | — | — | — | 140.8 | 0.29 | 13 |
| LGM21 | 10.4 | 0.03 | 35 | 166.0 | L | 34 |
| LGM21 | 9.38 | L | 21 | 141.4 | L | 14 |
| CONT. | 7.74 | — | — | 124.0 | — | — |
| LGB10 | — | — | — | 287.2 | 0.12 | 17 |
| CONT. | — | — | — | 245.7 | — | — |

"CONT."—Control; "Ave."—Average; "% Incr." = % increment; "p-val."—p-value, L—p < 0.01.

TABLE 199

Genes showing improved plant performance at Normal growth conditions under regulation of At6669 promoter

| Gene Name | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|
| MGP30_H3 | 0.861 | 0.21 | 9 | — | — | — | — | — | — |
| CONT. | 0.791 | — | — | — | — | — | — | — | — |
| LGD9 | 0.767 | 0.02 | 27 | 12.1 | 0.19 | 19 | — | — | — |
| LGD9 | 0.831 | L | 38 | 11.9 | 0.07 | 16 | — | — | — |
| LGD9 | 0.664 | 0.21 | 10 | — | — | — | 7.91 | 0.28 | 3 |
| LGD9 | 0.654 | 0.27 | 8 | — | — | — | — | — | — |
| LGD8 | 0.831 | L | 38 | 12.3 | 0.11 | 21 | 8.12 | 0.07 | 6 |
| LGD8 | 0.827 | 0.16 | 37 | — | — | — | 7.93 | 0.13 | 3 |
| LGD8 | 0.864 | 0.04 | 43 | — | — | — | — | — | — |
| LGD6 | 0.767 | 0.04 | 27 | — | — | — | — | — | — |
| LGD6 | 0.753 | 0.03 | 25 | — | — | — | — | — | — |
| LGD6 | 0.899 | 0.04 | 49 | 11.4 | 0.28 | 11 | — | — | — |
| LGD6 | — | — | — | 12.5 | 0.08 | 23 | 8.20 | L | 7 |
| LGD24 | 0.834 | L | 38 | 13.1 | 0.06 | 28 | — | — | — |
| LGD24 | 0.762 | L | 26 | 12.8 | 0.07 | 25 | — | — | — |
| LGD24 | 0.822 | 0.02 | 36 | — | — | — | — | — | — |
| LGD24 | — | — | — | 12.4 | L | 22 | 8.05 | L | 5 |
| LGD24 | 0.849 | 0.03 | 41 | — | — | — | — | — | — |
| LGD21 | 0.843 | 0.03 | 40 | — | — | — | — | — | — |
| LGD21 | 0.802 | L | 33 | 11.0 | 0.21 | 8 | — | — | — |
| LGD21 | 0.900 | L | 49 | 12.5 | 0.03 | 23 | — | — | — |
| LGD21 | 0.785 | 0.03 | 30 | 12.9 | 0.05 | 27 | — | — | — |
| LGD21 | 0.716 | L | 19 | 11.7 | 0.17 | 15 | — | — | — |
| LGD19 | 0.688 | 0.08 | 14 | — | — | — | — | — | — |
| LGD19 | 0.656 | 0.07 | 9 | 11.2 | 0.07 | 10 | 7.87 | 0.15 | 2 |
| LGD19 | 0.673 | 0.29 | 11 | — | — | — | 7.96 | 0.07 | 4 |
| LGD19 | 0.714 | L | 18 | 11.8 | 0.29 | 15 | 8.04 | 0.28 | 5 |
| LGD18 | 0.721 | 0.15 | 19 | — | — | — | — | — | — |
| LGD18 | 0.813 | L | 35 | 11.9 | 0.13 | 16 | — | — | — |
| LGD18 | 0.700 | 0.10 | 16 | — | — | — | 7.82 | 0.27 | 2 |
| LGD18 | 0.760 | 0.01 | 26 | 13.1 | 0.10 | 29 | — | — | — |
| LGD18 | 0.814 | L | 35 | 12.9 | 0.25 | 27 | — | — | — |
| LGD17 | 0.801 | 0.14 | 33 | 13.2 | 0.03 | 29 | 8.27 | L | 8 |
| LGD17 | 0.722 | 0.02 | 20 | 12.7 | L | 25 | 8.04 | 0.21 | 5 |
| LGD17 | 0.753 | 0.07 | 25 | 11.5 | 0.27 | 12 | — | — | — |
| LGD17 | 0.691 | 0.10 | 15 | — | — | — | — | — | — |
| LGD16 | 0.699 | 0.03 | 16 | — | — | — | — | — | — |
| LGD16 | 0.833 | L | 38 | — | — | — | — | — | — |
| LGD16 | 0.761 | 0.07 | 26 | — | — | — | — | — | — |

TABLE 199-continued

Genes showing improved plant performance at Normal growth conditions under regulation of At6669 promoter

| | Leaf Area [cm²] | | | Roots Coverage [cm²] | | | Roots Length [cm] | | |
|---|---|---|---|---|---|---|---|---|---|
| Gene Name | Ave. | P-Val. | % Incr. | Ave. | P-Val. | % Incr. | Ave. | P-Val. | % Incr. |
| LGD16 | 0.712 | 0.08 | 18 | 12.1 | 0.23 | 19 | — | — | — |
| LGD16 | 0.804 | L | 33 | 14.5 | L | 42 | — | — | — |
| LGD15 | 0.806 | L | 34 | 12.0 | 0.24 | 17 | — | — | — |
| LGD15 | 0.764 | L | 27 | — | — | — | — | — | — |
| LGD12 | 0.696 | 0.15 | 15 | — | — | — | — | — | — |
| LGD12 | 0.724 | 0.05 | 20 | — | — | — | — | — | — |
| LGD12 | 0.822 | L | 36 | 11.9 | 0.12 | 16 | — | — | — |
| LGD12 | 0.636 | 0.25 | 5 | — | — | — | — | — | — |
| LGD11 | 0.686 | 0.11 | 14 | 11.9 | 0.05 | 17 | — | — | — |
| LGD11 | 0.688 | 0.14 | 14 | — | — | — | — | — | — |
| LGD11 | 0.694 | 0.12 | 15 | — | — | — | — | — | — |
| LGD11 | 0.903 | L | 50 | — | — | — | — | — | — |
| LGD11 | 0.734 | 0.06 | 22 | — | — | — | — | — | — |
| LGD10 | 0.712 | L | 18 | 11.8 | 0.07 | 16 | — | — | — |
| LGD10 | 0.747 | 0.08 | 24 | 12.6 | L | 24 | 8.07 | 0.03 | 5 |
| LGD10 | 0.780 | 0.02 | 29 | 11.7 | 0.10 | 15 | — | — | — |
| LGD10 | 0.756 | 0.08 | 25 | 11.6 | 0.20 | 14 | — | — | — |
| LGD10 | 0.692 | 0.20 | 15 | 11.7 | 0.04 | 15 | — | — | — |
| CONT. | 0.603 | — | — | 10.2 | — | — | 7.68 | — | — |
| LGB8 | 0.806 | L | 24 | 11.0 | 0.05 | 14 | 7.54 | 0.28 | 2 |
| LGB8 | 0.948 | L | 46 | 10.8 | 0.26 | 11 | — | — | — |
| LGB8 | 0.841 | 0.09 | 29 | 12.6 | L | 30 | 7.90 | 0.08 | 7 |
| LGB8 | 0.722 | 0.03 | 11 | — | — | — | 7.89 | 0.03 | 7 |
| LGB8 | — | — | — | 11.3 | L | 17 | 7.79 | 0.01 | 6 |
| LGB5 | 0.802 | 0.02 | 23 | 11.6 | 0.06 | 20 | — | — | — |
| LGB5 | 0.858 | 0.18 | 32 | 12.2 | 0.20 | 26 | 7.82 | 0.17 | 6 |
| LGB5 | 0.783 | L | 20 | 10.5 | 0.22 | 9 | — | — | — |
| LGB5 | 0.727 | 0.02 | 12 | 11.1 | 0.06 | 14 | 7.67 | 0.06 | 4 |
| LGB5 | 0.827 | 0.08 | 27 | 11.2 | 0.18 | 16 | — | — | — |
| LGB2 | 0.889 | 0.12 | 36 | 10.8 | 0.16 | 11 | — | — | — |
| LGB2 | 0.845 | 0.03 | 30 | 13.6 | L | 40 | 7.79 | 0.14 | 6 |
| LGB2 | 0.860 | L | 32 | 11.1 | 0.17 | 15 | — | — | — |
| LGB2 | — | — | — | — | — | — | 7.69 | 0.11 | 4 |
| LGB16 | 0.744 | 0.02 | 14 | 11.1 | 0.14 | 14 | 7.70 | 0.21 | 5 |
| LGB16 | 0.760 | 0.01 | 17 | 11.8 | 0.02 | 22 | — | — | — |
| LGB16 | 0.762 | 0.19 | 17 | — | — | — | — | — | — |
| LGB16 | — | — | — | — | — | — | 7.79 | 0.16 | 6 |
| LGB16 | 0.774 | 0.03 | 19 | 11.9 | 0.10 | 23 | — | — | — |
| LGB15 | 0.963 | L | 48 | 11.2 | 0.03 | 16 | — | — | — |
| LGB15 | 0.825 | 0.02 | 27 | 12.6 | 0.08 | 30 | 7.65 | 0.11 | 4 |
| LGB15 | 0.773 | 0.14 | 19 | — | — | — | — | — | — |
| LGB15 | 0.830 | 0.02 | 27 | 12.2 | 0.07 | 26 | 7.70 | 0.24 | 4 |
| LGB14 | 0.836 | 0.02 | 28 | — | — | — | — | — | — |
| LGB14 | 0.840 | 0.01 | 29 | 11.7 | 0.10 | 21 | 7.86 | 0.10 | 7 |
| LGB14 | 0.797 | L | 22 | — | — | — | — | — | — |
| LGB14 | 0.914 | L | 40 | 12.6 | 0.02 | 30 | 7.88 | 0.03 | 7 |
| LGB14 | 0.791 | 0.05 | 21 | 12.2 | 0.05 | 26 | 7.97 | 0.05 | 8 |
| CONT. | 0.652 | — | — | 9.70 | — | — | 7.37 | — | — |
| LGB9 | 1.10 | L | 23 | 14.5 | 0.04 | 19 | 7.77 | 0.20 | 4 |
| LGB9 | 1.17 | 0.06 | 31 | 14.6 | 0.16 | 20 | 7.83 | 0.06 | 4 |
| LGB9 | 1.14 | 0.09 | 27 | — | — | — | — | — | — |
| LGB9 | 1.07 | 0.09 | 20 | — | — | — | — | — | — |
| LGB18_H2 | 1.05 | 0.19 | 17 | — | — | — | — | — | — |
| LGB18_H2 | 1.02 | 0.02 | 13 | — | — | — | — | — | — |
| CONT. | 0.896 | — | — | 12.2 | — | — | 7.50 | — | — |
| LGM9 | 0.804 | 0.10 | 26 | — | — | — | — | — | — |
| LGM9 | 0.672 | 0.11 | 6 | — | — | — | — | — | — |
| LGM9 | — | — | — | — | — | — | 7.96 | 0.07 | 4 |
| LGM9 | 0.720 | 0.12 | 13 | 10.6 | 0.17 | 14 | — | — | — |
| LGM8 | 0.747 | 0.23 | 17 | — | — | — | — | — | — |
| LGM8 | 0.797 | L | 25 | — | — | — | — | — | — |
| LGM8 | 0.883 | 0.02 | 39 | 11.2 | 0.02 | 21 | 8.03 | 0.21 | 5 |
| LGM8 | — | — | — | — | — | — | 8.31 | L | 9 |
| LGM8 | 0.815 | L | 28 | 10.1 | 0.17 | 9 | — | — | — |
| LGM4 | 0.699 | 0.23 | 10 | — | — | — | — | — | — |
| LGM4 | 0.884 | 0.04 | 39 | — | — | — | — | — | — |
| LGM4 | 0.774 | 0.02 | 22 | 10.6 | 0.13 | 14 | — | — | — |
| LGM4 | 0.708 | 0.06 | 11 | — | — | — | 8.14 | 0.14 | 6 |
| LGM21 | 0.859 | L | 35 | 11.3 | 0.07 | 22 | 7.91 | 0.08 | 3 |
| LGM21 | 0.759 | 0.01 | 19 | — | — | — | — | — | — |
| LGM21 | 0.666 | 0.29 | 5 | 10.5 | 0.28 | 14 | — | — | — |
| LGM21 | 0.728 | 0.02 | 14 | 11.2 | 0.06 | 21 | — | — | — |

TABLE 199-continued

Genes showing improved plant performance at Normal growth conditions under regulation of At6669 promoter

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| CONT. | 0.637 | — | — | 9.28 | — | — | 7.65 | — | — |
| LGB10 | 1.23 | 0.16 | 18 | — | — | — | — | — | — |
| CONT. | 1.05 | — | — | — | — | — | — | — | — |

"CONT."—Control; "Ave."—Average; "% Incr." = % increment; "p-val."—p-value, L—p < 0.01.

TABLE 200

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LGD9 | 0.0787 | L | 26 | 1.48 | 0.17 | 18 | — | — | — |
| LGD9 | 0.0859 | L | 37 | 1.43 | 0.25 | 15 | — | — | — |
| LGD8 | 0.0843 | L | 34 | 1.49 | 0.13 | 20 | — | — | — |
| LGD8 | 0.0821 | L | 31 | 1.42 | 0.29 | 14 | — | — | — |
| LGD8 | 0.0890 | L | 42 | — | — | — | — | — | — |
| LGD6 | 0.0789 | L | 26 | — | — | — | — | — | — |
| LGD6 | 0.0779 | L | 24 | — | — | — | — | — | — |
| LGD6 | 0.0928 | L | 48 | — | — | — | — | — | — |
| LGD6 | — | — | — | 1.49 | 0.14 | 19 | — | — | — |
| LGD24 | 0.0877 | L | 40 | 1.58 | 0.05 | 27 | — | — | — |
| LGD24 | 0.0788 | L | 26 | 1.54 | 0.08 | 24 | — | — | — |
| LGD24 | 0.0866 | L | 38 | — | — | — | — | — | — |
| LGD24 | — | — | — | 1.52 | 0.10 | 22 | — | — | — |
| LGD24 | 0.0873 | L | 39 | — | — | — | — | — | — |
| LGD21 | 0.0889 | L | 42 | — | — | — | — | — | — |
| LGD21 | 0.0835 | L | 33 | — | — | — | — | — | — |
| LGD21 | 0.0926 | L | 48 | 1.53 | 0.09 | 22 | — | — | — |
| LGD21 | 0.0819 | L | 30 | 1.57 | 0.05 | 26 | — | — | — |
| LGD21 | 0.0732 | 0.06 | 17 | 1.42 | 0.29 | 14 | — | — | — |
| LGD19 | 0.0699 | 0.21 | 11 | — | — | — | — | — | — |
| LGD19 | 0.0699 | 0.22 | 11 | 1.43 | 0.28 | 15 | — | — | — |
| LGD19 | 0.0731 | 0.07 | 17 | 1.42 | 0.28 | 14 | — | — | — |
| LGD18 | 0.0736 | 0.08 | 17 | — | — | — | — | — | — |
| LGD18 | 0.0832 | L | 33 | 1.44 | 0.24 | 16 | — | — | — |
| LGD18 | 0.0717 | 0.12 | 14 | — | — | — | — | — | — |
| LGD18 | 0.0789 | L | 26 | 1.59 | 0.04 | 28 | — | — | — |
| LGD18 | 0.0838 | L | 34 | 1.56 | 0.08 | 25 | — | — | — |
| LGD17 | 0.0844 | L | 34 | 1.59 | 0.04 | 28 | — | — | — |
| LGD17 | 0.0729 | 0.08 | 16 | 1.54 | 0.07 | 24 | — | — | — |
| LGD17 | 0.0772 | 0.02 | 23 | — | — | — | — | — | — |
| LGD16 | 0.0727 | 0.08 | 16 | — | — | — | — | — | — |
| LGD16 | 0.0873 | L | 39 | — | — | — | — | — | — |
| LGD16 | 0.0805 | L | 28 | — | — | — | — | — | — |
| LGD16 | 0.0726 | 0.09 | 16 | 1.47 | 0.18 | 18 | — | — | — |
| LGD16 | 0.0854 | L | 36 | 1.75 | L | 41 | — | — | — |
| LGD15 | 0.0838 | L | 34 | 1.46 | 0.19 | 18 | — | — | — |
| LGDI5 | 0.0738 | 0.12 | 18 | — | — | — | — | — | — |
| LGD15 | 0.0786 | L | 25 | — | — | — | — | — | — |
| LGD12 | 0.0706 | 0.18 | 13 | — | — | — | — | — | — |
| LGD12 | 0.0765 | 0.02 | 22 | — | — | — | — | — | — |
| LGD12 | 0.0853 | L | 36 | 1.44 | 0.22 | 16 | — | — | — |
| LGD11 | 0.0688 | 0.29 | 10 | 1.46 | 0.18 | 18 | — | — | — |
| LGD11 | 0.0696 | 0.23 | 11 | — | — | — | — | — | — |
| LGD11 | 0.0720 | 0.11 | 15 | — | — | — | — | — | — |
| LGD11 | 0.0943 | L | 50 | — | — | — | — | — | — |
| LGD11 | 0.0758 | 0.03 | 21 | — | — | — | — | — | — |
| LGD10 | 0.0723 | 0.09 | 15 | 1.43 | 0.26 | 15 | — | — | — |
| LGD10 | 0.0763 | 0.02 | 22 | 1.54 | 0.07 | 23 | — | — | — |
| LGD10 | 0.0805 | L | 28 | — | — | — | — | — | — |
| LGD10 | 0.0770 | 0.02 | 23 | 1.42 | 0.29 | 14 | — | — | — |
| LGD10 | 0.0695 | 0.25 | 11 | 1.43 | 0.27 | 15 | — | — | — |
| CONT. | 0.0627 | — | — | 1.25 | — | — | — | — | — |
| LGB8 | 0.0853 | 0.03 | 25 | 1.30 | 0.15 | 14 | — | — | — |

TABLE 200-continued

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LGB8 | 0.0983 | L | 44 | 1.29 | 0.17 | 14 | 0.733 | 0.15 | 13 |
| LGB8 | 0.0836 | 0.07 | 22 | 1.52 | L | 33 | — | — | — |
| LGB8 | — | — | — | 1.34 | 0.07 | 17 | — | — | — |
| LGB5 | 0.0819 | 0.07 | 20 | 1.40 | 0.02 | 23 | 0.741 | 0.12 | 14 |
| LGB5 | 0.0891 | 0.03 | 31 | 1.47 | 0.01 | 29 | 0.721 | 0.25 | 11 |
| LGB5 | 0.0834 | 0.05 | 22 | 1.26 | 0.25 | 11 | — | — | — |
| LGB5 | — | — | — | 1.34 | 0.07 | 17 | — | — | — |
| LGB5 | 0.0872 | 0.03 | 28 | 1.34 | 0.10 | 17 | 0.726 | 0.23 | 12 |
| LGB2 | 0.0929 | L | 36 | 1.28 | 0.20 | 12 | — | — | — |
| LGB2 | 0.0885 | 0.01 | 30 | 1.64 | L | 44 | 0.730 | 0.19 | 13 |
| LGB2 | 0.0901 | L | 32 | 1.35 | 0.06 | 19 | 0.733 | 0.16 | 13 |
| LGB16 | 0.0774 | 0.22 | 13 | 1.28 | 0.21 | 13 | — | — | — |
| LGB16 | 0.0796 | 0.13 | 17 | 1.42 | 0.01 | 24 | — | — | — |
| LGB16 | 0.0795 | 0.15 | 16 | 1.36 | 0.11 | 19 | — | — | — |
| LGB16 | — | — | — | 1.37 | 0.09 | 21 | 0.711 | 0.29 | 10 |
| LGB16 | 0.0819 | 0.07 | 20 | 1.43 | 0.02 | 25 | 0.717 | 0.27 | 11 |
| LGB15 | 0.101 | L | 47 | 1.35 | 0.07 | 19 | — | — | — |
| LGB15 | 0.0857 | 0.03 | 25 | 1.51 | L | 33 | — | — | — |
| LGB15 | 0.0793 | 0.17 | 16 | — | — | — | — | — | — |
| LGB15 | 0.0863 | 0.02 | 26 | 1.48 | L | 30 | — | — | — |
| LGB14 | 0.0856 | 0.03 | 25 | — | — | — | 0.715 | 0.29 | 10 |
| LGB14 | 0.0867 | 0.03 | 27 | 1.37 | 0.07 | 20 | — | — | — |
| LGB14 | 0.0836 | 0.04 | 22 | — | — | — | — | — | — |
| LGB14 | 0.0956 | L | 40 | 1.53 | L | 34 | 0.734 | 0.16 | 13 |
| LGB14 | 0.0822 | 0.07 | 20 | 1.45 | L | 27 | — | — | — |
| CONT. | 0.0683 | — | — | 1.14 | — | — | 0.648 | — | — |
| LGB9 | 0.116 | 0.02 | 25 | 1.74 | 0.09 | 18 | — | — | — |
| LGB9 | 0.119 | 0.02 | 28 | 1.75 | 0.10 | 19 | 0.777 | 0.16 | 9 |
| LGB9 | 0.118 | 0.03 | 28 | — | — | — | — | — | — |
| LGB9 | 0.111 | 0.10 | 19 | — | — | — | — | — | — |
| LGB18_H2 | 0.108 | 0.17 | 16 | — | — | — | — | — | — |
| LGB18_H2 | 0.104 | 0.28 | 12 | — | — | — | — | — | — |
| CONT. | 0.0929 | — | — | 1.47 | — | — | 0.713 | — | — |
| LGM9 | 0.0831 | 0.05 | 23 | — | — | — | — | — | — |
| LGM9 | — | — | — | — | — | — | 0.773 | 0.29 | 6 |
| LGM9 | 0.0760 | 0.22 | 13 | 1.26 | 0.29 | 13 | — | — | — |
| LGM8 | 0.0775 | 0.19 | 15 | — | — | — | — | — | — |
| LGM8 | 0.0851 | 0.02 | 26 | 1.28 | 0.27 | 15 | 0.802 | 0.12 | 11 |
| LGM8 | 0.0942 | L | 39 | 1.34 | 0.11 | 20 | 0.790 | 0.17 | 9 |
| LGM8 | 0.0846 | 0.01 | 25 | — | — | — | — | — | — |
| LGM4 | 0.0954 | L | 41 | — | — | — | — | — | — |
| LGM4 | 0.0808 | 0.06 | 20 | 1.26 | 0.30 | 13 | — | — | — |
| LGM4 | 0.0768 | 0.18 | 14 | 1.28 | 0.29 | 14 | 0.803 | 0.10 | 11 |
| LGM21 | 0.0932 | L | 38 | 1.37 | 0.08 | 22 | — | — | — |
| LGM21 | 0.0821 | 0.04 | 22 | — | — | — | — | — | — |
| LGM21 | — | — | — | 1.28 | 0.25 | 15 | 0.773 | 0.30 | 6 |
| LGM21 | 0.0788 | 0.10 | 17 | 1.35 | 0.10 | 21 | — | — | — |
| CONT. | 0.0676 | — | — | 1.12 | — | — | 0.726 | — | — |
| LGB10 | 0.127 | 0.13 | 18 | — | — | — | — | — | — |
| CONT. | 0.107 | — | — | — | — | — | — | — | — |

"CONT."—Control; "Ave."—Average; "% Incr." = % increment; "p-val."—p-value, L—p < 0.01.

TABLE 201

Genes showing improved plant performance at Low Nitrogen growth conditions under regulation of At6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LGB8 | 4.25 | L | 10 | — | — | — |
| LGB8 | 6.30 | 0.10 | 63 | 94.4 | 0.11 | 71 |
| LGB8 | 5.10 | 0.25 | 32 | — | — | — |
| LGB8 | 5.28 | 0.24 | 37 | 72.9 | 0.23 | 32 |
| LGB5 | 4.50 | L | 17 | 65.2 | 0.25 | 18 |
| LGB5 | 4.15 | 0.15 | 7 | 65.0 | 0.04 | 18 |
| LGB5 | — | — | — | 74.6 | 0.17 | 35 |
| LGB5 | 4.20 | 0.17 | 9 | — | — | — |
| LGB2 | 4.88 | 0.23 | 26 | — | — | — |
| LGB2 | 4.60 | 0.06 | 19 | — | — | — |
| LGB2 | 4.83 | 0.05 | 25 | 74.3 | L | 34 |
| LGB2 | 4.42 | 0.19 | 15 | — | — | — |
| LGB16 | 4.62 | 0.05 | 20 | — | — | — |
| LGB16 | — | — | — | 80.3 | 0.14 | 45 |

TABLE 201-continued

Genes showing improved plant performance at Low Nitrogen growth conditions under regulation of At6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LGB16 | 4.17 | 0.16 | 8 | — | — | — |
| LGB15 | 5.20 | 0.28 | 35 | 77.0 | 0.18 | 39 |
| LGB15 | 4.20 | 0.14 | 9 | — | — | — |
| LGB14 | 4.35 | 0.20 | 13 | — | — | — |
| LGB14 | 4.25 | 0.12 | 10 | 66.8 | 0.04 | 21 |
| LGB14 | 4.55 | L | 18 | 66.2 | L | 20 |
| LGB14 | 4.62 | 0.05 | 20 | 65.8 | 0.23 | 19 |
| LGB14 | 4.15 | 0.14 | 7 | — | — | — |
| CONT. | 3.86 | — | — | 55.3 | — | — |
| LGB9 | 5.17 | 0.16 | 8 | 78.3 | 0.26 | 7 |
| LGB9 | 5.55 | L | 15 | 85.3 | 0.03 | 16 |
| LGB9 | 6.95 | 0.13 | 45 | 91.6 | 0.25 | 25 |
| LGB9 | 5.50 | L | 14 | — | — | — |
| LGB9 | 5.42 | 0.17 | 13 | — | — | — |
| LGB18_H2 | 5.47 | 0.06 | 14 | 79.9 | 0.20 | 9 |
| LGB18_H2 | 6.62 | 0.07 | 38 | 90.9 | 0.09 | 24 |
| LGB18_H2 | 5.50 | 0.05 | 14 | 84.8 | L | 16 |
| CONT. | 4.81 | — | — | 73.3 | — | — |

"CONT."—Control; "Ave."—Average; "% Incr." = % increment; "p-val."—p-value, L—p < 0.01.

TABLE 202

Genes showing improved plant performance at Low Nitrogen growth conditions under regulation of At6669 promoter

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LGB8 | 0.445 | L | 18 | 18.0 | 0.08 | 33 | 8.38 | 0.19 | 5 |
| LGB8 | 0.463 | 0.15 | 23 | — | — | — | 8.26 | 0.13 | 3 |
| LGB5 | — | — | — | 15.6 | 0.21 | 15 | — | — | — |
| LGB5 | — | — | — | 17.4 | L | 28 | — | — | — |
| LGB5 | — | — | — | 15.7 | 0.01 | 16 | — | — | — |
| LGB5 | 0.418 | 0.03 | 11 | 16.2 | L | 19 | — | — | — |
| LGB2 | — | — | — | 15.6 | 0.05 | 15 | 8.38 | L | 5 |
| LGB2 | — | — | — | 15.1 | 0.05 | 11 | — | — | — |
| LGB2 | — | — | — | 16.7 | 0.01 | 23 | — | — | — |
| LGB16 | 0.418 | 0.05 | 11 | — | — | — | — | — | — |
| LGB15 | — | — | — | 15.4 | 0.19 | 13 | — | — | — |
| LGB14 | — | — | — | 15.5 | 0.21 | 14 | — | — | — |
| LGB14 | 0.397 | 0.24 | 5 | — | — | — | 8.24 | 0.24 | 3 |
| LGB14 | 0.429 | 0.06 | 13 | 16.0 | 0.12 | 18 | 8.21 | 0.19 | 3 |
| LGB14 | 0.406 | 0.19 | 7 | 15.8 | L | 16 | — | — | — |
| CONT. | 0.378 | — | — | 13.6 | — | — | 7.99 | — | — |
| LGB9 | 0.454 | 0.05 | 9 | 18.3 | L | 20 | 8.26 | 0.02 | 3 |
| LGB9 | — | — | — | 20.3 | 0.02 | 33 | 8.57 | L | 7 |
| LGB9 | — | — | — | 18.3 | 0.10 | 20 | — | — | — |
| LGB9 | — | — | — | 18.3 | 0.19 | 19 | 8.20 | 0.28 | 2 |
| LGB18_H2 | 0.443 | 0.09 | 6 | 17.9 | 0.14 | 17 | — | — | — |
| LGB18_H2 | 0.467 | 0.09 | 12 | 20.0 | L | 30 | 8.24 | 0.16 | 3 |
| LGB18_H2 | — | — | — | 16.3 | 0.19 | 6 | — | — | — |
| LGB18_H2 | 0.479 | L | 14 | — | — | — | — | — | — |
| LGB18_H2 | — | — | — | 16.0 | 0.23 | 5 | — | — | — |
| CONT. | 0.418 | — | — | 15.3 | — | — | 8.04 | — | — |
| LGB10 | — | — | — | — | — | — | 8.24 | 0.27 | 3 |
| CONT. | — | — | — | — | — | — | 8.01 | — | — |

"CONT."—Control; "Ave."—Average; "% Incr." = % increment; "p-val."—p-value, L—p < 0.01.

TABLE 203

Genes showing improved plant performance at Low Nitrogen growth conditions under regulation At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LGB8 | — | — | — | — | — | — | 0.767 | 0.27 | 8 |
| LGB8 | — | — | — | 2.18 | L | 35 | — | — | — |
| LGB8 | 0.0414 | 0.02 | 22 | 1.78 | 0.24 | 10 | — | — | — |
| LGB8 | — | — | — | 1.77 | 0.24 | 9 | — | — | — |

TABLE 203-continued

Genes showing improved plant performance at Low Nitrogen growth conditions under regulation At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LGB5 | — | — | — | 1.89 | 0.05 | 17 | 0.830 | 0.02 | 17 |
| LGB5 | — | — | — | 2.12 | L | 31 | — | — | — |
| LGB5 | — | — | — | 1.91 | 0.02 | 18 | — | — | — |
| LGB5 | — | — | — | 1.96 | L | 21 | — | — | — |
| LGB2 | — | — | — | 1.89 | 0.04 | 17 | — | — | — |
| LGB2 | — | — | — | 1.84 | 0.07 | 14 | 0.784 | 0.16 | 10 |
| LGB2 | — | — | — | 2.03 | L | 26 | 0.766 | 0.30 | 8 |
| LGB16 | 0.0369 | 0.21 | 8 | — | — | — | — | — | — |
| LGB15 | — | — | — | 1.86 | 0.06 | 15 | — | — | — |
| LGB15 | — | — | — | 1.87 | 0.10 | 15 | — | — | — |
| LGB14 | — | — | — | 1.89 | 0.04 | 17 | 0.795 | 0.10 | 12 |
| LGB14 | 0.0374 | 0.15 | 10 | 1.93 | 0.02 | 19 | — | — | — |
| LGB14 | — | — | — | 1.83 | 0.18 | 13 | — | — | — |
| LGB14 | — | — | — | 1.91 | 0.01 | 18 | — | — | — |
| CONT. | 0.0340 | — | — | 1.62 | — | — | 0.710 | — | — |
| LGB9 | — | — | — | 2.22 | L | 19 | — | — | — |
| LGB9 | — | — | — | 2.48 | L | 33 | 0.879 | 0.11 | 12 |
| LGB9 | — | — | — | 2.25 | 0.02 | 20 | 0.853 | 0.20 | 9 |
| LGB9 | — | — | — | 2.25 | 0.02 | 20 | 0.851 | 0.22 | 8 |
| LGB18_H2 | — | — | — | 2.17 | 0.05 | 16 | — | — | — |
| LGB18_H2 | — | — | — | 2.44 | L | 31 | — | — | — |
| LGB18_H2 | 0.0375 | 0.17 | 8 | 2.06 | 0.23 | 10 | — | — | — |
| CONT. | 0.0346 | — | — | 1.87 | — | — | 0.785 | — | — |

"CONT."—Control; "Ave."—Average; "% Incr." = % increment; "p-val."—p-value, L—p < 0.01.

Example 27

Evaluation of Transgenic Brachypodium Nue and Yield Under Low or Normal Nitrogen Fertilization in Greenhouse Assay Assay 1: Nitrogen Use efficiency measured plant biomass and yield at limited and optimal nitrogen concentration under greenhouse conditions until heading—This assay follows the plant biomass formation and growth (measured by height) of plants which are grown in the greenhouse at limiting and non-limiting (e.g., normal) nitrogen growth conditions. Transgenic Brachypodium seeds are sown in peat plugs. The $T_1$ transgenic seedlings are then transplanted to 27.8×11.8×8.5 cm trays filled with peat and perlite in a 1:1 ratio. The trays are irrigated with a solution containing nitrogen limiting conditions, which are achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels are achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants are grown in the greenhouse until heading. Plant biomass (the above ground tissue) is weighted right after harvesting the shoots (plant fresh weight [FW]). Following, plants are dried in an oven at 70° C. for 48 hours and weighed (plant dry weight [DW]).

Figure 9B:
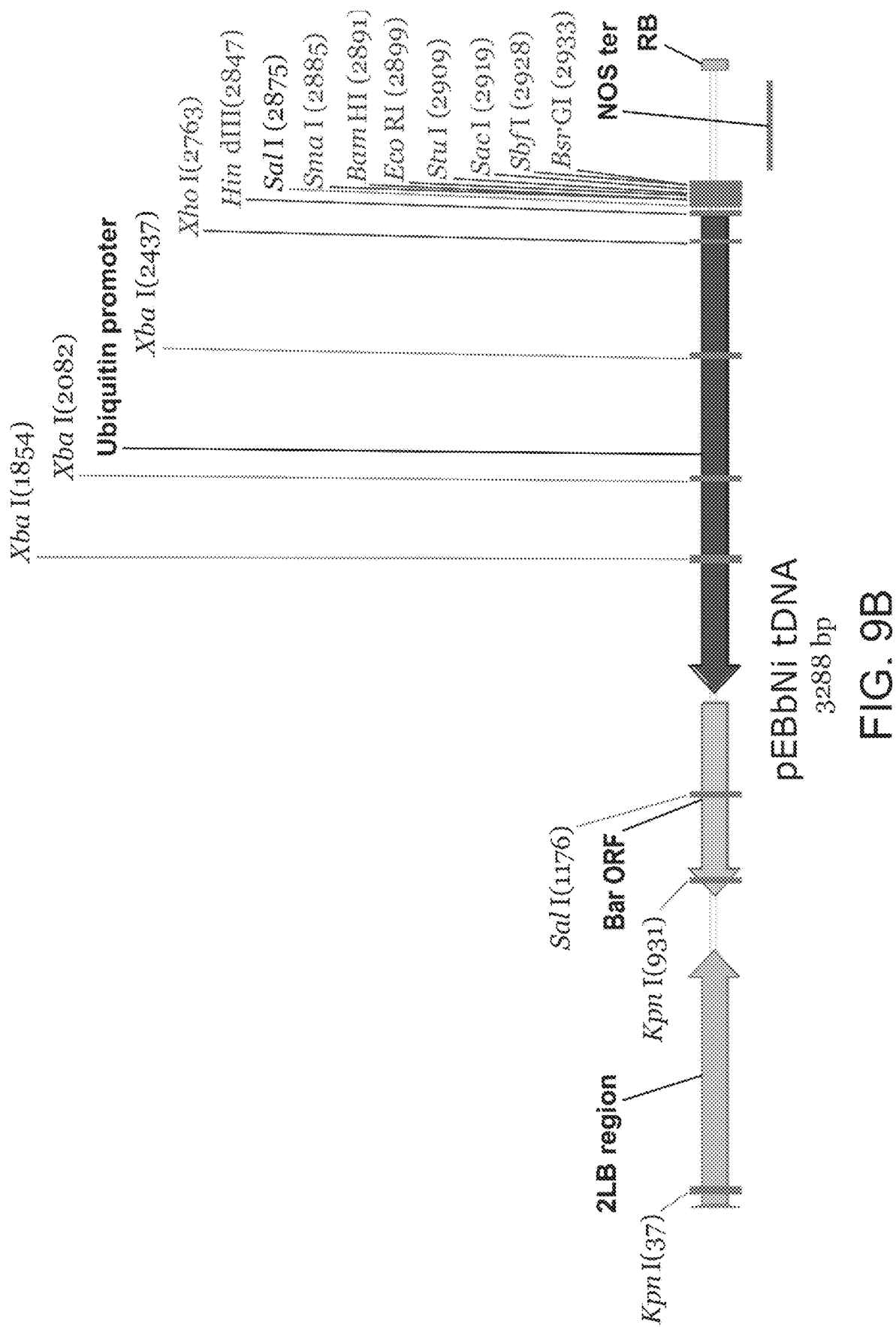

Each construct is validated at its $T_1$ generation. Transgenic plants transformed with a construct conformed by an empty vector carrying the BASTA selectable marker are used as control (FIG. 9B).

The plants are analyzed for their overall size, fresh weight and dry matter. Transgenic plants performance is compared to control plants grown in parallel under the same conditions. Mock-transgenic plants with no gene and no promoter at all, are used as control (FIG. 9B).

The experiment is planned in blocks and nested randomized plot distribution within them. For each gene of the invention five independent transformation events are analyzed from each construct.

Phenotyping

Plant Fresh and Dry shoot weight—In Heading assays when heading stage has completed (about day 30 from sowing), the plants are harvested and directly weighed for the determination of the plant fresh weight on semi-analytical scales (0.01 gr) (FW) and left to dry at 70° C. in a drying chamber for about 48 hours before weighting to determine plant dry weight (DW).

Time to Heading—In both Seed Maturation and Heading assays heading is defined as the full appearance of the first spikelet in the plant. The time to heading occurrence is defined by the date the heading is completely visible. The time to heading occurrence date was documented for all plants and then the time from planting to heading is calculated.

Leaf thickness—In Heading assays when minimum 5 plants per plot in at least 90% of the plots in an experiment have been documented at heading, measurement of leaf thickness is performed using a micro-meter on the second leaf below the flag leaf.

Plant Height—In both Seed Maturation and Heading assays once heading is completely visible, the height of the first spikelet is measured from soil level to the bottom of the spikelet.

Tillers number—In Heading assays manual count of tillers is preformed per plant after harvest, before weighing.

Example 28

Evaluation of Transgenic Brachypodium Nue and Yield Under Low or Normal Nitrogen Fertilization in Greenhouse Assay Assay 2: Nitrogen Use efficiency measured plant biomass and yield at limited and optimal nitrogen concentration under greenhouse conditions until Seed Maturation—This assay follows the plant biomass and yield production of plants that are grown in the greenhouse at limiting and non-limiting nitrogen growth conditions. Transgenic Brachypodium seeds are sown in peat plugs. The $T_1$ transgenic seedlings are then transplanted to 27.8×11.8×8.5 cm trays filled with peat and perlite in a 1:1 ratio. The trays are irrigated with a solution containing nitrogen limiting conditions, which are achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels are achieved by applying a solution of 6 mM inorganic nitrogen also in the form of $NH_4NO_3$ with 1 mM $KH_2PO_4$, 1 mM $MgSO_4$. 2 mM $CaCl_2$, 3.6 mM KCl and microelements. All plants are grown in the greenhouse until seed maturation. Each construct is validated at its $T_1$ generation. Transgenic plants transformed with a construct conformed by an empty vector carrying the BASTA selectable marker are used as control (FIG. 9B).

The plants are analyzed for their overall biomass, fresh weight and dry matter, as well as a large number of yield and yield components related parameters. Transgenic plants performance is compared to control plants grown in parallel under the same conditions. Mock-transgenic plants with no gene and no promoter at all (FIG. 9B). The experiment is planned in blocks and nested randomized plot distribution within them. For each gene of the invention five independent transformation events are analyzed from each construct.

Phenotyping

Plant Fresh and Dry vegetative weight—In Seed Maturation assays when maturity stage has completed (about day 80 from sowing), the plants are harvested and directly weighed for the determination of the plant fresh weight (FW) and left to dry at 70° C. in a drying chamber for about 48 hours before weighting to determine plant dry weight (DW).

Spikelets Dry weight (SDW)—In Seed Maturation assays when maturity stage has completed (about day 80 from sowing), the spikelets are separated from the biomass, left to dry at 70° C. in a drying chamber for about 48 hours before weighting to determine spikelets dry weight (SDW).

Grain Yield per Plant—In Seed Maturation assays after drying of spikelets for SDW, spikelets are run through production machine, then through cleaning machine, until seeds are produced per plot, then weighed and Grain Yield per Plant is calculated.

Grain Number—In Seed Maturation assays after seeds per plot are produced and cleaned, the seeds were run through a counting machine and counted.

1000 Seed Weight—In Seed Maturation assays after seed production, a fraction is taken from each sample (seeds per plot; ~0.5 gr.), counted and photographed. 1000 seed weight is calculated.

Harvest Index—In Seed Maturation assays after seed production, harvest index is calculated by dividing grain yield and vegetative dry weight.

Time to Heading—In both Seed Maturation and Heading assays heading is defined as the full appearance of the first spikelet in the plant. The time to heading occurrence is defined by the date the heading is completely visible. The time to heading occurrence date was documented for all plants and then the time from planting to heading is calculated.

Leaf thickness—In Heading assays when minimum 5 plants per plot in at least 90% of the plots in an experiment have been documented at heading, measurement of leaf thickness is performed using a micro-meter on the second leaf below the flag leaf.

Grain filling period—In Seed Maturation assays maturation is defined by the first color-break of spikelet+stem on the plant, from green to yellow/brown.

Plant Height—In both Seed Maturation and Heading assays once heading is completely visible, the height of the first spikelet is measured from soil level to the bottom of the spikelet.

Tillers number—In Heading assays manual count of tillers is preformed per plant after harvest, before weighing.

Number of reproductive heads per plant—In Heading assays manual count of heads per plant is performed.

Statistical analyses—To identify genes conferring significantly improved tolerance to abiotic stresses, the results obtained from the transgenic plants are compared to those obtained from control plants. To identify outperforming genes and constructs, results from the independent transformation events tested are analyzed separately. Data is analyzed using Student's t-test and results were considered significant if the p value is less than 0.1. The JMP statistics software package was used (Version 5.2.1, SAS Institute Inc., Cary, N.C., USA).

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (6822 sequences)

SEQ ID NO: 1 - DNA, 2502 bp, Hordeum vulgare
gccgcgccgcgagccgctgggccgaccgcctcttcgccgacttccacctcctccccgccgccgcgcccgagccgccggccgcggcccccgccggcgtctccgcgtcccccttcgtcccgctcttccccgacgccgccgaccgctcctttcccctccaggtcgacctctacaaggttctcggcgcggagccgcatttcctcggcgacggcgtcaggcgggcattcgaggcgcggacggccaagccaccgcagtacggctacagcacggatgcccttgttggccgtcggcaaatgctgcagattgcacatgatacactcacaaaccagagctcccgcaccgagtatgaccgcgcgctctctgaggaccgtgacgccgcgctcacgttggatgttgcttgggataaggttccgggtgtgctgtgtacccttcaggaggctggggaggcacaggcagtgctcgcaattggagagcacttgctggaggaccgcccgcccaagcggttcaagcaggatgtggtgctgacaatggctcttgcttatgtggacatatcaagggacgcaatggcggctagccctccagatgtaatctgctgctgtgaggtgcttgaaagggctctcaagctcttgcaggaggatggggcaatcaatcttgcacctgatctgctttcacaaattgatgaaactctggaggagatcacccctcgttgtgttttagagtttcttgcccttcctcttgacgagaagcaccagagtaaacgccaagaaggtcttcgtggtgtgagaaacattttgtggagtgttggtagaggaggtattgctactgttggtggaggattttcacgggaagcctacatgaatgaggcctttttgcagatgacatcagctgagcagatggatttcttttcaaaaacgccgaatagcataccacctgaatggtttgaaatctatagcgtggcactcgcaaatgttgctcaagcaattgtaagtaaaaggccagagctcatcatggtggcagatgatcttttcgaacaactccagaagttcaatatcggttctcaatatgcttatggtaacgagatggatcttgcgttggaaagggcactttgctcattgcttgtgggagacattagcaactgcagaacttggcttgcgattgataatgaatcttcaccacatagagacccgaaaattgtagagtttattgtgaacaactctagcattgaccaccaggagaatgatcttcttccaggcctgtgtaagcttttggagacttggcttgtctcagaggttttccctaggagcagagatactcgaggcatgcagtttacacttggagactactacgatgatccaaaagttttaagctacctagaaatgatggaaggtggtggtgcttctcatttggctgctgctgctgctatagcaaaacttggtgctcaagctactgctgcgcttggtaccgtgaaatcaagtgctattcaagcattcaacaagatttttccattgatagaacagctagatcgatcagccatggagaatcctaatgatggccttgaggaatctgtcaataaatttgaccagaaaaacattatgggatttgatatccttgattccaaaaacgctttcctgaagattgtctctgccagtgcattatttgctctgttgacggtaataggcatgaagtacttgccccgtaagaaggcgctcctccctgctatcagaagcgagcatgagtccgtggcagttgctaatgttgttgactcagttgatgatgacgaaccagatgagcccatacagattcctaaaatggatgcgaagctggcagaagatattgttcgcaagtggcagagcatcaaatccaaggccttgggatcagatcattctgttgcatcattgcaagaggttcttgatggcaacatgctgaaggtatggacagaccgagcagcagagattgagcgcaaaggctggttctgggactacacgctgttcaacgtggcgatcgacagcatcaccgtctccctggacggacggcgggcgaccgtggaggcgacaattgaggaggcgggtcagctcaccgacgcaaccgaccccaggaacgatgatttgtacgacactaagtacaccacccggtacgagatggccttcaccggaccaggagggtggaagataaccgaaggcgcagtcctcaagtcgtcatagggcgttcagcgtgcagtaaaccttgttgattgattcctcccgtgtttttctggtgtgtaaataagcagtctagtctaggctcttgtcagtttggaagacggagatagtttggttagtcagttagtcagcgatgagctttgtttttcggtgtgttctattcggattattgctaggctagaagagatccttgggttggtgataagagaaacttagtgctggatttgcaggtgaagccatccttttgatcctcttttacaaaatccctacacaaaaaagtatacccttcataaatagttgatgcggc

SEQ ID NO: 2 - DNA, 2084 bp, Hordeum vulgare
tgggagtaggggtttaggagaagccgcaaacccaagaaaaaacagattccagatactaccacctccggaactgaaaccccactcctcccgtcggtcgacagggcggccaaccacctcaaattctccacctccttccccaaatctctcttgtgaagcgcacggcggcgatatcttgggatttcggcgcggtccggcctgagtcgctcgtgactgtgctgtgccctagagctgcaggcgtgccgcggtccgccttcttccgcgccgccgccgccgccgccatcgccgttcccgttctacaaaccgacctccaaattttctgggtgtgcaccggcacgccaggcacaacatctggatccgcttctgcctgccattcagctcgctgggatggcgacgcagctgccgtgcttcacgcagctcaccccgccgtcacctggatggagaaacgaagccgggagtctcggtgctacatctgggagggcgttggtcaggagcactccatttccgggtcactctcacttcaggtgccgcgcaagcccacgcagcgctaactcgtttcagaagaaagactccttcctggaccttcatccggaggtgtccctgctccgaggcgagcagaacgacgagtctattaacccaaggaaagcttcttctgatgggagcacgttggaggggctgggggtgccgccgagccaggacgattacaacgctgccaagatcaaggtcgttggggtcgggggtgggggttcaaatgctgtcaacaggatgattgagtactccatgaatggtgtcgagttttggatcgtgaacaccgatgtacaggcgataaggatgtcccctgtgcattcccagaacaggctgcagattgggcaggagctcactcggggtttgggtgcgggtggaaaccctgatatcgggatgaatgccgccaaggagagctgtgagtccatagaggaagcacttcatggtgctgacatggtttttgtcacggctggaatgggtgggggaaccggaactggaggtgcccctgtaattgctggaatcgctaagtccatgggtatactgactgtgggtattgtcacaacacccttttcatttgaggggaggaggcgcgcagttcaggctcaagaaggaattgcagccttgagaaatagtgtggacactctcattgtcatcccaaacgacaagctgttgtctgctgtttctccaaacactcctgtcatggaagcattcaacttggctgatgatattctttggcaaggaattcgtggtatctctgatatcatcacggttcctgggctggtgaatgttgattttgctgatgtgcgagctataatgcaaaatgcagggtcatctttgatgggtatagggactgcaacaggtaagtcaagagcaagagacgctgctcttaatgccattcagtcaccactgctagatattggaattgagagggctacaggcatcgtgtggaatatcactggaggaactgatttgactttgtttgaggtaaatgctgcagctgaagtaatctacgatctcgttgatccaaatgccaacctgatatttggttctgtcatagacccatcactcaatggccaggtcagcataacattgatcgctactggctttaaacgccaggatgaagcagaaggtcgcaccgcaaagggtggccagcaaatgcaaggagacaacggtcgagatccatcttccacaggtggaagcaaggtggagattcctgagttccttcggaagagaggaccgtctcgcttcctgcgaatttgactcttccccaggatccctttctcagatatgcctgatgatacttgcccctcgtagattagatgccctcttgtaagataccagatcggtagagtctagttgttttccgtagagttttttttcccatagttttgtttgatctttctgttctttatcttggaatgttactgccaataatgtgtagctgtgagcatgccagtgttgtagaaaatgttctgccttcctggtgtgtccttctatcgtgcgctcttcatttcccctccggcctacttatctccctgtccccttaatcgattattttttatgca

SEQ ID NO: 3 - DNA, 1195 bp, Gossypium hirsutum
accttgtgttgggtgattgttaaagggtcaattttgtgtctataaatgtctatctggtaaagcagaaaactgccttttttttgcaacacaaaactgtagctctacttaacctatattcatcaaaagaaggagaagagttggaattcaagagcttagcctttctcatagttcaattccttgccagctttgaaccatggagttccctaatctagacccagaaagctcttcccagaaaaaaatgggaagaggcaaaatcgagattaagcggatcgagaacaccactaatcgacaagttaccttctgcaagcgccgcaatggactgctcaaaaaggcctatgaattatctgttctttgtgatgctgaggtggctctcatagtcttctccagccgtggccgtctctatgaatatgctaacaacagtgtgagagcaacaattgagagatacaagaaagcatgctcagatgcaacaactccagggtctgtggctgaagccaacattcagttctaccagcaagaagccaccaaactccgacgacaaattcgtgatgttcagaacatgaacaggcatatccttggagaggctctgagctcattgacctttaaggaactcaagaaccttgaaggcaggctggagaaaggcatttgtagaatcagatccaaaaagaacgaattactgtttgcagaaattggattcatgcaaaagagggaagttgaactgcagaacgataacatgtacctgcgagcaaaaatagctgaaaatgaaagagcgcaacaacaatcaaaccagctgatacaagcagcctcctcctacaatcgcaactttctgccagtaaacctgctggaacccagtaataatgattactccaaccaagaccaaactcctcttcaacttgtataagcttctctcttccacctccatctattcaagctgacatgcaagcagcagcctctaatgttctaccaactttatctctggttaagcatatatatatatcttataagccatgcaagtatatatatatatatttatatatggtttataaacagttgaaagcgtagttgttgattgtgatgaatgtaaggaacttaggtttcagtactggactcctttttaactgttatattgcaggaaaggtttatttttgtattatatatgtttcttaaaactctacatatagttttcatcccttctctc

SEQ ID NO: 4 - DNA, 707 bp, Gossypium raimondii
ttcttcaattgtttttttctctcattgtcccccattttctttcttcattttttcaagcggctatgttttccagaggaacaaatgcatcatctggcatgggagtggctgatcacagcaaaagcacttacctggagctgcaaagaaagaaggtgtttcgatacgtgatctttaagatcgatgagaagaaaaaggaggtagttgttgaaaaaacaggaggtccatcagagaactatgatgatttcactgcttcattgcctgagaatgactgccgctatgcagtttacgactttgattttgtgacttctgagaattgtcagaagagcaagatcttttttattgcatggtcaccgtctgtttcaaggatccgtgccaagatgctgtatgcaacatccaaggaaaggttcataagggaattagagggcattcattacgaaatccaggcaactgacccaactgagatggatctcgaggtgattagagagcgtgcaagttaaaagtgttgaaatcccgtcatcaatgccgcatgcttaggaaactcctgtgtttaattattgttaaataacacctaggaaggctgattaggagctcagggtgttcaaaacatgtcgggactttatgctcctcattccacatgatgcttctgaggtgacaatggatgtgttattattgaatagtttgacccttcgttaatgaaaattttcatttca

SEQ ID NO: 5 - DNA, 2949 bp, Sorghum bicolor
cccacctgccgcacccttcttcttccccaaccctattccaaaccctgctccagacgggagtgccaatctccaattcaaagccctattccagaccctgaatcttacacaagccgcagtcgtccgtgatggaggcgttcagtgggttctacgtggacgagaaggcggcgcgggtggagaacatcttcctcgagttcctgaagcgattcaaggagtcggatggcgcgggggagccgttctacgaggtggagatggaggcgatgcggtcgcgggagtccactaccatgtacgtagactttgagcacgtcatgcgcttcaacgacgtcctccagaaggccatctccgaggagtacctcaggtttgaaccatgcttaaggaatgcatgcaagaggtttgtgttggagcaccgggctggcgagaaccgtgccccaatcatctcagatgatagtcccaacaaggatatcaacattgccttctataacatcccgatgctgaaaaaactgagagagcttgggacagccgaaattggtaagctcacagcagtaatgggtgttgtgacacggacaagtgaagtgcggcctgaactattgcaaggcaccttcaaatgccttgactgtgggaatgttgtaaagaatgtggagcagcagttcaagtacactgagccgataatatgcgttaatgcaacttgccagaaccgaacaaaatgggcccttctccgccaggaaagcaaattcacagattggcagcgggtcagaatgcaggagacatcaaaagagatacctgctgggtcgcttcctcgttcccttgatgtcattctgcggcatgagattgttgagaaggctagagctggggacacggttatatttactggaactgttgttgcagttcctgatgttatggcactaacttcacctggtgaacgagcagagtgtcgcagggaaggtcctcagcgaaaaaatggaggtgttcaagaaggtgtaaagggcttgaagtcccttggagttagggatctctcttatcgcctcgcttttgtagcaaattcagtgcaggtcgcagatggcaggagagaagtggacatcagggatcgtgacacagatggcgatgacagtgagagacagaaattcacagaagaagaggaagatgaggttgttaggatgaggaacactcctgatttctttaataagatagttgatagcatatgccctaccgtctttggtcatcaagaaattaagagggcagtgcttcttatgcttttgggtggtgttcataagataacacatgaagggatcaacctgagaggtgacatcaatgtctgtattgttggcgacccaagctgtgcaaagtcccagtttctaaagtatactgctggtattgttccaagatctgtttacacatcagggaagtcgtcatctgctgctggtctgacagcaactgttgctaaagaaccagagactggtgaattctgtattgaggctggtgccctgatgttagctgataatggcatttgttgtatcgatgaatttgataaaatggacattaaggatcaggtcgctatacatgaagcaatggaacagcaaacaattagcataaccaaagcaggaatacaggcaactttgaatgcacgaacatcaattttagctgcagcaaatccgacaggtggccgttatgacaagtcaaaaccacttaagtacaatgtggcattgcccccagctattctttcaagatttgatctggtctacatcatgattgatgaacctgatgaaaacactgactaccacattgctcatcacattgtaagagtccatcagaaacgtgaagaagcacttgcccctgcatttagcacagcacaactgaagcgttatatttcttttgcaaagtctttgaaacctcagctgagttcagaagcaaagaaagttctggtggagtcgtatgttacccttcgtagaggggacagtactcctggaactagggttgcttacaggatgacagttcgacaattggaagcattgattcggctgtccgaagctattgctcgaagccatttagaaagagttgttctcccagctcatgtccgcctggcagttaaattgctcaagacatccatcatcagtgttgaatcaagtgaagttgatctctctgacttccaagatgctgaagatggaacaaatgtaccttctgagaatgatgctggacagccagctgaagaagatactgctcctcagcagcagggtgcagaaaatgaccaagcagcggacagcggtaagaagaaattggtaataactgaagaacacttccagagagttactcaagctttggttatgagactaaggcagcatgaagagtcagtcaagaaagatggcgatggtttggctggcatgaagcaaggggatcttatcatttggtatgttgagcagcagaatgccaaaggggcatatagttctacagcagaggtgaaggaagaagtgaagtgtatcaaggccattatagagagacttatacagcgggaaggccatcttatagtcattgatgaaggcacagcagccccagccgaagatggcagtggcgtaagaagaacatcagagagcagaatattggcagttaacccgaactatgttgttgattagcaacagctttgtaacatgctgctaactcaagtcagctgatgtggttaacgaacataagctgtagttcgggtgatgtgcctgttgtgccctggcattgttgtaccatctccgtcactgatgtgctcattgcaaaggagcacatgatcctcaaaatttataatttgtttcctcttgcttctaggcttagtgatgcatgataattagcgtatgtagtctgactatataattttgaccgtgtttccctagtgaagtttcatagcatcagcttgatttatcagtcaatgagtactgcaatttcctatttgcgttcgccctttttggaatccat

SEQ ID NO: 6 - DNA, 2566 bp, Oryza sativa
tctccccctcactcctaaaacctctctctcctccgccccctccatctccgccgccgccgccgcggcggctaatggagggcttccacaacctcctcgcccgccccaactcggcgccattcgccttctccctccctcgcccgcgcccgcgcccgcgccgcaggccgccgcctcacccctccgctgcctgccgcgccgcgagccgctgggccgaacgcctcttcgccgacttccacctcctccccaccgccgcgccctccgacccgccgtccccggccccggccccggccgccgcgccctccgcctcccccttcgtcccgctcttccccgacgccgccgaacgctccctcccgctccaagtcgatttctacaaggttctaggggcagagccacatttccttggcgatggcatcaggagggcgttcgaggcacggatagccaagccaccgcagtatggctacagcacggatgctcttgttggtcgtcgacaaatgctgcagattgcccatgacactctcatgaaccagaactcccgcactcagtatgatcgtgcgctttctgagaaccgtgaagaagctctcaccatggatattgcttgggacaaggttccaggtgtgttgtgtgcgcttcaggaggctggggaggcacttgctgtgcttgtaactggagaacagttgcttctggatcggccacccaagcgcttcaagcaggacgtggtgctagcgatggctctggcttatgtggatctatcaagggatgctatggcagcaagccctccagatgtaattggctgctgcgaggtgctcgagagggctctcaagctcttgcaggaagatggagcaagcaatctcgcacctgatctgctttcacagattgatgaaactctcgaggagattacacctcgctgtgtattggagcttctctcccttcctattgacacagagcatcataagaagcgccaagaagggcttcaaggtgcgagaaacattttgtggagcgttggcagaggaggtattgctaccgttggaggaggattttctcgtgaagccttcatgaacgaggcttttttgaggatgacatcaattgaacagatggatttcttttcaaaaacaccgaatagcattcctcctgaatggtttgaaatttacaatgtagcacttgcacatgtcgctcaagcaattataagtaaaaggccacaattcatcatgatggcggatgatctttttgaacaactccagaagttcaacataggttctcattatgcttatgataatgagatggaccttgcattggaaagggcattctgctcattgctagtcggagatgttagcaagtgcagaatgtggcttggaattgataatgagtcttcaccatacagagaccccaaaattctagagtttattgtgaccaactctagcatcagtgaagagaatgatcttcttccagggctgtgcaagcttttggagacttggcttatctttgaggtttttcctaggagcagagatactcggggcatgcagttcagacttggagattactacgatgatccagaagttttaagctacctagaaaggatggagggtggtggtgcttctcatttggctgctgctgctgctattgcaaaacttggtgctcaagctacagctgcacttggtactgtgaaatcaaatgctattcaagcgttcaacaaggtttttccattgatagaacagttagacaggtcagccatggaaaatactaaagatggccctgggggatatcttgaaaattttgaccaggaaaatgcacctgctcatgattcgagaaatgccgccttgaagattatctctgctggcgcactgtttgcactgttggcagtaattggggccaaatatttgcctcgtaagaggcccctttctgctattaggagtgagcatggatctgtggcagttgctaatagtgtcgactctactgatgatcctgcactagatgaagatccagtacatattcctagaatggatgcgaagctggcagaagatattgttcgcaagtggcagagtatcaaatctaaggccttgggaccagaacattcggttgcatcattgcaagaggttcttgatggcaacatgctaaaggtgtggactgaccgagcagcggagattgagcgtcatgggtggttctgggagtatacactatccgatgtgacgattgatagcatcactatctccctagatggtcgacgagcgactgtggaggctacgattgatgaggcaggccaacttactgatgttactgagcccagaaacaatgattcatatgacacaaaatacactacccggtatgagatggccttctccaagctaggagggtggaagataacggaaggagcagtcctcaagtcgtagaacagtgtgcagtagcttgtcctttcagtttgattgtgtaaatagacagtgtagatgtcttcgttctttctgacagttttgttagatgagtgctgagatccccctgtgttcttcattttcgcaaagaatgtaggtgtatttagctgtaataactatattattgctagctcagaacttttggagat

SEQ ID NO: 7 - DNA, 1988 bp, Gossypium hirsutum
aatatccaattttcttttcactttcaccccatattcttccttgttccataccatcctcctcctcctccacctcctcttcttcgaattagggtttcacgatccccagatatgaagcgaactgccacgaagaagaataggcggcctcgtgcgacgaaaacgccggcggtcaacgattcgtcacgtcatgcgttaagtcagcgggatcagcggcgagaaggagaaggagaagacgatgaagaacaaaaaaggcttctcggctcgttaatggaagccttcggttcgatctctctagaagaagccacgtcagcttataaccaagccgacggtgatttggacaaagcggccgagattctatccaatttgatcgataacggtaacaatagtgaagatcccgatccgtcaacgagctcgatatcgagtggctcgtcatcgtcaggttcttccgggttcggtttttccgaaacgagttgcttacaaaatctgaatagcggaaggggacgtagcagatggggaaaacagcagaagcgagtggtagcgtcaacggggacggtttcgaccgtcctcgggaaagattacgttaggtcaagcccatggcgagacccggctgcagtggcaccggcgaaatcggtgttggcgacggaagaagcggaacagtttttatgctcaatgcttggggaagagtgtgaacttagcatggctgttgttagagatgttttgtgtcagtgtgggtacaatgttgagaaggctttggatgcattacttgatttatctgcttcctcctatgaaaaatccaagagttttaatgacaatttgaacagtagacaagatacaggattcgtaattgaatgtgcagacaatttaacagataggacatctgactgcatatctaagttgttggaaagcgaacttcaagatagtatatggtcagccggatatggtcacaggaattactctaaggttcttgctagttctgaagctatgcaaccaccttgcccaaggaataatgtgtcgaatctccctcaggaggtcctggattctttatttaaaatccccaagagttctgagcatgaaccaagcactatgagttggaggaatgtagtaaagaagatgcagttgttgggaccacctattgatttttgtccatctactgatgcagaacctcagcaggatatctatgctaagggagatgaatatcacaaatttagagagtgtgccaaagaacattgggattccatgagatcttattatcagaaggctgctactgcatattcaaagggagagttggagtatgcagcttatctttctgatcagggaaagatacagactaaattggcacgggaagcagatgaaagggcaagccagaatatatttaaagccaggaacaaagcctttgaaaatgtgataacaattgatttgcatgggcaacatgtcaaacaagcgatgaaacttttaaaactacaccttctatttggaatacatgttccttctgttcaaactctgagggttattactggctgtggaacacatggtatggggaagtcaaaactgaaacagtcggtcactaagcttcttgaaaaggaaggcattcagtggcgtgaagaaaaccgtggaactgtactaatcaagcttggcggatacagagagttcagctttttagaatccaatagtgacacggagtaaattaattatctaataccaggtttgcatcatttaccatctgtttgtacaagacaaggatgtaatgtaacaaggttaattagtggttcaaaaacagggatcagatgtttatatgtacattactagaaatccttgtaccctttcctccttaggtaggtggaagcttcatgaagatgaagctttccgtgttcctgtatgttgagtttagcaaaatcatgtatctgactcaattattggtaatgacaaagactcatgtatctgactcaattattggtaatgacaaagactcatgagagactgtaaattccgta

SEQ ID NO: 8 - DNA, 1370 bp, Setaria italica
cccctcgccgccccgtctgtctccacctcctctccacacctcctcctcggccacaccgccacgccttgcctcgctactgctgctgcttccaccagcgggagtgggcgggatgaaggtcaccgtcgtgtcccggagcggccgggaggtcgtcaagggcggcatcgacctcaaggactcggccaaggtcgcggatctgcaggaggccatccatgccaggactaagaagtattatcctgctagacagcggctcaccctccctcttcaacctggaaaaggtggaaagccagttgtcctcaatccaaaagccagcctatcagaatactgtgagaagggttccgggtcactgactgtagtcttcaaagatttaggcccacaagtctactacagcacactcttcttctttgagtacttgggtcctcttatcatctaccccatgttctattatctgcctgtctacaaattcttcgggtacgagggggaacgggtcatccaccctgtccagacctatgccatgtactactggtgcttccactacttcaagaggatcatggagacattcttcgtgcaccgtttcagccacgcgacatcacctctgtcaaacgtcttcaggaactgtgcctactactggactttcggcgcttacatcgcttactactgcaaccacccgctctacaccccagtgagtgaactgcagatgaagattgggtttggcttcgggatcatctgccagattgcaaacttctactgccacatcctgctgaggaacctcagaagcccaagtggtagcggtggttaccagatccctcgtggtttcttgttcaacattgtgacctgcgccaactacaccaccgagatctaccagtgggttgggttcaacattgccactcagactgtagcaggctacatcttcctcgtggtggctgcaagcatcatgaccaactgggcgctaggcaagcacagccgcttgaagaagctgtttgatggcaaggacgggaggccgaagtatcctcgccgctgggtgattctccctccattcctgtgaagaggtgatgattgcgattgctgctggcctgtcacgaatgcaataccttctgcgttccagtgttcagaagaagttccaagtcatgaataccatgcaaacatttgtactaaatcacgccttgtaccagtggaacttcgattccggagtctgaaatttctaatccgaaagatggatgctaaatttttcttcgatattctgtcacaatgtcatgtgttcctgtcgtaatagtaatacattggaaggttcatctgatgttagcttcttttcgcccccatttgtccaagcagaagtaaatgcaaacataacttcattttgatgcttgccattg

SEQ ID NO: 9 - DNA, 1025 bp, Setaria italica
gacagcgctcggggagcccgctctgccgccgtgccggatgtctggacacaatcacaccacagggagctgtagagggcggagagcagaggccggcggagccatggcgaccactctctcgttatcttctcccctcttcctcgcagctccggccagagctagagatgtggccttgtgcggagtgccttcagctagtacatcatggagcactgcaaatgctctaagcaagggctacatggttagagtacatgagcgggggaaacagcgacgcatggcaatagtatccgtgattggaagaaagtcaacgactagagaaacagttgtccctgaccccgactataggttaccaattgctatacttgggattgctggtgcttttgcatatgcagacaatcttctagctgctgcacctgtaggactgctgggactgctgcttttgttccagactacaagagtgaggttcgtctttgataatgaggccctggaggtgaaagttggagaccagttgcaggagtcaggtgaaaatgtgtttgttggtggcaagaaccgttggaagtactcaacgttcataaattgggagctatggtggccacaatttcctatcttggtttacttcaaagagagccaaacaaaacctgaggggcagatccacttcttcccagtgatattcaatggccgacaactctatgatgtcatggtggagcgtgctggaccctcaaagacgagcggccctaagtagaagtagtgctgatcttccctcaagatgatgagctgagttccatggcgtgctgctgtggcaccagttgacgctccaggaagcaaaggctccgtgcctttttcgacctacctgatgtgtggtcctatgcattaccttcgagataaaatgaaggatgaatggatgatgtattagctgtagatatattagaaactgatgtaatgcaacatcaactactcatctgaggcaatacattggtgtgtacttggatttatattcagatgctaccaaaaaaaacacccatctgcaggca

SEQ ID NO: 10 - DNA, 1273 bp, Setaria italica
ggttgtcagcacctccgtgctgccctcatcagggtaatacaaaaggtagtagcctcttgcactctgccgaaggtcataatgagcctgcttctgtccacgccgagacaagatggccttgctagctgcagatgcggaggcgcgatggccaacgtccccaacgccggcgccggcgtggttcaccctcctgttggctctcggcctccttgtcttggtccggtccgcggccaccttcctcgcatggctccaccgcgcgttcctgcggccgggccgagacctggccaggcggtacgggacgtgggcggtggtgacgggcgccacggacggcatcggccgcgcggtggcgctggatctcgcgcgccggggtctccacctcgtcctcgtggggcggagccccgacaagctggcgcgggtcgggaaggaggtcctggccgccgcgccgtcgtgcaaggtgcggagcgtggcgttcgacctcgcctcgacgggggacgacgcgcggcacggggtggcgcgggtggcggccgccgtggaggggcgggacgtaggggtcctcgtcaacaacgccggcgcgacgtacccgtgtgcggcctacttccacgaggtgggggatcccgtgtgggaggccgtggtgcgggtgaacgtggaagcggcgacgcggatcacgcgcgccgtcgtgccgctgatggcggcgaggggaaggggcgccgtcgtcaacgtggggtcgggctcctccgtcgtggtgccggcgttcccgctctatgctgtctacgcggcgagcaaagcgtatgttgatcaattttctcgaagcttaagtgttgagtacaaacaatatggagtagacgtgcaatgccagatccctctgtatgtcgctactaagatgtcccctgtcaagggtgattccccattcataccatcacctgaggagtacgccaaggctgctcttcgttgcattggctacgaggcaaggtgcgtcccgtattggcgccactcggtccagtggttcttggcatcgttagttccagatgctgctctcaaccagtggcgcctccaaattggcatccggaaaagaaacgagacgaataaggctctggctggagtgaagaaagtcctcggctaaactgttgtacagatagtaacggagaaagggtttttaaatctgtgctctatttggacttctgaaaagcaacccgcactgtgtctcgattggagaataactggaaataatcggttgtgtataactcgtgatattttcttaaatgtaaattggtgctatttt

SEQ ID NO: 11 - DNA, 5623 bp, Zea mays
aagattttgaaaacctgcggaacaaattaataaacgaaccagtagaagccaaacgaaatctttgtatttcatacacttagcttttcccctcctttttcaaaaaaaaaaaccctctcccccaactccacctgcttcgttcgcttcccttcatccccactccaccaaaccctcgcgtcgctgggactgggagcagagtagagcacagcggagcagattagcagaaggtgtcgagtggaagcaaatggccaatgagtggccgcggtggtggtagcatcctcctcgccttttctccccgtctcccgcgttctggttgttgcagcgagcgggagcgggaggacacgtgctacccccgtcgcttctcgggcacgcctccctcactcggatctgggccgcgcgcgcgagatcctgagctccgggttggagagctcccgtgctccagctcaggtgacgtcgatggagcccgcggtggctacagcgggtgaagggcagcggttcaagcggattccgcggcaggcgtggtcggggaacctcgaactgggtcctctgcttaatgaaagcttagatcagtggccacatctaaatgagctggtacagtgctacaaggctgattttgtgaaggatgactgcaaatatggacactatgagagtgttgcatcaccgtctttccaaaatcaaatttttgagggacctgatactgacatagaaacagaattgcagctttgcaatgcaaggcattccaagtctgaagatgctactgaagatgatacaccaagcacctcagggaggcaaatatatgaaactgaatcatctggttcgtcttcaaaagtgcactgtagtttgtcaccattgccagcatatgaggctgcatttgattgggagaatgagaggtctttgatatttggccaaagggtgccagaaagtatacctgcaataagcaacagtggcttgaagataactgtcaaggtactatctttgtcattccaagctggattagtcgaacctttcagtggaacgatttgcttgtataacagagatagaagagagaggctgtcagaggacttctatttccatatgcttccaacagatatgcaggttgaccagggttccttggatcgtcgaggtgttttttcattggacgcaccttctccatcggtctgccttttgattcaattggaaaaggctgctactgaagaagggggagtaacaccttctgtttattctcgtaaagagcctgtgcacttagctgagaaagagaagcaaaagctgcaagtatggtctcgaatcatgccttataaagagtcatttgcatgggccatgattcctctgtttgaaagtaaccatgcgggtggtcttagtgatgctgcttctcctagcagtcctctagcaccgagtttatcaggatcaagttctcaagatagtattgtggaccctatttcgaagcttgctttagatggaaaagtcaaccattactcaagtggaagctcagttattgtagagatatcaaacctaaacaaagtgaaggaaagctatatagaggactccctccaagacccaaaacggaaagtacataaaccagtgaaaggtgtattgagattagaagtggaaaaacttcatgatgaccataatgatgtggataacgcttctgaaggtggaagcatggccaatgatttgaatgatgctggtgacatcaataatggcagaagcaacagaagtagctttgatgggattcacagttctgtgaattctattgccattgccaaaaaagatgctcatcacaatggacacacttctaatgctgagaatgttgacaattttcaagcttttgactttcgggtgctgacccgaagtgagccattttcgcaactttttcattgcctctatgtgtacccattgactgttagcttgagccgcaaaagaaacctctttgttagagtggaactgagaaaggacgattctgacatcaggaagcctccattagaggtgatcattggatattctgtacttccactgtcgacacatattcagttactttcagatgtgtccttgccgattttgagagagctcgttccacattacctgcaggaaagtggaaaggagagaatggactatctggaagatgggaaaactgttttcaggttacgtttaaggctctgctcttcattgttcccaattaatgaaaggataagggacttttttgttgagtatgatcgccatactctacatacaagtcccccatggggttctgagcttcttgaggttgctgcatttcgagccatggttaacattttaacccgtgtgcagcaggagtcatcagatggggctgaaagaaatagattccttattaactatgttgattttgctttcgatgacttcggtgatcggcaagcccctgtgtatcctggtctgactactgtttggggaagtcttgctcggagtaaggcgaaaggtgaagatgtcccaccactgcaattgaaagaaggtgtcttcaggtgcatcatgcagctctttgattgccttctaactgaggttcatgagcgttgtaaaaagggtttaagcttggcaaaacgcttgaacagcacacttgctttcttttgctatgatcttttatcaattattgagcctcgccaagtttttgagctggtttcgttgtacatggacaagtttgcaggagtttgtcaatcagtccttcatgactgcaaattgacattcctgcagataatatgcgaccatgatctattcgttgagatgcctgggcgggatccttctgatagaaactatctctcgtcagttctcatccaagagatctttctgaccttagaccatgatgatttatctcaacgagcgaaggctgctcggattttggttgtccttatatgcaaacatgaatttgatgcacgctatcaaaaaagcgaagacaaattgtacattgctcagctgtattttcctcttatagggcagatccttgatgagatgcctgttttctataatctgaatgccattgaaaagcgtgaagtgctagttgtcattttgcaaattgtgaggaacttggatgatgcaactcttatcaaagcatggcaacaaagcattgctagaaccagattgttcttcaagcttcttgaagaatgtataatccatttcgagcacaacaaaacaggagacaacatgctacttggtgctagttctcggagcccagatgtcgagcatcctgcatccccaaagtactctgaacgattgtccccatcggtcaacacatatttgtcggaggcttcgaggcatgaaataaggggaacaccagaaaatggatacatgtggaacagggttagccctcaattaagttcccctaatcagccctattcattgagagaagcacttgctcaagcacaatcttcaagaatcgggtcaaccgccagggcattgagagagtctctacatccagtgctgagacaaaaaatggaactttgggaagaaaatctcagtactgccgtgagcctcgaagtgttgggaataactgagaagttttcagttgctgcaggcgctcgaagcatcactactgattacgcgaagctagattgtgtaacatcaatcttaatgggtcttttatctaggaaccaatccttggctttttggaaggctttccttcctgtggtctacaatatatttaatgttcatggtgcaacactaatggcaagggagaatgaccgcttcttgaagcaaattgcttttcatcttttgcggcttgctgttttccgaaacgattcgattagaaaaagagctgttgttgggctgcagattcttgttaggaactcattcaactatttcaaaaacactacaaggttaagggtcatgttgacaattactttgtccgagttgatgtccgacgtgcaagtaactcaaatgaaattcgatggttctcttgaagaaagtggtgaagctcggcgccttaggaaatcactggaggaaatggctgatgtgagaagcaaggatctgttaaaagattgtggcctccctgttactgcattggaggcggcccctgaaggctcctctgataataggtggtcttgggtagaggtgaaacatttgtctaaatgtctagtccaggcccttgatgctggtctggaacacgccctcctggagatgcaatcatgggctgaagcagcacaatgtgcagttgctgtagctggcgtgatcatgcaggcacttgttggaaggaatgatgctgtgtggagcaaggagcatgttgcttcgctgcgcaagatttgccctattgtcaacactgatgtgagtgcagaagcatctgcagctgaagtcgagggatatggtgcatccaaattaacagtggactcagcggtcaaatatcttcaactagccaataaacttttcacacaagctgaactctaccatttttgtgcaagcattcaggaactcataattcctgtgtataaaagcagaagggcttatggacagctggccaaatgccacacatcgctcacaaacatctatgagtcaattcttgaacaggaggctagccctataccattcattgatgccacatactaccgagttggtttctatggtgagcgttttggcaagctcaataaaaaggagtatgtatttagagaaccacgggatgtacgtcttggtgatattatggagaagcttagtcatatatatgaggctaaaatagatggaagtcacactttacacataattccagactctagacaagtcaacgctgatgagttgcagcctggcttctgctatttacagatcactgctgttgatcctgtgatggaggatgaggacttgggtagcaggagggaaagaatattttctttatctactggtactgttcgtgcacgtgtttttgaccgttttcttttcgatacaccattcacaaaaaatggaaaaacacaaggtggtctagaagaccagtggaagaggcgcacagtgctccaaacagagggttcctttcccgctttggtgaaccgtctgccagttatcaaatctgaatctctggagttctctcctgtcgagaatgcgattggaatgatcgaaacaaggacagctgcattgagaaatgagctagaagaaccacggagttctgaaggtgatcaactcccaaggcttcagagcttgcaaaggatactccaaggaagtgtggctgtgcaggtcaacagtggggtattaagtgtgtgcactgcattcttatctggtgagccagcgactaggctcagatcccaagaactgcagcagctcatcgctgcattgcttgaattcatggctgtctgcaagcgtgcaatccgtgtgcatttcagattgataggggaagaagaccaggaattccacacccaacttgtcaatgggttccagtcactcaccgctgagctatctcactatatccctgctatactctccgagctatgatagaactgtagcaagccagaaattaggtagcatgtgaatggttgttcattcattcagttgcaggttcccaccaaatgtccatatttccattagctttggttgtatagttctaggaaccggaaattaactagtcttcgaagttctgtaccgtattgcagaaccgattcctgattttggagtgtaaagtctgtataatacc

SEQ ID NO: 12 - DNA, 3382 bp, Zea mays
cgcgccccaaatccagatccactgcccaccacccgcctattagtctccaacgcggacgcccccgcccccggctgcactcgtcgcgccatcctctggtgcctggtctccgggattctgcaggttcagttgagtagaccagtgtttgagcaagggttgaacataggaatgcgctgtttgttcctagagtagcagttcaaaatccaaacccgcccgcgatgaaaagcggcgtcatggttctcggtgtcggcagccctgaagaggcccctgaccgcaacgatgcggagccacggcgcgatatgggccaatcgcagatgcaggtcggtggccccgttgttctcaaccgatcagctgagctcgggtcaggtgattttatggctatcgatgacgctccagttcaagcaccatcgggccagccggcggcggcaaaacatcagtctcctgctgctctgacggacaccatcatggaggtgcagaagcaactgaagcgaaagagggcttctaataacccagtgattgctgccgcggacaaggacgctctcgctgccgggtgccggcaagagcttgagggtctcttccagttttacaaggaggtttctgaccgtaaggtgcagcttgacggtggtaacctgtccgtcaacggaatggttggctgcttgcttgaggagagcagccttgggctgaccaagttggtggacgggatatatgaaaagttgaagggattggatggtgtgtctgtggcttcagtccgtggctctgtgctgctcgttgggcagaggatgatgtacgggaaatcatccttggacgctgatgtgttggaagatgatacagagtcggctctttggtgctgggagacaagagatctgaaattgatgcctgtgaaagcacgcagtgttcttagtacacggaggtctgtcagaaagaaaatccatgagagaatcactgccatctattcaactctatcggttcttgaaaacccaggagtttacgtccaagtaaatgatctaaaaaaggcatcattaagattaaacaaatcgctgaacctggaagggatcagatcaatggtggaaagagtggcacaaaagaacctagaacggggtgtgaaagttgctggatcagcaattaaggaattgaagcaagagacagaaaaaaatgaccaaaatcttagaagacttgaggatactagcgtctctgagctgcagaatggaaattcgcctgataatgaaaaagaggttcaaaaggcacaaaaacaggtggagaaggaaataaagcgccaggagaaagaagaagctcggatgaaaaaactgcaaaagaaacagcaagaagatgtcctaagagaacagaagagacgtgaaaaggaggaagctgaagctaagaaacaacaaaagaagcaggaggaggaagcactgaaagaacagaagcgtcgtgaaaaggaagaagctgaaatgaagaaacaacataaaaaacagcaagaggaagctgagaaagaacagaagcgccttgagaaggaagctgcacaactcaagaagcaactagccgtgcaaaagcaagcttctatgatgcaaagatttttcaaaagtaagaaagacaatggaaaacttcaaaaatctggagagaacaactcagctgatggtccgtgcaatgacaacaaagagaccgtaccatcaaccacatcaaaaattgattattcattgtctcaacaagagagctgggttttggaggatctttggaggttgcagatcactggttggaagaagctatctagccacaataggtcctccagatggggtgtaagatgcaaacccaagacgaaagcatttaatgaactgaagcttcagaaatcctcagatgatatggttgatgaaatactttctactccaaataaagatggctgccacacttcaagtcaggaaaatgaacatgctacgcttgaaagtgacattgacatgctacaagctattgaggtgcaatgtcatgacaccaataaccctaaacctctgcaaactagattaattagaaggaaacttctgcaatttgacaaaagtaacaggccagcgtattatggatcctggaggaagaaaagtgttgttattggtccaaggtgtccacttaagatggatcctaatcttgactatgaggttgatagtgatgatgaatgggaagaggaggatcctggtgagagtctttctgactgtgagaaggataatgatgaatttatggaagaagattccaaaattacagatgaagaagatgaagatagctttgttgtgcctgatggctatctatcggacaatgagggaatacaaattgaaagcctattggatgataaagatgaggaagccagtagctcaccaactggtcagtgtgcagaagttgaagagttcaggtctctactgcgccaacaaagagtcctgaacattttaaccgagcaagctctccggaagagccaacctcttattatatccaacctaaatcatgaaaaagctgaattactgactgccgaagacctcaaggggacagcaaagatcgaacagctatgtttgcaagttctttcaatgcacatctgtccaggaggcgcagttgttgatgtgcctctaactgacagctcatctgcaactgttgaagaaattaaccagcccaatccgaaggatggttctcctggggctgcatctgctataccagaaacagatctgccagaaattgtccaggtgataagatcatgtcgagatggtatccataaggtggtggaattactgcagcacaagtttccaaatgtttcaaagactcagctgaatcgcaaagtgagagagatatctgactttgttgacaatcattggaaggtaaagaaagaggtgcttgacaagctgggattggattcgtcaccagtgaaatccaagaagaataaaagcatagccatgtacttctcgaagagatgtttacctcctgaagaggctgtcaatgctctgtctgcttctcctgagttgcggttgaaatctagaaccattcaaaatggcaatggtggcaccgaagctcctcagatcaatctgttcccttcaaagcagtagagtttgtaacaggacaccctgaaagtcggatcaggtataaatgaggctatgcacccaggtgagcacaaagctcagaggtccatgtccctcccatggctatggaagtgcgtgcaacttggttttgcatatggatgatctggatcgattatgtttccagtgacatgttgtaattttagccagaaagtaggtttgttcatgaaggacattcagttcaaatgtttgacctattgttaaggcaaggcattgttctctgcaacatgtggtgttatgaacattatgtgcactcgtgattctgccaaataagtaatgtgtcctgtgac

SEQ ID NO: 13 - DNA, 1972 bp, Oryza sativa
cgagcccagacctccaccatcgccaccacctccgcctcgtttccatcgccaccacctcctcccgccgccgccgccgccaccgccgcgatgcagagcctcctcctccccaccttcgccgcggcctccgccgcccccccgcggagggggcgcgtgcctcccgccggtcgcgcctcggtctccgtgcgcgcgtccgcgtccgcggcggcggtggcgccgaggagggagacggatccgaggaagagggtggtgatcacggggatggggctggtgtccgtgttcgggaacgacgtcgacgcctactacgaccgcctcctcgccggggagagcgggattggccccatcgaccgcttcgacgcctccaacttccccacccgcttcgccggccagatccggggcttctcctccgagggctacatcgacggcaagaacgaccgccgcctcgacgactgcctccgctactgcatcgtcagcggcaagaaggccctcgagtccgccggcctcgccctcggctccaaatccatggacaagattgaaaagactcgggctggtgtacttgtgggcaccggtatgggtggtcttacagtgttctctgatggtgttcagaatcttattgagaaggggcacagaaagataactccattcttcattccgtatgccataacaaacatgggatctgcccttcttggaatggacattggtttcatgggtccaaactactccatctcaactgcatgtgctacctcgaactactgtttctatgctgcagcaaaccatattcgcagaggcgaagccgatgtgatgattgctggtggcactgaagccgcaattattccgattggtgtcggtgggtttgtcgcgtgtagagcactttcacagaggaacgatgaccccaaaacagcatcaagaccttgggaccaagaccgtgatggttttgtcatgggtgaaggagctggagtactggtcatggagagcctagaacatgcaatgaagcgtgacgcaccaataattgcggagtatttaggaggtgccgtgaactgtgatgcttaccatatgactgacccgagatctgatggccttggtgtttcgtcttgcattaagcaaagtcttgcagatgctggcgttgcaccggaggaggtcaactacataaatgctcatgcaacgtccaccctagctggtgatctggcagaggtgaacgccattaggcaagtcttcaaggatccatcagagattaaaataaatgcaaccaagtccatgattggacattgccttggtgcggctggtggcttggaagccattgcaactgttaaagctataaccactggatgggtccatccaagcataaaccagtttaacccggagccagctgttgaatttgacacggtacctaatgtaaaaaagcaacatgaagtgaatgttggtatctcgaattcctttggatttggtggacacaattcagttgtagtatttgcaccatttaagccttaacttgctgcatgttacacaaatcttggccagaatagtaaatgtcttttcaggaagttctgagttattctgcatgtcttttctttgggtgaagcaactgttgatttgacagccggcaacgttacaatgaactggatctgagattaattccattttaggcactcccatcttccattgaaattgagagctctgtataacgttgttttgcataatttgcaattgattctacctacttctgtataatggaaaatgtgggaatttctagaattgtcatgtagaagcaaaagttagatctcctgttccatagaaatgcttgagccaaggaattgcttgtctgtaatttgtatctggtctagaaaaatgttctcttcatttttttttcttgtccagtatgccaatgtccgtctagtggaataaaatgtattcagttttgcttaacttgctcggctaatagcttggttcgatgagatgaaatattctagatttcgcc

SEQ ID NO: 14 - DNA, 3124 bp, Oryza sativa
ctctcttcacccgcaactcgatctccaattctctctctctttctctcgcatcgaatccgagttcacatctccaaaccctagcgagctctctctctcgcagatggcgccgccgacgccctccccccggccggggccgccgccgacgccgcaggcggccatgacgaccccgctcaagacgcccgcatccaagcaccgcctccacttcccggccatgacgcccaggaacggcggcggcgggggcgccgcggcgggcggcacggagcacccggtggaggtgatcggccgcatccggaacctcgccgcgggggcgggcggcgcgtcggcgctggagatcgcgggcgggggcacggccgtgcgcgtccgcggcgacgccggcgggtgccgcgacttcaccctcgacggggtctcggtctccgaggaggaggatctggaggggttctaccgccgcttcgtgcggtcgcggatcgagggggtgcgggtgggcgccaagtgcaccgtcatggtgtacggccccacgggctccgggaagagccacaccatgttcggctgcgccaagcagcccgggatcgtgtaccgcgctctccgggatatactggaaggaggaggaggaggagggggaggtgtctctggtggtgggggtgaaggcgatggccgcggcgaggatgacgccgggttcgggatggggctgttcgtgcaggttgccgtgctcgagatctacaacgaggagatctacgatttgctcgtggggagcggagcgaatgctaaaggaaacgcccccaaggcgaggctagaagtaatggggaagaaagccaagaatgcaacctacatatctggaaatgaagccgggaagatatcaagagaagttgcaaaagtggaaaagaggcgtattgtcaagagcacgctttgtaatgagaggagttcccggagccactgcatgataattttggatgttccatcggtggggggacggctcatgcttgtggatatggctggttctgagaacatagaagcagcaggccaaactggatttgaagccaaaatgcagactgcaaagattaaccaagggaacacggctttgaaacgagtggttgagtctattgctaatggtgactcccatgtcccatttcgagacagcaagctcacaatgctcttgcaggattcatttgaggacgacaaatcaaaaatcttgatgattctctgtgcaagtcctgacccaaaggaattgcacaagacagtttctacattggagtatggtgctaaagcgaagtgcattatccgtgctgcccacgctgcaaccccaagggacaaaatgagctctgaagagtcatctacaatgctcaattcaagaattgttgcgatgaaccagttcatctacaatctccagaaagagaacaagctaagggagaaagagcgcaatgaggcccagagtgtgctaaggaaaaaagaagaggagcttgcacagctcagggcgaagctcaagctgattgaaggtcagggagcagctgcaaaagaggaagagatcaactcaaaggtcatggagaagacccagagtttgaggactgagctcatgaagatggaagagaaaatgcttaggcagcagcaagaactccttgctttgcaacagcgactgaaggaggttgagtgtgaaaagcctgtgcagcaggatatcatcggaggtagattgttggcacgtctgtcagagatgtcggctagggcggatcagtccatgtcaatggatatgtccattgattttgatatgggagatcagccagctgcgcaagacgtgaaggtgatcaaggaggatactcgccagcagggccagatatggagccaagcaaatactgcaggctcttgcaccagcgctgtggagcaagaagatgctgtgagactgtccgggtacccagaaaaggtggtcctgagcactgtctttgaggagggagatgaagaagaagataaagacagtggcgttgaagaggaagtgtgcaaggaagttgtcgaagagagctatgtaatgcaacagccccttgcagagcctgaagaccctgccacaaggaataaccggattcagaacattttcaggctttgtgggaatcaccgagaattagccaagaaggtccagtcaccagcaaagaaggcgttcggagatgagaacagtgagcctgcgaagcaaacattcggagatgagaacaagcagcagcctgcaaagcgagtgtttggagatgagaacaagaacccttcagcatggggagcgatagaacctccaatgtgcgacgtcagagtgaccgacagtccagcatcctcgcagctttcacctatcgtctgccaagttgtggatgatgccaagttgccggcgtcggagcagctgaaatcatgcaatgctttggaggcaaatgatgagaataaggagaacaatgcttctggacaagacggcctgcttgaaatctacatcaaatgggagtccgggcatctgataaaaggtctgaaattgctgagcaactcgtgtctttctgacctgagaaagctcttggaggctcacttcgaagaagcaggcagcaagcagcagcagcagttcaccttcctccttctcggggatccttctggcgcaccggtgtccagagagaaggaagcaggggtgccgataagcaagctgccaagctgcaacaaccagccgaacagctacctagcctgcttgcgcgctgtcaagaagcagccggcgacggagcagatgccgttcagcccactggagagcaagctgaattcggcactgaacgacgtgcacctcgccgccctctcgccgaaggtcaacccaatgagccctaactacatccgtgagctcagagcttgagctcttccaacctgaagaagatcggttagatctttcgtaggtttgtcgccggtggcatttcaacggtggcaacgatgtatcatcatttatctatagtctggctctgttctgtctgtaaatttgctagctataggctggttctgcaaacctaaactctgaagtgtaaccatgttacacgagtggctgtggctagacactgcgggtcatgcgtctgtggccaacaaggtgaatatgaatatgattcgattcgtttacttctgctgtgctgctgttctgtct

SEQ ID NO: 15 - DNA, 4439 bp, Oryza sativa
gacctccccaccttcgtccgtctccgtcctgggcacccaacgcccaagggccaaggccataccatcgtcctctcccccaacctccttcccgcgccagatcagatccaccgccctctctctctctctctctctctctctctctctctctctcctccgctcgcctcagcggctaggggtttcgcctgccgctgccgccgccgccgccgctgggggacggctagcgaagatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacccagccgctcttcgtctccggaggtgatgattacaagattaaggtgtggaattacaagacacaccgctgcctcttcacacttcatgggcaccttgactacattcgcaccgtgcaattccaccacgagtacccatggatagtaagtgctagtgatgaccagacaatccggatatggaactggcagtcacgcacatgtgtggctgtgctgactggacataaccactatgtcatgtgcgcatcattccatcccaaggaggatctggttgtgtccgcatcactggatcagactgtccgtgtatgggatattggtgctttgaggaagaagacggtgtcacctgcggatgacatcctgcgcctcacccagatgaacactgatctgtttggaggtgttgatgcagttgtaaaatatgtgttggaagggcatgaccgtggggtgaactgggcgtcatttcaccccacattgccgctcattgtttctggggcagatgaccggcaagtgaagctatggagaatgaatgacaccaaggcttgggaagttgatactttgcgggggcacatgaataatgtgtcctgcgtgatgttccatgcaaagcaagacatcattgtgtccaactcagaggacaaaagcattcgtgtctgggatgccaccaagcgaactggtattcaaacattcaggcgggaacatgatcgtttctggattcttgctgcccaccctgagatgaatcttcttgccgctggtcatgacaatggtatgattgtgtttaaattagagagggaacgtccagctttctctgtgagtggtgatactgtcttctatgtgaaggaccgttttcttcggttctttgaatactccacacagaaggaggttcagttggctccaataagaagacctggatcggtcagcttgaatcagtcacccaggacactgtcgtatagtccaactgaaaatgccgtcctgatttgctctgatgtggatggaggctcctatgaactctatatagttccgaaggattctgctggcaggactgattatttgcaggaggcaaagaagggagctggtgggtcagctgtttttgttgcacgcaacaggtttgcagtgctcgagaagagtagcaatcaagttctggtgaagaatcttaagaatgaaattgtaaagaaaagccctcttcctattgcgatggatgcaatttattatgctgggactggtaacttgctgtgcaaagctgaagaccgagtgaccatctttgatctgcagcaaaggttaattcttggcgagctccaggcacctgctgttaaatatgttgtttggtcgagtgatatggaatctattgcattgctgagcaagcatgcggtggttatagcaaacaagaagcttgtccatcgttgtacgctccatgaaaccatccgtgtgaaaagtggtgcctgggatgagaatggtgtgtttatttacactactttgaaccatatcaagtattgtcttcccaatggagatagtgggatcattaaaacccttgacgttcctatttacataacaagggctattgggaataatattttctgcctagatcgtgatggaaagaacaagctgatcacagttgatgcttctgaatacattttcaagctggcccttctacggaaacgatacgatcatgtgatgagtatgattaagaattcccagctgtgtgggcaggctgtgatttcttatttgcaacagaaaggctttccagaagttgccctccactttgtgaaagatgagaagacaagatttaacctagctcttgagagtggtaacatccaaattgcagttgcttctgccaaagagattgatgacaaagatcactggtaccggttgggaatcgaggccctgaggcagggaaacgttggtattgtggaatatgcgtaccaacgtacaaagaattttgagaggcttgctttcctatatcttattactggttacatggacaaggtggggttcatgtgcaaaattgctggacagaacaataacctgatgggtcaattccacaatgctctgtatcttggtgatgctatgaagagagttgagatcctagagaatgctggacagctacctcttgcttatattactgctgccacccatggactcacagaaattgctgataggcttgctgctgaattgggtgaaaatattccttctctacctgaaggaaaaactcgctctcttttgatcccccctgcacctctcacagccagtggtgattggccattgcttagggtgatgcgtggtatctttgagggtggactggatgctactgggaaggctgaacttgaggaagacgatgaagctgctggtgctgactggggtgatgaggacctggatatggttgatgcaagcgaagcgatggcgaatggtggtgatggttttgatgctgaggagggtgaagcaaatgaggaggatggtgaggaaggtggctgggacctagaagacctggaacttccgcctgaagcagagacccctaaaaacgccggtaatgcactctcagtggtctttgttgctcctcctccaggcatgcctgtcagccagatttggactcagaaatcttctcttgctggggagcacgcagcagcaggaaactttgacactgcaatgagattgcttagccgtcaattgggcatcaaaaactttgctcctctcaagcccctatttctcgatctgcacatgggcagccactcatatcttcgtgcacttgcaactgcccccattattccggttgctgttgagaaaggttggagtgagtctgcaagtcctaatgtgagaggccctcctgcacttgttttcaccttctcacaaatggaagacagactcaaggctgcctacaaggccaccacagaaggtaagttcccagaagccctgaggcagttccttaacatcttgcataccatccctcttatcgtggtagactcgaggagggaagtggatgaagtgaaagagttgatcgagattgtgagggagtatgtccttggcctgaggatggaacttaagaggaaggaattgagagatgatgtcaaccgccaacaagaattggcagcttacttcactaactgcaagcttcagagagttcatatgaggcttgtgcttggaagtgctatgggtttgtgctacaagcaaaagaactttgctactgcagagcactttgcaaggatgctgctggagaacaaccctaatgagagccaagcaaagagggcccgacaggtgcagcaacagtgcagtggaaagaaggatagctgtgagctgaactatgactacagaaatccatttgtcgtctgtggtgccacatatgttccaatttaccgtggccagaaggatgtttcctgcccgtactgtggatcccggtttgttccttccatcgaagggcagctttgtaccatatgtgagcttgctgtggttggtgcagatgcttcaggcctcctctgctcccctacgcagttgagataagtggcgctagatgccttatttccagctcaggaaaaacaattggacctttaatgcttacatggatggaaaaatgggatgttagatttgatttgtgatcagagaaggccattacatttgtgcaaaattttgaaatttaatagttcatacaaaaaagtgtgcaaatccaagaccaggctcaggataccaaggaacctcatcttgcctatgtaaattaactactttgagcagctgtggctagaagaatggatatatatcggccatgcctcatgtcagagcatttcagaataaatattcgtgtttagaatagactttttgatggtgaaatatttcaccgaggaattgtgagttcttacttcaaagcacattgcaaattgaggtcgtgttcctggatggttcgtcatttgtcgctgttatcttaacaagcggatttcacagcataattttttgctgagctacataaaagtgaaattggatttgatatgtagctcttatcttttgtctccaaatacaattaagatttttatctggaactaaaaatagatttggatttcataaa

SEQ ID NO: 16 - DNA, 1884 bp, Sorghum bicolor
cgagaggagagatggaaacggagggcgctatccgtcctctacctctacccccaaagcgcggtcccctccctcggcctccccactacgcctgcccctctcctctcgccgtcgccgtcccgtgtcctactcctccctctctctcgcgtcttcaaagcctccgccacttgactcgcgtggtcctccactcctgctcccgccccccgctcctcatcttctcgcgccccggctgcgcgccgcgccgcgcccccatccatccttcgcccgacccgccgccgcctcccactctctagctgggccggcggctcgatggcgttcaactaccacgaccacgcgctggcgatggaccccgccgcggttggggccgcggccgcgaaccctagctttgtctccgggggtggtggtggtggtggcgtggccggtggggggcccggctgggagagggagaaggcggccatcgcggcgcacccgctgtacgagcgcctgctcgaggcgcacgtcgcctgcctccgcgtcgccacccccgtcgaccagctcccgcgcatcgacgcccagatagcggccaggcccccgcccatggcggccgccgcagcggcggcggcggcgggcggagcgcactcgggaggcgaggagctcgacctcttcatgacgcattatgtgctgctactctgttcattcaaggagcaactccagcagcatgtgcgtgttcatgcgatggaagcagtcatggcttgctgggagcttgaacaaactttacaaagccttacaggggcatctcctggtgagggcactggggcaactatgtctgatgatgaagacaatcaggtagacagtgagagcaacatgtttgatggaaatgaggggtcagatggaatgggatttggaccattaatgttgactgagggtgagagatccttagttgagcgtgtccggcaggagctaaagcatgagcttaagcaggggtacagagacaaacttgtggatattcgggaagagatattgcggaagcgaagagctgggaaactccctggcgacactgcttctaccttaaaagcttggtggcaagctcattctaagtggccatacccaactgaggaagacaaggctcgactggtgcaggaaacagggctacaactgaagcagatcaataactggtttatcaaccagcgtaagcggaactggcacaacaatccggcgtcatcctcgtcggacaaaagcaagagaaaaaggagcactgcaggtgatggcaacgcagaacaatcctggtagtgcacggttggggaacaaattatatgtaaataataatgcttctactgtgaagagtgtcatcatatttgttgctccagaaacgacccttcagaccgccgtttcctgagcccatattcatataaagacatcacacgatgaataatgttgcaagtagtcacataaactaaataacttgtatagtgaatgactagaaactagcattcatcgtttggtactgtatagtactatagtgtaattgtttggtcggactgtctcttgtataatggtgtaaggttcaaatgtactttgacctagcattcgatgttgtattttgtgatgtaaaaaccatggagtgtatttggattcgttttgtgttttatgtggaatagagacactctgctagtgttgccctcagatcggcagtgtcgtgttgtcaacttcatattaaaatattaaactaagttttttagcactgttcattgactaaacagtattgtataaattcataacatgaggttggtacatatttcacaatgtcattatctgtctccaataaaacattatattgctgtagatattattagtcaaaaagcagtgttcatagaattaatgtggatagcaccaccatatctgcattcc

SEQ ID NO: 17 - DNA, 2594 bp, Sorghum bicolor
aaagtactacagtgtcaaaatcaaaaacatttcgggtctcagcaaggccttacttgcagtgcagagtaccacatacccattgcccagcgagtcacagtcagcgcaggccgtttccctttggcttatatactgcacaggcgcgcgagctctgccactcacccggccagagaagcggcaaaacagagagccgccgccgacgagaacgacggggaggagctttagtttggcgcgcgcgcgatggtgttcgcgtccgggtccggcgccgccggcggcccgcaggtgctgacggcgcggttcgtgcggcaggtggtgctgggccgttggttcatggtgttcgcatgcctgctcatcctgtcggcgtccggggcgacgtacatcttcagcatctactccaaggtgctcaagtcgtcgctggggtacgaccagcgcacgctcaacacgctctccttcttcaaggacctgggcgccaacgtgggcgtcatctcgggcctcatcaacgaggtcacgccgccgtgggtggtgctcgccatgggcgccgccatgaaccttgtgggctacctcatgatctacctcgccatcgacgggcgcaccgccaggccacccgtctggctcatgtgcatctacatctgcgttggggccaactcccagtctttcgccaacaccggcgcgctcgtcacctgcgtcaagaacttcccggaggaccgcggcgtcgtgctcggcatcctcaagggattcgtcggccttagcggcgctatcttcacgcagctctacctcgccatctacggcgacgacgccaagtcgctcgtgctgctcatcgcctggctccccgccgccgtctccatcctcttcgtgcacaccgtccgcatcatgccgtacccgcgcgccagccgacgccggggcgcatcggcggccaccagcaacgacgccttcttctgcttcctctacatctccatcgcgctcgcggcctacctcctcgtcatgatcgtcgtgcagaggcaggtcaacttctcgcacgccgcctactcggtctcggccgcggcgctgctcctcgtcctgttcctgccgctcgccgtcgtcgtcaagcaggagtacaagatccagaaggagctggaggagtccctccgcgagccccccacggtgaccgtggagaaaccagcctcgctgcagctggcagcagcaccacctcagagccagagcatgacgacgggaacgacagaggccgccgccgagccgtcgaggccgtcgtccagctccagcagctgcctggggtcttgccttcggcacatgttcagcccgccggcgcagggggaggactacaccatcctgcaggcgctggtgagcgtggacatgctggtgctgttcctggccaccatctgcggcgtgggcggcacgctgacggcgatcgacaacatgggtcagatcgggcagtcgctggggtacccggccaagagcatcaacaccttcgtctccctcatcagcatctggaactacgccggtcgcgtcaccgccgggttcgcgtcggaggtgttcctggcgcggtacaagttcccgcggccgctgatgctgacgctggtgctcctgctctcgtgcgtcggccacctgctgatcgccttcggcgtgccgcagtcgctctacgtgtcctccgtggtgatcggcttctgcttcggcgcgcagtggccgctgctgttcgccatcatctccgaggtgttcgggctcaagtactactccacgctctacaacttcgggtccgtggccagccccatcggcgcctacgtgctcaacgtccgcgtcgcgggggcgctctacgacgtcgaggccgccaagcagcacggcgggtccctggtgggcgccggcgacaagacctgcatcggcgtggagtgcttccgcaagtcgttcctcatcatcaccgccgccacggtcgccggcgcgctcgtgtcgctggtgctggtgtggcggacatggaacttctacaagggcgacatctacgccaagttcagggaaagcgcggacgccgccgaggcggaggcggaggatctgaagcggcccaaggagacggcggaggcggagagcgaggttaacgggaggaagcagtaggcgcatagggcaccgcgccgcgccgcacgcaggcgctggtgtccatggcggccgccggccgggggcctggcgcttgcgttgactcggtcgaggtcgaggaagccacactcacactgtcgtcacacagtgagctaacgctcggttttgacttggtatacgtgtcaagatctccgttcgttgctgttcttgctctggagctcaagttggatggcaatgggcagtgaagtgaaggccgcagcagcagtctgatgagtctctgagtgagagcagctgtcactgctaactgcaggtgattaggtgcacggttactgtgtaatcttttagcagggaaagaaaaaaactagtggtgcttgactgtagtataaagtacacctgcttctttttacctgttgtatggatatgtacttttgtaactgctactgctcttaatcttcaaactggagaggaaaggggtaaaatgttctttctttatcttccaaacaagctgcataatttgatga

SEQ ID NO: 18 - DNA, 761 bp, Sorghum bicolor
agccagacatactttccctcatcaaagccgggaagagaaaaataactccgaaaagaaagagacgccgaaaattcgaaggggaaggggaaagcaaagcaaatggcggaggccgagggaaaagcaaagcaaatggcggagggcccgagcaagatcgaatccatgaggaagtgggtcgtcgaccacaagctacgagccgtaggttgcctctggctaggtgggatcagcagttcgatcgcctacaactggtcgcggcccaatatgaagactagcgtcaagatcatccacgcaaggttgcatgcacaaggtctaaccctagctgcattagttggttctgcatgcgtggagtactatgacaataagtatggttcttctgggccaaaggtggacaaatacacaagccaatacctggcccatgcgcataaagattaagatctccatgttggttcctgcataccggattaattttggactcaactgtgggtgctcatgacccacccgtcgatgctgggtgtttattctttttgttgtcttattaattacaaaatgatggtgtacttaccagggaaatgataatgagggtataatgcagatattgtcgtatctaacctcactttgttgactctcagcatctttgaatatttttatattttttgagaaaaggaaaggagatcctgatttgtgcctgaattttgaattctctgtgccctgtaacttttgttctctgttcctgtgctttatgattacaaggcaaatgcaaaaaa

SEQ ID NO: 19 - DNA, 1495 bp, Triticum aestivum
acagtgtacatgcacctcaacgacacgatgaactcaaactgctttgtgctcttacaatttcaaatcctactctactgttttcacattttcttcttcatgtcaaataagcgtgcctaactctactctctgattcttgcagttatatcgctgggagcgagtctgaaggccatttttcactgataaacaaggcctactctatgttttcacacacaaatccactgcatcaggatgtattcaagagtgtggcacagttagaggctgaagtagttgcaatgacagctgctttgcttggcagcaaagaaaaggcgtctggtggacaaatttgtggcaatatgacgtcaggcggaactgaaagcatattattggccgtcaaaacatcacgcgattatatgcagtcaaagaagggaatcacaaagcccgaaatgattattgctgaatcagctcattctgcctatgacaaagctgcccaatatttcaatattaaagtgcggcgtgtacctgtgaataaagaatttcttgcagatgtaaaaggattcaaacggtgcataaatggaaacaccataatgatggttggatctgcaccagggtttccccatggtttaattgatcctattgaggaacttggggagttggcttcacaatatggtatttgcttgcatgttgatctatgccttggtggcttcgtattgcctttcgcccgtaagcttgggtaccctattcctccttttgatttttctgtcaaaggtgttacgtccatctcaacggatgttcataagtatgggctagctccaaaaggcaccagtactgtcctatacaggaatcatgcaattagaaagcaccaatttgttgctgtgactgaatggactggtgggctctatatttcccctactatggctggaagcaggccaggtggactagtcgcaggagcttgggctgcgatgatgtctcttggattgaatggttatttggaaagtactggtaagatcatggaagtctcaaagaagatacaaaaaggaattgatgatatctcaggtttatttgtgattgggaagccagacatgaccgtcgtggcctttgggtcggacgcggtcgacatatttgaggtaaatgacataatgtcatcaaaaggatggcacctcaatgctcttcagagacccaacagtctgcacatctgcgtgacgcttcaacacacggctatctatgaggaattcctcaaggacctcgaggattccgtggacacagtgaaagcgaatccagggcctatcagtggggggatggctcccatctatggcgcggctgggaagatgccggacagaggcacggtcaaggagttgcttgtggagttcatggacagctcttgctaaccattgactataccccattggttatctctctgtaacatgtatgactgttgtgtgatcttctatatttggtttggctgcaaaacagaaggcacacaatgcctccaatacagacatgtatctatgtatcagtt

SEQ ID NO: 20 - DNA, 1829 bp, Hordeum vulgare
gagcgagctcgggatccagcttcggcttgccgttgccatggaggcggccgccgagctggcgctgcgcctgcgggccgccgccaacggccggctggccgggcaggagccgctcctcctcgtcgccgcgccgctgctcgcgctcctcgccgcgcgcgccgtccacgccgccgccgcccacgtcgccgaccgcggcctccgcgccgtcctcatcaccctcgccatggccgcgctcaagttggtgccgggggttggcggatacatcgccgcccagaagagcaaggttgttgagcagttgcagtcaggaagtgcatccagcaagaagaacctgcgaaccgagctgcccgccatcggggatcccgacggggtaataggcgagctccaggcgctcaaggacaaggatgtgagatggcagggcaaatgctccggcaccgtttatatcgctgggagcgagtccgaaggccatttttcacttataaacaaggcctactctatgttttcacacacaaatccactgcatcaggatgtattcaagagtgtggcacagctagaggctgaagtagtcgcaatgacagcagctttgcttggcagcaaagaaaaggcgtctggtggacaaatttgtggcaatatgacgtcaggtggaacagaaagcatattattggctgtcaaaacatcacgtgattatatgcagtcaaagaaaggaatcacaaagcctgaaatgataattgctgaatcagctcattctgcctatgacaaagctgctcaatatttcaatattaaagtgcggcgtgtacctgtgaataaagaatttcttgcagatgtaaaaggattcaaacggtgcataaatggaaacaccataatgatggttggatctgcaccaggatttccccatggtttaattgatcccatcgaggaacttggggagttggcttcagaatatggtatttgcttgcatgttgatctatgccttggtggcttcgtattgcctttcgcccgtaagcttgggtaccctgttcctccttttgatttttctgtcaaaggtgttacgtcgatctcaacagatgttcataagtatgggctagccccaaaaggcaccagcactgtcctatacaggaatcatgaaattagaaagcaccaatttgttgctgtgactgaatggactggtgggctctatgtttcccctaccatggctggaagcaggccaggtgggctaatcgcaggagcttgggctgcgatgatgtctcttggattgaatggttatttggaaagtacgggtcaaatcatggaagtctcaaagaagatacaaaaaggaattgatgatatctcaggtttatttgtgattgggaaaccagacatgactgtcgtggcctttgggtcggacgcggtcgacatatttgaggtgaatgacataatgtcatcaaaaggatggcacctcaatgctcttcagagacccaacagtttgcacatctgcgtgacacttcaacacacggcaatttacgaggaattcctcaaggatctcgaggattctgtaaacaccgtgaaagcgaatccagggcctatcagcggggggatggctccgatctacggggcggctgggaagatgccggatagaggcacggtcaaggagttacttgtagagttcatggacagctcttgctaaccattgactataccccattggttatctctctgtaccatgtatgtacaacccgcagtgacagtgttgtgtgatcttacatatttagtttggctgcaaaactgaaggcacacattgcctacaatatagacatgtatctatgtatcagctaaatgggttcaataaagttacattt

SEQ ID NO: 21 - DNA, 1911 bp, Triticum aestivum
gaaattcttcacgcgcccaacacccaccactgccggcgatgaacaccaccgagggaaagccgggcgccgctgcggtggaggagatggcgcgggaggcggcggcgtggtgcgctatgcacggactcgtcgtcggggaccgcgcggacccgagatcaggaacagttcctggggttgggttggtccacgctccaatctccctgctcccgtcgcgtctcccggagtccttctggagccaggcgtgcgagctggccccgcttttcaacgagctcgtggatcgtgttagcttggatggggatttcttgcaggattccttgtccaaaacaaggcaggttgatgatttcacttctaggctcttagatattcacaggaagatgatggatgcaaacaaggaggagaatattcgactggggctgcaccgatcagattatatgctggattcagaaaccaattctcttctccaaatagagctcaacactatttcagtatcttttcctgggctttgttctatagtgactgagcttcacaggaccttgatcaatcagtatggaaatttattatgtctagatgccaaaagggttcctggaaatgatgcaagccgtcaatttgctaaagcattggccaaagcatgggatgagtttaatgttgacagtgctgtagttatgatgattgttcagcccgaagaaagaaatatgtatgaccaatactggattgtcaaatatttgagggaatcacatggcgtaacaactattaggaaaaccttgtcagaggtggaggctgaaggccaggttctccttgatggaactcttgttgtaaatggcaggaaggtcgctgtggtgtattttagagctggctatacaccaaacgattatccttcagaagcagaatggagtgcaaggcttttgatggaacaatcatctgctgtgaagtgtccttcaatatcatatcatttagtcgggaccaagaagattcaacaagaactagcaaaacctaacgtgcttgaaaggtttcttgaaaataaggaggaaatcgccaagctccgtcaatgctttgcagggctatggagcttggatgatgaagaggttgtcaaatctgcgattgaaaaccctgacttgtttgtcttgaagcctcaacgtgaaggcggagggaacaacatatacggtcttgatgtgcgagaggctctgatcagactcaagaaggaaggaggagatgctctctcagcctacatactgatgcaaagaatctttcccaaagcatctctcgctagtctggtccgtggtggtgtttgccatgaggccctcacagtatctgagcttgggatgtatggagcctacctgcggaacaaagataaggtgatcatcaatgacaagtgtggttacttgatgcgaacaaaagtttcttcttcggatgaaggcggtgttgctgcgggatttgctgttttggacagcttatacctgaccgacaagtgatatcacctcaggaatagcagctacaaatccgaaccagcattgacctaccatggatttagcattctgttgcatcggtcgcaataaatgagatgaacaaagttgctgcacaatttgcagacgtcagccattaacatacagcacactgtgtgaagaataaatatgtcatgtatagatgacgtgtgtatgtatggaaaaataatccccgtgaaaaaacggattacaaattcttgtttcgtggatcactacacccttgattcggggccaggcagttgtgttatactgttaatgtgaattttcagcgttgccatttctgttggtcgatcatatacgaagaagttaagaattctgtgagatgcaacttttttgagtgtaaaaaagaccatatgggcatgatcatcatggaagatcctccgctctgctgtcctgctctttccagatggatcat

SEQ ID NO: 22 - DNA, 1410 bp, Solanum lycopersicum
aaaacatcccaattcccatttctccttatttttccttcttcaccattccccccctcttaattctctttactcataattcataaaaaaacatggctactgcagtaagtgctgcagtttctcttccttcatccaagtccacctccttttcctctagaaactccatcatctctacagacaaaatcaacttcaacaaggtgcccttgtactacagaaatgtgtctggtgctagtagattagtttctatcagagcccaagtgaccactgaggctcctgctaaagttgagaagatttcaaagaaacaggaggaaggtgtgattgtcaataaattcaggccaaaggaaccttatgttggtagatgtctgctaaacactaagatcactggtgatgatgcacctggtgaaacttggcatatggttttcagcactgagggagaggtcccatatagagaaggacaatccattggggtaattgctgatggtgttgatgccaatgggaagcctcacaagcttagattgtactcaattgctagcagtgcccttggtgacttcggtgactccaaaactgtttccctgtgtgtcaagaggcttgtgtacaccaatgacaaaggggaagaagttaaaggagtttgctcaaacttcttatgtgacttgaagcctggagcagaggtcaagattactggacctgtaggcaaagaaatgctcatgcctaaagatccaaatgccaccgttataatgcttgccactggaactggaattgctcctttccgttcattcctgtggaaaatgttctttgagaaacacgaggattacaagttcaacggtacagcatggcttttcttgggtgttcccaccagcagctcactactttacaaggaggaattcgagaaaatgaaggagaaggccccagaaaacttcagattggactttgctgtgagcagagagcaaacgaacgaaaagggtgaaaagatgtacattcaaaccagaatggctcaatatgctgaagaactatggactttgctccaaaaagacaacaccttcatctacatgtgtggactcaagggcatggagcagggaattgatgaaattatgtcttcacttgcagaaagagatggtattgtctgggcggactacaagaagcaattgaagaaggcagagcaatggaatgttgaagtttactaaatatttttacttttctttgtacaaatatgagccaacattatgcttctctccccctgcatccatgtagataggtaaatttttcctttgaaattttaatttcattttttgggacttccctttttaaatctatgtgtatcttttaatgaatcggtgtattggcatttgtccctctaaaaagttgaattttgagggcatggatcaataacatatagctgaatcaaccaaaaatcac

SEQ ID NO: 23 - DNA, 3405 bp, Phaseolus vulgaris
ctgaatctcctgcttccaccaacacacccttctactgtttctactcctccttccttcctttcacttctacctttctacccatcattcacaagccctccacttgaaagaggatatgacaagcaaaagctaaaagagtgtgaaattggtttactgtgaagcttgtcaccttcgacaagttcgctgtactattgttgtttgtacatctggtgagagtaagtactcatcaacaaggccaacatgccagtgaggcagatgaaagaaagctcggagcaacaccttgtgatcaaaccccatttgcagaatcctatgaatccagccaagaagacaaccaaagctgcccaaaatggcaaaggtccaccgccactagaaaacgatagccaagctttccctcacgcaaagaacaagggaagaagaaggggaagaggtggcagaaaacccgatcaaggagatgttatgatgaggcctagatgcagaccatgcacagcaacacttacaagtagtgcaaatgggaatgttgaaaatgatttcgtctctgatatgggttttcccacttcaagcaagtctttgagctttgctcgtaggcctggatatggacaagttgggacaaaatgcattgtgaaggctaaccacttctttgcagagttaccagacaaggacttgaaccaatatgatgttactattaccccagaagtgtcttctaaaacagtaaacaggtctatcatagcagagctggtgaggctctataaagagtctgacttggggatgagacttccagcatatgatggcagaaaaagtctgtacacagcagggcagcttccctttgcttggagagagtttaagattaagcttgtagatgaagaggaaggagttaatggccccaaaagggaaagagagtacagggtggcgatcaaatttgttgctcgggcaaacttgcatcacttgggccagttcctagctggtaagcgtgctgatgcaccccaagaggcacttcaaatcctggacattgtactaagagagctggcaactaagaggtattgcccaattggaaggtccttcttttcacctgatattagaacaccacaacggcttggagaaggattagagtcatggtgtggattttaccagagcataaggcctactcaaatgggcctttccctcaatattgatatggcatcggctgcatttattgagccacttccagtagtggaatttgttgggcagctattagggaaagatgtgatgtcaaggccattgtcagatgctgatcgcattaagattaagaaagcccttagaggagttaaagttgaagtaacacatagagggagtgtgagaagaaaatatcgtgtttcagggttgacttctcaaccaacaagggaactggtgttccctgttgatgagaactcaactatgaaatcagtagttgaatactttcaagagatgtatggcttcactattcaatatactcaccttccttgccttcaagtgggaaaccaaaagaaggccaactatttacctatggaggcctgcaaaattgttgaggggcaacgttatacaaaaagattgaatgagaagcaaatcactgctctattgaaagttacttgccagagacctcgtgatcgtgaaaatgacattttacggaccattcaacaaaatgcttatgatcaagatccgtatgcaaaggaatttggaattaaaatcagtgaaaaactagcttctgttgaagcacgaattcttccagccccttggcttaaatatcacgaaagtgggaaagaaaagaactgcttaccccaagttggtcaatggaatatgatgaacaagaaaatgattaatggaatgactgttaaccggtgggcatgcataaatttttcacggagtgtgcaagatagtgttgctcgcaccttttgtaacgagcttgctcaaatgtgtcaagtatctggcatggaatttaatccagagcctgttatccccatatacaatgccaagcctgaacaggtggagaaagctttgaaacatgtgtaccatgtgtcagcgagcaaaactaaaggaaaggaattggagcttttgttagcaatattgccagacaataacgggtctctctatggtgatctaaagcgaatttgtgaaactgaccttggcttaatttcacaatgctgtctgacaaagcatgtcttcaaaatcactaaacagtacttagctaacgtgtctctgaagatcaatgtgaagatgggaggtagaaatactgtacttcttgatgctgtgagctgcagaataccgttggtcagtgacataccaaccataattttcggagcagatgtaacccaccctgaaaacggcgaagactcgagcccctcaattgcagctgtagtagcatctcaggactggcctgaagtaacaaaatacgccggtttagtgtgcgctcaagctcatcggcaggaacttatacaagacttgtacaaaacttggcacgaccctgttcgtggcacagtcagtggaggcatgatccgagatttactggtttccttcagaaaggcaacaggacaaaagccgctacgaattatattttacagggatggtgtcagcgaagggcaattttaccaagttttactttatgagttggatgcgattcggaaggcatgtgcttccttagaaccaaattaccagcctccagtaactttcatagtcgtgcaaaaaagacatcatactcggctattcgcaaacaaccacagggatagaagcagtacagataggagtgggaatatattgcctgggactgttgttgattccaaaatctgccatccaacagaatttgatttttatctctgcagtcatgctggcatccagggtactagtaggccagctcattatcatgttctgtgggatgaaaacaacttcacagcagatggaattcagtctttgacaaacaatctttgttatacatatgcaaggtgtacacgctcagtatctgttgttcccccagcatattatgcacatttagcagcctttcgagcccgtttctacatggaaccagatatgcaagagaatgggtctacaggtgagggtaatggtcatagttcgaaaggaacacgagcagctggagattatagtgtgaagccattgccagacttgaaagaaaatgtgaagagagtgatgttttactgttagatgcttagtggcctggccttggtagaaggatataggtaagtgaatattcatggaaagcaatgattagtttgtacattagtcgtgtaggtatccatgattacagttcttgaagtttagtttagaatgaattcctacaagtatttttaggttttatagatgtcaaatttaccattgtaaaaagtattctgttaatctttgtagaaaattttgccataaggcctttacagagatgttcaagagtag

SEQ ID NO: 24 - DNA, 1061 bp, Arabidopsis thaliana
ggatccagagagagaattagatatttccgacacgaggcaaattcctagtggctcatggcgtcatcatctgatcacacggcgaagataatcgacggcaaggcgattgctcataccatcagatcagagatcgccgaggaagttcgcggtctatctgagaaacacggcaaggtcccaggactagctgtagttattgttgggagccgaaaggattcacagacctatgtgaatacgaagaggaaagcgtgcgctgaggttgggattaagtcatttgacgtgggcctaccagaggaagtttctgaagctgatcttattagcaaagttcatgaactaaattcaaatccggatgtccatggcatattagttcaactcccattgccgaaacatattaatgaggagcatatattgggtgcaatcagcattgataaagatgtcgatggcttccatcctttgaatattggtaagctagccatgaaaggcagagaacccctcttccttccttgcaccccaaagggatgtttggaactcctagctagaagcggcgtaaagataaaggggcaacgagcagttgttgtaggtcggagtaacattgttggtttgcccgtttcacttcttttgctcaaggctgatgctactgtcacaactgtacattctcacaccaaggatcctgaggctatcatacgggaagctgacattgttattgctgcatgcggacaagcccacatgattaagggcaactggataaagccaggggctgcagtaattgatgttggaactaatgcagtcagcgacccgagcaagaaatcaggataccggttggttggagatgttgatttcgcagaagcttcaaaagttgcaggtttcataactccggtccctggtggtgtaggcccaatgacagtggcaatgcttctcaggaacaccgtagacggtgccaagcgtgtctttggcgagtaaaacaatctactgtatgtaataaagaaaccaagagtttctccattctgtaattgtgtacttggcttgacgatatttttccactcaaataaattgaaattggcgttccc

SEQ ID NO: 25 - DNA, 1533 bp, Brassica juncea
acatccttatatctctctcttcctcttctctctctatcttcctcctctgcttcccgcggagctttcagtctcaagtatgtcagtatctacacattgtttcacttcaccttgtcacgaccgtacgagattcttctcaggcgatgatggtaataaacttctaagaaagagaatcaaaggcactttcttggtcaagatcttaccttcttcccaaaacgcttatctaagagtaactgcgaaatcctcacgacccttatctggattcaggtcaggaatctctaagggagtatttgatattgtggcattgacctcaaagaatgcactcaaagagctgagtactccactgatgctaaagctcgtgggtgttgtagcttgcgcgtttctcatagttccatctgcagatgctgttgatgcgctaaagacttgtgcatgcttacttaaggggtgcaggatagaactcgcaaagtgcattgccaacccttcctgtgcagccaatgtcgcttgcctccagacctgtaacaaccgtccagatgaaaccgagtgccagataaaatgcggagatctgttcgagaacagtgtagtcgacgagttcaacgaatgcgccgtgtccagaaaaaaatgtgttccaagaaaatctgacctcggagagtttccagcccctgacccttctgttcttgtcaagaacttcaacgtcagggactttgacggcaagtggtacattacaagtggcttgaatcccacctttgatgcctttgactgccagctccatgagttccacacagaagatgggaagcttgttggaaacatctcctggagaataaagaccccagacagtggtttctttactaggtcagccgtgcagaagttcgtgcaagatcctaaccaacctgctgttttctacaatcatgacaacgagtaccttcactatcaagacgactggtatatactgtcatcaaagatagagaacaaacctgaggactatatctttgtgtactaccgtgggcgtaacgatgcttgggatggatatggcggtgcggttgtgtacacaagaagcgcttctttacccaacaccattgtaccggagcttgaaaaggcagctaaaagcataggcagagagttcagcacgttcataaaaacggataacacttgcggtcctgagcctccgctggtggagagacttgagaagacggtggaggaaggggagaagattatagtcaaagaggttgaggagatagaagaggaggtagagaaggaagtggagaaagtcggcaagactgagatgactttgttccagagattagctgaagggtttgaagaactaaagcaagacgaggagaatttcttgagagggttgagtaaagaggagatggagttgttggatgagcttaaaatggaagctaatgaggttgagaaattattcggaaaagctctaccaatcagaaagttcaggtagagaaactatattattattactacacatacatacactgttgtaaaaacattcaaccatttcataaaattggatacacaaagaca

SEQ ID NO: 26 - DNA, 1572 bp, Phaseolus vulgaris
cacacatgtgcagtggtgaataaccaaacaccaaatacacataacaaacacacacttccattaacagagacaaacaataacaacaacatagaaaaaacagaacacagagaaagaagatgcatgccaaaacagattctgaggtaacaagccttgccgcgtcttctcccacgcgctcccctcctcgccgccctctctactacgttcagagtccttccagggactcccacgacggcgagaagactgccacgacatcgtttcactccacccctgttttgagccctgttgcttcccctccccactcgcgccactcctcctccacgcgcttctccaagaaggaccacagccacaatctgaagccctggaagcaaatcgatatcattgaagaggaaggccttctccaaggtgatgatcgccgcaatgggctccctcgtcgctgctactttctcgcctttgttgttgggttcctgcttctcttctccctcttctcgctcatcctctggggggctagtagacccatgaagcccaagatctccgtcaagagcataaagtttgatgatgttagagtacaagctggttcagatccaactggtgtggccaccgatatgatcacaatgaattccactttgaagttcacataccgcaacacaggcacatttttcggggtccatgtcacagccacacccgtggaactctcctattcagacatcgtaattgcttctggcaatatgaagaagttttatcagtctaggaggagccaaaggttggtgagtgtagcagtgatgggtaacaggattcctttatatggaagtggtgctagccttagtagcacaacgggtatgcccacagtgcctgtgccattgaacctaaactttgtcctacgatctagggcttatgtgcttgggaaattggtgaagcctaagtactacaaaaccattcaatgttccatcactttggatcccaaaaagctcagttctccagtttctctcaaaaaatcttgcagacatgattgatacatacacatgtggtagagattatgtggaatgcacatgcaaaagaattatttgaaaagataaaataaaaataagaacattattattctatgttcaatggattcttctgatgtttgggaagaaatggaggtaacagctcagacaaggacgcgtttttgggagtatttggctgcacaaattgcctcaaattgcggaaagacaaagacacgatgttgggttgggtagagaaatgtgacattgtggatttgtgattggtcatttcaagaagactttttttcatgtgtgtgtgttgattatttgtctgattttaatctattaattgtaaaagtgacaggtaatttgaattcattgagtctaattgttgtaattgcatctttgtccttgtaattatggtgtaattataggcatataaatttgggtttttgagagttgtttctatctgttaggtgagttttatgatggtggagtcatcatggttcagagatcaattcaatgggtcttcttggatctttcaattcatcattactcaagaagagaattatttaatatcctttttgcaaaa

SEQ ID NO: 27 - DNA, 819 bp, Phaseolus vulgaris
gtgctacagtgtcgaaactttaaaccctttgtcaatttctttgttgttcttcaacttctacactcttctccaacttcaggcacaaaccatggcaaaggacagaacgatcggtgtggctatggatttctccaagagcagcaagaatgctctcaaatgggcacttgagaacttagctgataagggtgacaccatttatgtcattcacatcagccccaattctctagacgagtctcgaaaccagctatgggctaaatctggttctcctcttattcctctgcaagagttcagagagcctgagattatgagcaagtatggtgttcaaattgatatcgaggttcttgatacgcttgacactgcttccagacaaaaggaggtgcacattgttacaaaaatttactggggcgatgcaagagagaaacttctggatgcaattgaagatctgaagctggattctctggttatgggaagcaggggtctgaccacaatcaaaaggatcattttgggaagtgtaagcaactttgtgatggcccatgcttcttgccctgtgactatcgtgaaggaacctatcagcaagtaaagataaatcaattgggagagaagagaacatttaaatttcatatgatattttctttgcaatgttcttgatctagtagagtcatatttcctttcctaaactattttggtgtctaataagaatgagtcatattatagatatatgatgctttctgtattttagctctcactctttgactttattgaaggaataatttaatctgagtgccatatataaggccattaggcctcaaaattttcttctaa

SEQ ID NO: 28 - DNA, 1072 bp, Phaseolus vulgaris
gagaaatagagtagcagtttggcatagggttcataaatcttggagatgctaaactttgtatatcatattttgtgatacagtggtggttgatggagcaaacgatatggggccatttgccggtgctgatgagggcaaattccaaagaatctatagaatacattcttcaagccctttggagaactcgaaagagtggtcttaccacttctgatcgatgcatcatccaagacatgcttcaactacacaatgaatctgatctcgacccacttctggtttgcctccgaatgttaatccggaggtgtgtttatgagaatacttccaaggaggatattcccatgctgtttcccggtgaagttctgcctgaattgcaaaagctgttgacacttttgttgcagaagtttcagcgagagtggcaagaagatgtgatgaaagatcagaatattgtgcctagattaaaggcgatgacatggaatatggcaaatctggagaaaggatcagcagaccctgcagcggttattgatttgaagcttcaaaatgatactccatttcactcgggagtgcaagatgtgaagttccagttggctacagattctatggatatgatgctgaaagccatgcactgtattagagaccagttttctaccatggatgaggcagtaaatgggcattagcacctgtaaaccaaaggagattcttagaagttgttttacaaggaatgaggtttaaattgattccatggaggagctcaactggaaacttatgagttttgaatacataattttaatgtaatttagattctcaataggctgagccttggggcaatgggaaggtttactgtcttgtgacctgagctgtgctttgatattggaaacagcctctctgcttttggtgataagactgctaccaccctctgtaccatatggatacctaaaccactgtgccacccatttaacgattttgggttcacagctctcttatttgtcacttttgtatatttgatagccttaagcacaatgtaatgccagtcaaatactgtggttgaaatttaaagctgattgtgattatttctgtttga

SEQ ID NO: 29 - DNA, 838 bp, Phaseolus vulgaris
aaaaacttggcagcagcagaagaaatgagtacctaaaatattgagttagtggttagaacttgagactaactatggacggtctagttcagctgcagaagcaacttgttgattacactgcttccctatttcatgagggttttctagatgaacaatttaaccagcttcagcaacttcaagatgaaagtaacccagattttgtggttgaagtggtcactctcttttttgaagacgcggagaggcttcttaatgagctcacaaaaacactaggccagcccagcactgattttaaaaagttggatgctcttgttcaccagttgaagggtagcagctccagcattggagcacatagagttcacagagtctgcatttccttccgaaactcttgcgaggagcaaaacgttgaagggtgtcttaaaaacttgcaacaagtgacacaagagtactacttggtgaaaagcaggcttgaagctctgttcaagatggagcaacagattttggctgctggtggatagttttgtaggtagtgtgataggaggcagagatgttttgctgcaattggaatttggaaataacactcagaacaaatcatgtctgatctgcaaacgaaacagacccacttctatgttgtatttttcactttgtgtatgattttgtcaagtggatcatggtctatttgagcaagagttgacctatatttagtccaaaagcaacgcgaatagcacatgcttctatggtttaaagaaagaaaaaatagacgctggaactcttagctgttggaatagtaattatcttgatttttgaaatgtcatctataatatagggcttgattgaataacca

SEQ ID NO: 30 - DNA, 1510 bp, Brassica napus
ctgtcacaactcatcgtcgaaaaaccactgaaccaatctcgagatggagtcacgcgtgctgctacgcgccaccgcaacggtcaccggcgtcccgcagctgaggcgaccgatcagagcgatcaaccgccacttcagcactgcgtcttcgtcgttcacggctttcgctaagccgataggatcaatcggagagggagggaacctgatctccggtcgtcagctccgtccggtgctccttctcgatagctcgccggagaaaagagagattctcaagccggttcgagccgccgctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtccgtgggtctacctaaacgggctccaattaactcggacatcctcaaggtattgataccagttgcagtgtgtcacgccataggccatgttactagcaacgtgtccttcgcagccgtcgctgtctccttcactcacaccatcaaagcactggagccattcttcaatgcgtctgcttctcaattccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctcttttcgtctgccttcctcctgctatcatcgtcgaagggcctcaactgttgaagcacggtttcaatgacgcgattgctaaagtgggaatgactaagttcatctctgatctcttctgggttggaatgttttaccatctctacaatcagttggctactaacacgttggagagagtagcaccgttgactcacgctgttggaaacgttctgaaacgtgtcttcgtgatcggtttctccatcgttatcttcggaaacaagatatcgacgcagacaggtgtcggaactggaatagccattgctggagttgcactctactctgtcattaaggccaagatcgaagaagagaaacggcaaggtaagacggcgtagagagctacggccgagggcggtcaacggttgcgtaaacaaatcctccgatgaatatctatataataaaataaccaaaaatgcaatagtattttgtatcgtataaatcaaacattgtttttgagtttctcttctcgttgttcttctttataaagcttatatattatttttttattctgcgtcttttcttccagtggacaacattgttgccatttcttatgcattgccttatcttttttttttttt

SEQ ID NO: 31 - DNA, 1696 bp, Medicago truncatula
cataccatacaccttacaccataagcaagaacacagtgacttcagtaattttcctttctattttcttttttttttagatttttaaaaattaaatcaaaatcaacgatgtacaaggtagcaaaagcatcacaataccttgtgataaccggaatcggaatcaaagacataaagctcgcaaagaaagcatggattctacccggtcaatcctactccgtcttcgacctctcacctgtaaattacacctttgaagttcaagcaatgagcgcagagaaacttccttttgttctccccgctgtcttcactatcggtcctcgtgtggatgataaggaaagccttctcaaatacgccaaacttatttcaccgcacgataaactctccaatcatgttaaggaactcgttcaaggaatcatcgaaggcgagacacgtgtcctcgctgcatcaatgaccatggaagaggttttcagaggaacaaaagagtttaaacaagaagtatttggaaaagttcaactcgaactaaaccaattcggtttattgatttacaatgctaatgttaaacagttagttgatgtgccaggtcatgagtatttctcatatttgggtcaaaagacacaaatggaagcagcgaatcaagcaagggttgatgtatcagaagctaagatgaaaggtgagattggttcgaaattgagggaaggacaaacactacaaaatgcagcaaaaattgatgcagagacaaagattattgcgatgcagagggctggagagggcgacaaggagggaattaaagtgaggactgaagtgaaggtttttgagaatcagagagaagctgaagtggctgaggctaattctgaattggctaagaagaaagcggcttggactaaggcggctcaagtggccgaagttgaggctgccaaagccgtcgctctaagggatgctgagttacaaggtgaagttgagaggatgaatgctttgactacaactgagaagcttaaagctgagttccttagcaaagctagtgttcaatatgaaaccaaggtacaagaagcaaactgggagctgtacaagaaacaaaaggaggcagaagcaattctgtatgagaagaaggcagaggcagaagcacagaaagcattagcagacgcaacattttatgctcgcacgcaagcagctgaagcagagctatatgcaaagaaaaaggaggcagagggaattgtgacacttgggaatgctcaaggggtgtatctaagtgcacttctcaatgcacttggaaacaactacactgctgtaagggatttcttgatgataaatggtggcatgtttcaagagatcgctaagattaatgctgaggcagtacgcggacttgagcctaagattagtatttggactaatggtggtgataatagtgggggtgaaggtgcgatgaaagaagttgctggtgtctacaagatgttgccacctttgtttaagactgttcatgagcaaacgggaatgttaccacctgcttggatgggagtcttgcctgacaaaaacttgaattaggatgatgcaactattatgtttatagattaattgtggaattttatttggcggatatatgtgtgtgattcactagtctttcagattttcaggttaaaagtcttgtattatatgcttggtattttatggtttaatttacacttttacatgcttggtattttatgaa

SEQ ID NO: 32 - DNA, 1615 bp, Medicago truncatula
gagagagagagctcaatttcatctcaaaaaatggcttgcacctctgcaaattcattactccaattaaagggttcttcattccagaggccaattttgaatttgagaacaaacatttctgctccttactcacccggcttatttaacctaaaaggtgatgggttaatccataaagggttcaggcatcaaagtcaaaaacatttgacacctagaaataaagttacagttatacgagctgtggcaattccggtagaaccagctccagtggaaagtgcggagtacagaaaacaactagcagaacgctatggttttgagcaaattggagagccgcttccagacaatgttacattaaaagatgtcattacttctcttcctaagaaggtttttgagattgatgatgttaaagcatggaaatctgttttgatatctgccacttcctatgcgctggggcttcttatgatttctaaagcaccctggtatctacttcctctggcttgggcttggacagggactgctgtaactgggttctttgttataggacatgattgcgctcacaaatcattttcaacaaacaaattggtagaagacattgttggaactctggcctttttgccactaatttatccatatgagccatggcgatttaagcacgacaaacatcatgcaaaaacaaacatgttgaaggaagatactgcttggcagcctgtttggcaggatgagtttgagtcaagtccatttttgaggaaagcaataatatatggatatggtccatttcgttgctggatgtctatagctcactggttggtctctcactttgatttgaagacgttcagaccaaatgaaataaagagggtgaagataagtttggcttgtgttttcgcctttatagcaattggatggccattaattatttacaagactggaatcatgggatggataaaattctggttgatgccatggttgggctatcacttctggatgagcactttcaccatggtgcatcatactgcaccacacataccattcaaaaactcagaagaatggaatgctgcacaagcacagcttaatggaaccgttcattgtgcttaccctcaatggatcgagatcctatgccatgatattaatgtccatattccacaccatatatccccgaaaataccgagctataatttacgagcagcccataaatccatccaagaaaattggggaaagtatctgaacgaggctagttggaattggcgattgatgaagacaatcatgacagtgtgtcatgtgtacgataagcagcaaaattatgtctcctttgatgaagttgctcctaaagaatctcgtccaattagatttttgaagaaagtaatgcctgattatgcctaattaggtccaagttggcttattttcatgcaatttttttatgtatcagagtaggtaggtataccattcattttcttttttacgtgttcaatagtattgcataatatggttccatttttcatatcacataacaaggggaaattacttggagctccctttaagtttacatcttatggtaatcatattatctagttgcaaaccctgagggacattcattaggttaatgtagacattatattaatctgaa

SEQ ID NO: 33 - DNA, 1719 bp, Medicago truncatula
agaagagtccctagaaagttggaagagtcgacgtgtagaattgtggtggcagtgtgtttgcagtccacatacaccatgctcttattcttatctaatcttcttcgccgcttctcgtcccttctttctttcttctctttttcttttttcatattattattccactgcacctccaatttgaaaggtggaattgcttcattctaatatagatatagaatgtatatggcaacattgggtgcaaattcaaatattataattaaaaatgatataagatttcgccgaacaacaacaacaaggttggcagtgttcaaagtattgcctacacgattgcatttcttaagacatgatcgtaattctcgtggtttggtggtatgccaatgtcaacaccaccaccacaaagggaaaccagattcttcttcaaacatatcacggatattagaaaatggggtgaataggatgcttgttgttcttgaagattggagaaattcacgcataatccaattagttgccatactggtttctattttaatgattgttccatcagctgatgctgttgatgcactcaaaacttgtgcttgtttgctcaaggaatgcagggtagaattggctaagtgtcttgcaaacccatcatgtgctgccaacattgcttgtctccaaacttgcaacaatagaccggatgagactgaatgccaaattaaatgtggggacgtatttgaaaacaaagtggttgatgaattcaatgagtgcgctgtatcgaggaagaaatgtgtacctaagaaatctgatgtgggagaatttcctgttccaaacccggatgtccttgtgaagagctttaatattgcagattttagtggcaagtggttcatcactagtggcttaaatcctacatttgatgcctttgactgccaattacatgaatttcacacagaatcaaataaacttgttggtaatataacatggaggataccaactccagatggtggatttcttacaaggtcagcggtgcagagatttgttcaagatccttcaaatccaggaatcctctataatcatgataatgagtaccttaactatcaagatgactggtatgtcgtgtcatctcaaattgagaataaaccagatgactatatatttatatactaccgaggtagaaacgatgcatgggatggctatggtggtgccgttgtgtacacaaggagtgcagttttacctgaatctattattcctgaacttgatagagcggcaaagagtgtaggaagagactttagcaagttcatcagaacagataacacatgtggaccagagccttccattgtggaaaggctggagaaaaaggttgaggaaggagagaaaaccattgtgagggaagttgaagagttagaagaggaggtggagaaggatttggagaaggttggcaaaacagaaatgaccttgttacaaaggctggcagaagggtttaaagtgtttcaagaagatgaggaaaatttcttaagagggttatctaaagaagaaatggagatactggacagtctcaaattggaagctgaggaagtagaagagctctttggacgtgccttgccactaaggaaactaagataacttataaatatgagaaaaaatgttgtaacatattttttgatatacgtgtttaatattgaatgaattctcatgttggttctctgctgaataatatcaactcattctttataaatgctgtcctcg

SEQ ID NO: 34 - DNA, 1210 bp, Medicago truncatula
atctatctatagtctatccatcttacaggaagaagaacacaggatgaactgcagtcagtttgcgactacaatgcgctctgccttttcccttcatcacttcaactctccgcgcttgtctcgccacgtatccaatgtctctgcttctctacagccccaaggacaagggactgacactcctccacggattggctttttgggccttggaatcatgggcaccccaatggctctaaatctcatcaaagctggagttgatctcacagtttggaataggactaagagcaagtgtgatcctctaatcagcttgggagccaaatataaaccatctcctgaggaagtagcggcatcttgtgatctcacatttgccatgcttgctgatcctcaaagtgcggtggatgttgcttgtggaaagcatggagttgctaatggaataggtccaggaaaaggatacgtggatgtatcaactgttgatgtggacacttctaaattgattaatggacacataaaatccactggagcattatttttggaggctccagtttcaggttccaaaaagccagcagaagatggacaattgatatttcttacagcaggggacagaaatctttatgaaacggttgctcctttcttggacatcatggggaagtctaaattttaccttggtgatgttggaaatggtgctgcgatgaaacttgttgtcaatatgatcatgggcagtatgatggcatccttttcggaaggtttacttttgagtgaaaaagttgggctagatccaaaagtactagtggaggtaatttcacaaggtgccattaatgctccaatgtactcgatgaaaggcccatccatgatacagtcaaattatccaactgcatttcccctaaaacatcagcagaaggatctaagacttgccctggggttagcagagtctgtttcccaacctattccgattgcagccgctgctaacgaattatataaagttgcaaaatcacacggctatagtgatgaggacttttcagctgtcattgaagcattaaaatccaaatttcagcactcagaaaaccagtgaggctcttatgagacacagtttcaacttcaagttgacttgaaatcaagtatagacagattgtaagactagtcaatttaaatgcaattcccaaaatgtagaatttatacttgcaactcccagaatgtgtagaatacacacagagagaat

SEQ ID NO: 35 - DNA, 3254 bp, Glycine max
aaaaatagaattaaaaaaagttatttcaaaatcctaaattcttagtgtgccgacccataagaaaaaaaaagtaaaataaaaagaaaaaggaaaaaaagaagaagcataatttggaatcaagtatatgtgagtagttatggtgatggcatgacaatggtaatgcccctgtgtcttgtgagagtctgagatcgcttttctctctttcgatcttccttttccgcatttctcaacaatcgtttccaatcccacgctaatggcaaatagtgagacttgttgttcaactcagcttattgatggagatggtacattcaatgtttttggggttgaaaatttcatgaaggaggtgaagttggctgaatgtgggctttcatatgccgtagtttctataatgggtcctcaaagtagtggcaagagcacactgttaaatcatttgtttggtaccaacttcagagagatggatgcttttaagggaaggtctcaaacaaccaaaggaatctggatggctagatgtgctggcatagagccttgtacacttgtgatggatttggagggtacagatggaagagaacgcggagaggatgacactgcttttgaaaagcagagtgctctatttgctcttgctgtctcagatatagtgctaataaacatgtggtgccatgacattggccgtgagcaagctgcaaataagccacttttgaaaactgtctttcaggtcatgatgagattgtttagtccacgaaaaacaacattgttgtttgtcatacgcgataaaacaaggacaccacttgaaaatttagaacctgttttgcgagaagatattcagaagatatgggactctgttcctaaaccacaggcccacaaggaaaccccattaagtgaatttttcaatgttgaagttgttgctctttctagttatgaagaaaaggaagagcaatttaaagatcaggttgctagcttgcggcaacggttccatcattctatcgctcctggtgggcttgcaggggatcggcgtggagtagttcctgcttctggcttttcttttagttctgagcatatatggaaagtcattaaggagaacaaagatctcgatcttcctgcacataaggttatggttgctactgtacgatgtgaagaaatagccaacgagaaatatgtttcttttgttgcaaatgaggattggtgtcaattggaagaggctgtgcaatctggccctattcctggatttgggaaaaagctcagttcacttcttgatatttgtttttcagagtatgatgctgaagccacctattttgacgaaggtgtgagatcttccaaacaaaagcaactacaagaaaaattgttccaacttgtccaaccagcattccaatctgcgctgggacatataagatctggaactttggataaattcaaggaggcatttgacaagactttgaaaggaggggaaggattttctgtggctgctaataattgcattgggtcttgtatggttcaatttgatgaagcatgcacagatgttgttattgaacaaacaaactgggatacatctaaagtacgagagaaactgctgcgtgatattgatgcacatgttgcaactgtacgtgcaaccaagatttctgaacttacttcatcatatgaggaaaaacttaaacaagctttgtctggacctgttgaagctcttttggacggagctaatagtgatacttggccatcaataaggaatctttttaggcgtgagactgaatcagctgtttcagggttctctgctgcacttactgggtttgatatggatgaagaaacaaggcagaaaataattttgagtttagaggattatgcaaggggtctggtagaaggaaaggctcgggaagaagctggaagagttctaatccgcatgaaagacaggtttacgatgttgtttagccatgattctgattcaatgcctcgtgtttggacgggtaaagaagatatacgagccatcaccaagactgctcgctcttcttctttgaagttgctatctgttatggctgcaattcgtttggatgatgatgacactgacaatattgagaaggtgttagcagttgcattggtggattcatcaccaaatagtaatgctacaaggagcatgacaatggttgatccactagcttctagcagctgggaacaggtttcatcctctaaaacattgattacacctgtccagtgcaagtctttgtggaggcaattcaagacagagacagagtacagtgtctctcaggccatttctgcacaggaggccaacaagcgcaacaacaactggttacctcccccatgggcaatagttgctttggttatcctgggatttaatgaatttatgacacttctaagaaatcccttgtatttgggtgtcatctttgttggttttcttctcattaaagccctatgggtgcagcttgatgtttcgggtgaatttcgcaatggagctcttccaggaatcatatccttgtctagcaagtttattccaactatcatgaaccttatgaaaaaactagcagaggagggacagaaccctgcagctaacaatcctcagagaaccccatcaaaaagcagttacaatgagggtcatgccgtgtcatctagcgcctcatctaacttgactagattggacaacggaaccgagtatgcgagtccattaaaagatgattaggtgaagacactcatcttactgaaaaccaatttattctgttgggagatggtggtttgtctggtggctgcatgcttgtccacaaaattcatgacttgtgagcattcaagacattcaaaggcattggttttttttgtgcaagtgccatatacagggggcaatgatttgttgatgtagtccccccttgagataggtctcttttccaatttaggcgcttcagttagttggaaaagttatagcttattttacatggtctttgatggttatgctggttttgcaatcaattttgtttgtaaattcggtgtactgagtttttttttttttttgtggaaaatttattaattggattgtgtgtttatgttagatcttttcaaagagatactagagttgatcgtgcttgctgcttgtaatgtcaactattgtttcacgtgtaacatggtcttggaagataggaagattgttttcttctatttattaaggaattaaaagtaaacaattttattttaaagttgtcatgtaatgctataaatacatatagattttttaataaaattttatttattgattaataataatg

SEQ ID NO: 36 - DNA, 556 bp, Glycine max
gtgagacgagggtaaggtcgcgttgtgttgcgtcgtgtcgtgcgctgttcctctgtctgtcgtttttgttttcagaccaaaccctagctccgcatcgcaaccatgtcgaccaagcaaggtggaaaagctaagcctttgaagaaacccaagtctgataagaaggattacgacgaggttgacatggctaacattcagaagaaaaaggaagaggagaaggcgctaaaggagttgaaagccaaggcgcaacagaagggaagctttggaggttctgggctcaagaaaagtggaaagaaataagggctctttatcatgattgtatacatccaatattgagccctgtagtttattaccatgataacttctgtcttattgtggccttctttattgctctaatgttagtactgaactgaggtatttcgtgatgtaagctgcaacaagttacttgtttgtagctttattgtgtggcccttcatggggttctgataattacatcctattagtagtgctgtggatttggcatagacttgttcaagtaataatgacttggcttgcgaaa

SEQ ID NO: 37 - DNA, 2007 bp, Glycine max
ataatagaaggttgtggggttagggctttagagtgtcttttcttctttttcttcttcttcttcttcgttgaatcgcgattgttctgttgtgcgactgaaagaagagagatcgaaaatggcgttggctttcgacgagttcggaaggcctttcataatcctgaaggaacaggagcagaagagcagacttcgaggtttggacgctcagaaagccaacatctccgccggcaaagccgtcgctcgcatcctccgaacctccctcggccccaaaggcatggacaagatgctccagagccccgacggcgacgtcactatcacgaacgacggtgccacgatccttgaccagatggacgtggacaaccaaatcgcgaagctgatggtggagctctcgcggagtcaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtccaatttggagcccctcattcaaacttgcatgaccaccctctcctccaaaattgtgaatcggtgtaagcgtagcttggctgagattgctgttaaggctgttcttgctgttgctgatctggcgaggaaggatgttaatttggatctaattaaagtggaagggaaagttgggggtaaattggaggataccgagttgatctatgggattgttgtggacaaggatatgagtcatcctcaaatgcctaagcaaattgaggatgctaaaattgctatcctcacatgcccctttgagcctcccaagccaaagactaagcataaggttgacattgatacagtggagaagttccagacgttgaggttgcaggaacagaagtattttgatgacatggttcagaaatgcaaggatgtgggtgcaacccttgtcatttgccaatggggttttgacgatgaagcaaatcatctcttaatgcacaggaacttgccagctgttagatgggttggtggtgtagagttggaattgatagctatagcaactggtggaagaattgttcctaggtttcaggagttatctccagaaaagttgggaaaggctggtatggttcgagaaaagtcctttggtacaacaaaagaccgaatgctgtacattgaacattgtgcaaactcaagggctgtaactatattcattcgtggaggtaacaaaatgatcattgaggagacaaagcgcagccttcatgatgccttgtgcgtggctaggaatcttatccggaacaactctattgtctatggtggtggttcagctgagatttcttgctctatagctgtggaggcagctgctgatagataccctggagtagaacagtatgcaattagagcatttggggatgctttggaggccatcccaatggcccttgctgaaaatagtggcctgcaaccaattgaaacattatctgctgttaagtctcagcaaataaaggataataaccctcactttggcattgattgtaatgatgttggcactaatgacatgcgtgagcaaaatgtctttgaaactttgatcggaaagcagcaacagctcctactcgctactcaagttgtcaagatgatactgaaaattgatgatgtcatctccccatctgagtactgatatttttaaactcagtcatggtctacgtcaagatgctgaattggtgatactattttgtttcgatcggtttggttgtagtaagagtccgtacgttcacttgaaatgcaagattttggcccggtttgtatcggagttgggcgattgtttttgttttgtttaatgcaattgcaatgcttttgatatttaacattacggattagttattttttttatagacgttttaatcttagtttgttgacagtgaaaatttgtcttagtatgtgtttgcataagtgttatcaaaa

SEQ ID NO: 38 - DNA, 2095 bp, Glycine max
gggcgagcagagcagtgttaatataaagcgttttgtttggagaagaggggctgagggagaggggatggaggacattgaggatttgctgattggaagtgcaactccaccgggctttcgtttgccattagcagcggctgttggcgtggggacaaagcggaatcaactctcttcttcttcgctttcgccttcacctgcaatccctggcactcagactatcttcataaagacctttggctgctctcataaccagagtgacagtgaatatatggctggtcagctttctgcttttggctattcattgagcgatgatcctgaccatgcagatctctggctcatcaacacttgcacggtcaaatccccaagtcaatctgctatggataccatcatatcgaaaggaaaatcttcaaataaaccactagttgttgctggttgtgtccctcaaggaagtcgggatttgaaagagctcgaaggaatcagcatagttggagtccagcaaatcgatcgtgttgttgaaattgtagaggagactttaaaaggtcatgaagtgcgtcttttgacccgtaagaaattgccagcacttgaccttccaaaggtaaggaagaacaagtttgttgagattcttcctattaatgttggttgtttaggtgcttgcacttattgcaagacaaagcatgctcggggtcacctaggaagttacacaattgatagccttgttgggcgtgtaaaatctgtcatatctgaaggggttaaagagatatggcttagcagtgaagacactggagcatatggtcgtgacattggtgtcaatcttccaacattattgaatgccttagtagcagaactaccagctgatgcaagcacaatgttgcgtattggaatgactaatccaccatatatacttgaacacttgaaggagattgctgagattttgcgccatccatgtgtttactcttttctgcatgtaccggttcaatctggaagtgataccattttgagtgcaatgaatcgagaatatactgtgagcgagttcaggactgttgtagatactctaactgagcttgtgccagagatgcagattgccactgatataatatgtggatttcctggtgaaactgatgaagattttttgcaaactatcaaccttattaaagagtacaagttacctcaagttcatatttcacaattttatcctcgaccagggacacctgctgcaaggatgaaaaaggttccaagtaatgtggttaagagaagaagccgtgaactgacaaatgtctttgaatccttcacaccatactctgggatggaaggcaaagtggaaagaatttggattactgatattgcatctgatggagttcacttggttggtcatacaaaaggatatatacaagttcttgtacttgctccagacaatatgctgggaacttcagctatggttaagataacatccgtgggaaggtggtcagtttttggggatgtaattgagacagtgaaccctgtaagtgacaataaagctctaaacaagctggttcctaatcaggattgcggtaactcagccaagactggtggattttcagaagagccagaatattgtgcctgtggaaatgacatctgttgtggtcagggtactctcgaaaataatgataattcaagaggcagtgcagtgccacagaaccaaagcaaaagaaatttcattggatggatgctgaggaagcgggagcatctgcacaaaacggttgagagtgagcttgcctcgggatctgttaaaaagcaagaaggaatcatgaggaagtgggacttcgttgataaggttcttttgggtggaatatctatcagcatcttgacgattatggctctagtagtagctgttatgtttagagttatttggtcccaataaaaggttttagtttttccgaatcaatctgtcgttccaaaattttgacttgtacaaattgctcggattttattaagtgttttcacatgtatccgcatcttgctttaggttttacggcagttgtattgatatatgatatgattcatagaaaaccctttggggcatgatttatgagaacgaacgaactagcttgttatagctcac

SEQ ID NO: 39 - DNA, 1233 bp, Glycine max
aaacattcttcagttctaagaaaccttaaaaaacaagtagtgttccgaaaagatggctcagcaggaagtggtagaagggttcaagttcgaacagaggcacgggaaagagcgcgtgagagtggcgcgcgtgtggaagacgaggcaggggcagcacttcgttgtggagtggcgcgtgggcatcactctcttctcagactgcgtcaactcgtatctccgcgatgacaactctgacatcgttgctactgataccatgaaaaacacagtgtatgcaaaagcaaaggaatgctcagacatactctctgctgaggactttgctattttgcttgctaagcactttgtatcattttacaagaaggttactggtgctattgtgaatattgtggaaaaaccatgggagcgtgtcattgtggatggtcaacctcatgaacatggtttcaaacttgggtctgagaagcatacaacagaggcaatagtacaaaagtctggttcacttcagttgacttctggtattgaaggattgtcagtgttgaagacaacccagtctggttttgtgaatttcataagagacaagtacacagcacttcctgatacccgtgaaaggattctggcaacagaagtaaccgcactgtggaggtattcgtatgaatcacagtatagcctccctcagaagccattttactttacagaaaagtatcaggaagtgaaaaaagttctggctgacactttttttggcccaccaaatgggggagtctatagcccatctgttcaaaacacactctacctgatggcaaaggccacactgaacagatttcctgacatagcttatgtcagtctaaagatgccaaatcttcatttcttacctgtcaatatctcaaacaaggatggtcctattgtgaagtttgaggatgatgtgtacttgccaacggatgagcctcatgggtcaattcaagctagcttgagccgcctttggtcaaagctgtagaaactgcagaagctatggtgctcatcccttctgtggtggattgccagtgcagcctaaaataccgaacctggccttagagatagtgctttccattaatgtgtcttgtaattctggtttttgtcatcgttgtatttgtttcgtggagaactattatgcatgaataacttccaggagggatattctgcaagttacaccaatgttaagtttttgatgtcctaaattccaataaattcctagtgtccttattatgg

SEQ ID NO: 40 - DNA, 1101 bp, Solanum lycopersicum
tatcctcttcttacctactctcctccatatttccaacaatttactccagttgagaagaagaaaaaacttatccaaattcagaaaaaaaatggcgtccactcagctaacagcatcctctatctctggcaatggttttgcatcctttgaagggctcaggtccacttgcattgtaaagaccgtatcttttgctcctttgaagcacaacaacagcaggtcttttagtcgtcttgttgtcaaggcggctaccaccgtagctcctaagtacactacacttaagcctttgggcgacagagtcttggtgaagattaagactgcagaggagaagactgttggtggtatcctacttccagtatcagttcagtcgaaacctaatggaggtgaggtggttgctgttggggagggtcattcagctggcaaaaccaaagtggacattagtgtgaagactggtgcccaagtcatctactcgaagtacgcgggaactgaggtggagtttgatggatcaaagcacctcattctgaaagaggatgatattgttggtattcttgagacagatgatgtcaaggatctgcagccattaaatgacagagtcctaatcaaggttgcagaagctgaagaaaaaaccgctggaggtttactgttgactgaggcagccaaggagaagccttcaattggcacgattatagctgttgggcctggtcctcttgatgaagaagggaacaggaaaccactttcagtatccccaggaaatacagttctctattccaaatatgccggcagtgaattcaaaggtgctgatggatctgattatattacactcagggtgtctgatgtaatggctgtgctatcttagtgggactattgagttattccgtgccaaaaatttcagcagagatctaggaaggaggaagagctgcatccaactttcgagtgaggagtaatactctctgcaaattaatgatcaatatctcaggtgtagaatcaattttctgaactcatttctgttcttgatttgaggaattagcctttgggaattttgtatgtcaaaagattgaaaactgcagactatgagagattagcaataatatttgcataattcacata

SEQ ID NO: 41 - DNA, 2632 bp, Solanum lycopersicum
gctgtctgcatggactttttgttaattctttaatttaataagatacgagaactcactgagtggcagaaaaattacattgctaccgtgcaccgattttgctaacgtgcgcgaccagtccgtcaacggggatatattacgtttatattttgattggtgattccgagttccgaccggtatatatcggtcggcggctgacttggtgaaacagaaatggccgaagtttctagattgattgctctgctttcttgttgtaccgtgctcagtgtgacggtctgttgctaaaggaattggattggatgactacgtgatcagcaagatgatgttgtgctgaactgacagccataactttaattattgtagttttttgatccctgtagtggagcgggaagtaatagtaatggaagttctccaatcacagttttgggagagctagggttgtattagaaccctaatttttgtgtttgtgtgtaatggttatggagaagaatgagactgtgaggacaggggatgtgtttattgacaggagtaaagttaggattttgctgtgtgatagcgatgccaaaagctcggaggaagtttttactctcttgtgcaaatgttcttatcaagtgatatcagtgaggtcacccagacaggtgattgatgcattgaatgcagaaggatctcatatcgatctcatcctttcagaagttgaccttcctatgtctaaaggatttaagatgttgaagcacattatgagggataagcagttgcgacacattccagtgatcatgatgtcatcgcaagatgaagtctctattgttattaagtgcctgaaatttggagccgctgactacctggtaaagcctctcagaactaatgagctattgaacttgtggacacacatgtggagaagaaggagaatgctcggactagtagagaagaacatcataaattatgacttcaatctggtcgtatcagagcccagtgatcccaacacaaatagcactactcttttctcggatgacaccgatgataagtcatggaagtgtgttaatccagaaatatgtccctctactatgctgcaagaagaagcaagatgcaagtctaatgcttcaactgatgccgctcccgtagagactgcggttgtagttccatttgagcatccacctaatgcaccaggaactgatgatcaaagcacaggagaaatttcactatttcctaagaagagtgaattgaagataggtgagtcttccgccttttctacatatgtcaagtcaagcttgccgaaaagcactggccaaagcccaacctctatccgtggaagtgtgcctcagcaattggggattgaagaaaacacttcattgggaggacatgaacacattgattctaacatacaagtcactggagatgtagaaagtcacttgcaaggtgatggctatgacaatattccaacgtctttttctatcgagaggtcatgtactccccctttatcacaggaatttccacatcactggaactcaaaaatggaggaattctctcaggtgcatatgcatctcaaaaatgaggctcagcatgatgtttccagttttcatgcacaaactccttatccctattatatttcaggagtaatgaatcaagtcatgatgccgtcaactcaaatatatcacgagagcctgcaacatctccataatcatgctaattcagctatgttgcctcaatacaattatatgccgcaatatcctcatatgcatggaatatcatcttatcctttctacccgatcggcatgtgcttacaaccaggtcaattgccagcagcacatccatggcattcgtttggcagttcatcttctgccgaaatcaaggtgagcaaagttgatcttagagagacagctttgatgaagttcagacagaagagaaaggaaagatgttttgacaagaagattaggtatattaaccggaagcaagtggcagagcagagaccacgtttgaggggacagtttgtaaggaaggtcaatggtgcgaatgtagatgtcaatgggcaaccttcttcagcaggcaatgacgatgttgaagaagaggaagtacaaatagaatatgtggattcttcacacgaggatgatctgtgaacatgtcagttgattgcaactttgtgatagttctcttgtattatcagaattccctgggacggagatgtactatagctcatggatgaatgcagaatgacgccttgatctacatgcacacaaatggcacaagcttgctttcagctgccaatcaaaggcatctgcggtctacatgcagcatcggggtgcaatgagattgacctgctgcctatccctttcattcctgtgattttgagcttaagtggatactcttgagagcaccctggacatgagatctcatgtgtggcaggtactatggttttgccatgttatgtccctggaagtaaaagttcttagatccatgttcgaacgagggaagtagagccacaatgcactttgacggtgtaaaaaagtaacgagatcactgtgacattccctaagggaagtttcatgaagtttaccatatgaaattaaatgtaatagactgatcatatagtaatcttctgacactttgttgtaatgattaagttcataatgcaacatgttat

SEQ ID NO: 42 - DNA, 729 bp, Solanum lycopersicum
ctctgcagcatggtgtgccaattactcaattttttaattctttctcttcttctccggcgccaccacctccgccacccgccgtgaaacataaatttatttttggtcatttttcaaaattaaacaatgcttgtctctgtttttctcgctctgtttcttccctgtgttggaatgagcgctgttttcttagtctacatctgtttactctggtacgccgctgcttaccaatctgccggccccggcgctgaaaattaccatagtcagaaaacgaatcaggaattgggtctttctgctgctcaattggacaaactaccgaaaattacagggaatgaattgttaatgggtaacgattgtgcggtgtgtttggatgaaattgagaatgagcaaattgctcgagttgttccgggttgtaaccatggatttcaccttgaatgtgctgatacttggctttcaaaaaatccgatttgtccagtttgtagaactaaactggagccggagttcttcaatccacctgaaagtaacccatgttgaagatattcctaattacaattatttcaaactttatttttattaatgttcgatagattataggagtagtttgatatgattggtgttgaattttttttttcttcgtttaattctgaatctggggtggtggatgttgttatgagaaatagcttaattttgaatcaagtacagttcctagaatttcgatttcttttttcatttcag

SEQ ID NO: 43 - DNA, 1829 bp, Sorghum bicolor
caacaatgcaactaaatcaaaacacaacgcccatagaaactaagcatagagaaatagcgccaacaaattaaatgggcccttttcacatccccagtacaagtggtcctcgcaagttttatcaccttgtgctcttccatgtgcacccgttctggatccaactcttgtacttcctttccatctccgtcttgggtttcttgatgctgagagctctgcccatgaagtccatctccgtccctaggccctcggctctcgacctagtcttcacgtccgtgtcagcgacgacagtctccagcatggtcgccgtcgagatggaatccttctccaactcccagctcctcctcatgaccctcctgatgctcctcggcggcgaggtgttcacaagcatgcttggtctccacttcaccttcaccaagttcatcaagaagagagaaatacctcatagtaataataatagtctccatggtaatatcaatggaccggcaccggcggcacctagtagcttagagcacggtcaccgtcgccgtcccatggagatggaagcccaggccgccgccgtccaaatggagctagcagggttcaacaacgacgaccaacgtgattttgcatccatagctaggctgctaatgttcatcgtgcttggctacctctcggtggtgcacctcgccggctacacgctcattctaatctacctcagcgtggtcggcagcgcgagagaagtgctggtcggcaagaggatcagcctgagcaccttctccgtcttcacggtcgtctcgacgttcgcgaactgtggcttcgtgccaacgaacgaggggatggcgtccttcaagtccttcccgggcatgctcctcctcgtcatgccacacatcctcctcgggaacacgctcttccccgtcttcctcaggctctccattacagcgctcgagagggtcaccaggaggggagacctccgcgagctgctgagggacggaggacccggcggcggcggcggcggcggcggcggaccagctgctgctgctataggctacgaccacctgctgcccggaggccgcacatggtgcctggctctcaccgtggcggtgttcctggcggggcagctgctgctctactgcgccatggagtggggctccgatgggcttcgagggctcaccgcgttccagaagctcgttgccgcgctcttcatgtccgtcaactccaggcactccggcgagatggttgtcgacctcgccaccgtgtcgtccgccatcgtcgtgctctatgtgctcatgatgtatctaccgccttacaccacatttttacccatagcgatggaagaccaccagcagcagcaaaatgaggcacaatccgacgacaagagcaagagcagcagcagtattagcatctggcagaagctgctcatgtccccgctctcgtgcctaaccatcttcatcgtcgtcatctgcatcaccgagcgccggcagatcgctgacgacccaatcaacttcagcgtcctcaacatcgtcgtcgaagtcatcagtgcgtatggcaatgtgggattcagcaccgggtacagctgcagcaggcaggtgacgcccgacggcagctgcagggacgcgtgggttggcttctccggcaagtggagcagggaagggaagctcacgctcatggccgtcatgttctacggcaggctcaagaagttcagcatgcatgggggtcaggcatggaagctaggctaaatcaaagtactgcttcgacactcgatctgctcgttattattgtacatttctctatagatactagcagctagatcaacctgctctccaagactagtacttgatgttggtgtaagcttg

SEQ ID NO: 44 - DNA, 1230 bp, Zea mays
ctgtcggccccacatggcgatccagcctcggcccctccacgtcgccctctccccagctgcttccgccgcccctccccatcgcgtcgcccgtctgcaaactgccgcctttgccgatccgcctccacatctccgcctggaagacgagaaacgaggaagacgatcccacctcgcctggaaaacgcatcccaagacttcaaccttcctttccggccggagatccgcttcgcatctccgcgacagatccgggcaaacgggccgatgcagttcttcggcggctcgtcgctgacgtcggtcgcgccggaggcgaccccagccccggcggcgccccctggtacgggcacgggcgccagcgcgcaggtcctctacgtcttcaaccgcaacggcgtctgcctgctctaccgcgagtggcaccgccccctccgcacgctcgaccccacccaggatcacaagctcatgttcgggctcctcttctcccttcgctccttcaccgccaagatcgacccaaccacggcagaaaagggaaatcttggtgtgccactactgccaggccaaggttgttcgttttatagcttcaagacaaacacatacaaactgaactttacggagagcccttctggtataaagcttatactaattacacatccaaggactggtgatcagcgagactcgctaaagcatatctacaacctatatgtggaatacgttgtaaaaaatcctctgtatgctcctggaacaccaatcaagtgcgaacttttcaacaaacatctcgatcaatacgtgagaacaataatttgatgtcattgagacaatgggttggtgaggcaaaaaaaggtccatttcatgttctttagcgtgatatcaccatttcgtggatggtagacttttctggtggaaaatttgcacagccgcaccatgggagctgcagtattcttgtgtaccgacctcaatttgacagctctactgtgacaacactcctgtagcctgtttgtttgatcgttacggatgcattcgacagggaagctgcattgtgcattgtcgcttctagtgtgacgtgtacatgattaatccatgggttattgcgtcaccgttcaagggggttcatggtcaagtagtaattatttcatatttgaaccggtcgccttgtcagatgactagactgaaacatcatgttttccgcttgagacattgtatgatttgtatggttggctgctaggataaagtcatatcagg

SEQ ID NO: 45 - DNA, 997 bp, Zea mays
attagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcgccgactggcgaccctgccttgaaggggctggcaagatgatcggcgtagggaaggcgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgctgttggtgcaagggtgcttgaactactctgtcacagggagaagggaaatagacgagagacacgacttctgggcattttatcattcatccacagtactgtttggaaagtgttgtttggaaaggtggctgactcacttgaaaagggaacagaacacgaggatgaatacatgatcagtgaaaaggagcttcttgttaaccgtttcatttctgtgccaaaagacatgggagcattcaactgtggagcttttgttgcgggcattgtaaagggtgtattagataatgccggctttcctgccgtagttactgcacattttgtgccaattgaaggccagcaaaggccaagaacgacaatcctgataaagtttgctgaagaggtattacacagagaagcaagactgggctgagtttttatgtatgtacacaaaacctttgactagcctatttgtaaggtgaatcgttactggagtttggtgatttcttgtatttgagtagttcggtgatttcttgtatttgagttatgtaatagcagtgtgactgagaataaaagttatgtaggtgagatcgcaggtgcttcatcagtcttattgaaatccgaccgaaactgctgtattaatgcttttccttgcattcaccttgtatt

SEQ ID NO: 46 - DNA, 1365 bp, Zea mays
ggctcacatctcagagtcacaggtgcaaacctcgcgcgcgctaccgtctcaaaaaaaaaaacacacacacacacacccgtcgcgtgcccactcccttcaaaccttcatcaaacacccgttgcgcttgcgccagcgggcagcccctctcccgcagccgcagtcccagtcccacgcgcattccgccccgcggctcccgagagagagagatggccaggcacgccaagacggactccgacgtgacgagcctggcggcgtccacgccgccgcggtccccgcgcggccgcccggcctactacgtgctcagccccgccgcctcccacccggacgtccacctgggcgcctccggcggcgtggcggggaccaccccggcggagtcgccgctccactaccacttccaccaccaccgccaccactcgagcggcggcgccggtgtcggcgtgggcggcatgcaccactcccgggagtcctcgacggggcggctcctcttctccgaccagctccgctccggcggcgacgtcgccgcggtggtgagcgtcccctggcgccggctcgggaacggcagcggcgcgggcagcgtcggggacgaggacgacgacggcgcgtccctgcgcggcgggtcgttcgcggagtcgccgtggcggtgctacgcgctcggcgcggtcgcgttcgtcgccgtgttcgccttcttcctgatcgtgctgtggggcgccagcaggtcgtacaagccccacgtcgtcgtcaagagcgtggtgttcgagtcgtaccacatccagggcggcacggaccggacgggcgtccctacgaagatgatgtcggtcaacgcgacggtgcggctgcgcttccgcaaccgcggcaccttcttcagcctgcacgtcacggccacgccgttcctcctcttctacggcgacctcaccgtcgcctccggagagatggcggagttctaccagccgcggaagagcgggcggacggtgacggtgtccgtggtggggaagcaggtgccgctctacggcgcgggcgccagcctgcacagcaagcccaacaacgggcgcctcggccccgcggtggtgcccgtcaggctccgcttcgtgctgcgcgcgcgcgcccacatcctcggcctcctcgtcaagtccaagttctaccgccgcgtgcgctgcggcctcgacatccgcgaggcgcacctcggcaggccggcccgcggcgtcgcctccggctgcgactaccacgacgggatgcgatgatcgttcctgccgccgttgtgtcgcctcgggcggggtttgctgcgttgtggttgcggacgaactgtgtaatcgattcctacgaaccgttctaatgtaaccggcggcgtcgacaagatcacagatcgtg

SEQ ID NO: 47 - DNA, 1939 bp, Zea mays
ctccgttctgttccgccccgccccgccccgaagcagcgcgaaacgacacacgcgagctatcccgacagtaggaagcgagacggggccagtaggaagcgccaagcagcaacgcagcgcatccactcgtcatcggcaaaccaacacccccggcccggccgcgggcggctgcgctcacactccactcccctgacggcctgaccccgcgcgcacaagcaacagcagcccgatggccgcaccgtcctccgccgccacagcctgcttcgtctccccgctcccgccgcctcgccgcccgcgtcatttcctcaggcacctcgcgcgcgccgccgccgccgagcccacgcccgcctccgcctcctcgttcgccctcccgtcgccatggccgtgggcgcggcggctccgcgacctggtccccgccgaggccgcgggccggctgctgtcgtcggccgcgggctccctcatcgtcgcgctcgcctccgcgtcgctcgtcctcggcgacgccggcgcggcctccgcgttcgtcgtatccacgccgcggaagctgcaggcggacgagctcgccaccgtgcgcctcttccaggagaacacaccctccgtcgtctacatcaccaacctcgccgtcaggcaggacgcgttcacgctcgacgtgctcgaggtgccgcaggggtccgggtccggctttgtctgggataagagcggccacatcgtcaccaatttccatgtcatccgtggcgcgtcagaccttagggtcacacttgctgatcagtcagtgtatgaagcacaagttgttggatttgaccaggacaaggatgttgctgttttgcgtatcgaagcaccaaaggataaactaagacctatacctgttggtgtgtcagcagacctactggttggtcagaaagtatatgccattggaaacccatttggccttgaccacactcttacaacaggtgttatcagtggattgcgccgagaaatcagttcagctgccacaggacgtcctatacaagatgtgatacagactgatgctgctatcaaccctggtaacagtggtggtccactccttgatagttctggaaacttgataggtgtaaacacagctatatactcgccctcgggagcatcatctggtgttgggttttccattccggtcgatacagttgggggcattgtggaccaacttataaggtttggcaaggtgacaaggcctattttgggagtaaaatttgcccccgatcaatctgtggagcagcttggattaagtggagtgcttgtcctggatgctcctccaaacggaccagccggcaaagcgggtctgcagccaaccaaacgagatccctatggtcggcttatcctgggtgacataattacctctgtgaatggcacaaaggtgacaaacggaagcgacctgtaccggatactggatcagtgtaaagtcggggaaacggtgaccgtggaagtcctgcgtggcgatcataaggagaagatccccgtggtcctcgagccgaaggccgacgaatcatagcgaacccaggttcttctgtaccatagcctgatcagtttgtcactttgggacaagacaagaggcgggcgtcttaagcattttcgcctggtgtattttctgcagcagacgcgcaaatacacaagggcgcgtgtcctagcattttcgccttcgttcgctgtacataattcctgctggtctgctggagaagaaggggggtactatccaggtcgccgcccgtaatgccgtctcagcattttctgtgtgtgtgcgtgtgtgctgtagcatgtcggcatcctacagtgctttagagtttatagatagatggcctacccttattaatacgagatgttgatcagatgaccatccatccagggaagggaaactgcgggtagaggaccaatgagcttactgatatcacggatcacctaaacctttttgacc

SEQ ID NO: 48 - DNA, 1931 bp, Zea mays
aaccagtaaaaggtcgggaaaaaaatccgaaatggccgctagtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcctcacgctcgcgctcgctaccgtgtcgtacctctggtccacgccaggcgtcgcgccggggttcttcgacatgttcgtcctcgccttcgccgaacgcctcttccgccctaccttccgcaaggatgacttggtatttgggaagaagctcggggagggcgcattcggggtcgtgtgtaaggcttcactggcgaaccccgaagcggcgaagaagcaaggggatttggtcgtgaagaaggcaacagagtatggtgcagtggagatttggatgaatgaacgtgtcaggagggcatgcgctagtagctgtgcggattttatttatggcttttgcgagaccaaagcaaaaggtaagggagctgaagaatattggcttatttggcgttttgaaggtgaggatacactttatgatctcatgcaaagcaaggaattcccttacaatgtggagacaaaaattcttggcggtatccaagacttgccaaagggaatagcgagagagaataagatcattcaaacggtgatgagacaactcttatttgctcttgacggacttcattcgacaggaattgttcacagagatataaaacctcaaaatgtgatattttcagagggatcacgaaccttcaaaattattgatcttggagcagcagctgacttacgtgtaggaattaactatattcctaaagagttccttttggatccaaggtatgctgctccagaacaatatattatgagcacacaaaccccgtctgctccttctgttccagttgcaacaactttgtctccagtcctgtggcagctgaatcttcctgacagattcgacatatatagcttgggtctcatattcttacagatggcattcccttcactacgaactgatagcaacctcatacaatttaatcgccaactgaaaagatgtgattatgacttacaagcttggaggaatctggtggagccacgagcgagtgctgagctccggaggggctttgacatcatggatttagacggtggtatcggatgggaactcctcacctcgatggtccggtacaaagcacggcagaggaccagtgctaaggccgcattggcacacccgtacttcaaccgtgaagggctccttggcctctccgtcatgcaaaacgtacggctgcaactgttccgcgcaacccagaaggactacagtgaagcagcgcggtgggttatcggcctcatggcaaggtcaggaactgaagatgtgggaggctttacagaagcacagcttcaagagcttagggaaataaaaccaaagaaaagcagcacccagcggaacgcgcttgcctccgtgctgcgcctgcagaggaagatcatgagaacgatcaaggagagcatggacgagctcaacagccagcgcaaaagcatctggtggagccggtggatacccagggaggagtaggccggccgcaggcgcacatgtacatcgtccacttctgtatgaaacgtcacctattagcactggtgaattggtgatagtataatacactatcctacttactgctttgtacatgctgacgactggtgagtaaaattcatctgaaaaaaaaatcggagtaacgcgatgtatagctgtaaatattttgcattgaagcatcatgatttttgagatc

SEQ ID NO: 49 - DNA, 1302 bp, Oryza sativa
cagcaaccaactccaagcttgctaactaacaaagcatcttgaattcctcttgaccaagtagttaagtagctaagctaattagtggtctaactttgaacacaacacaacaaaacacacacacatcatggccacgtcactatccttggcgcccaaacccgccgccgtcgccgtcgccgccgccgccatcccgaggcttgttccgccgccgtctatcgacatgtcggcgctgtcgccgccgccgccgctcgtcagcgtcagcaggagcatggtagcgaagcacaaggccgtggttgtgatgggcgcgacggggacggggaagacgcggctcgccgtcgacctcgcgctccagttcggcggcgaggtgatcaacgccgacaagctgcagctgcaccgggggctcgacgtggccaccaacaaggccaccgccgacgagcgcgccggcgtgccgcaccacctgatcggggtggcgcacccggacgaggagttcacggccgcggacttccgccgcgccgcgtcgcgcgccgccgccgcggtcgccgcgcgcggcgcgctgcccatcatcgccggcggctccaactcctacatcgaggagctcgtcgacggcgaccgccgcgcgttccgcgaccggtacgactgctgcttcctgtgggtggacgtgcagctccccgtgctccacggcttcgtcggccgccgcgtcgacgacatgtgcggccgcgggatggtcgccgagatcgaggcggcgttcgacccggaccgcaccgactactcccgcggcgtctggcgcgccatcggcgtgccggagctcgacgcgtacctccgctcgtgcgccgccgccggcggcgaggaggaacgcgcgcggctgctggccaatgccatcgaggacatcaaggcgaacacccgctggctgtcgtgccggcagcgcgccaagatcgtgaggctagaccgcctatggcgaatccgccgcgtggacgccacggaggcgttccggcggcgcggcggcgccgccaacgaggcgtgggagcggcacgtcgccgcgccgagcattgacaccgtgcgatccttcctccacggcgaattcaccaccgccgccgaaactacggcggcgccggtgccgccaccgccgttcctccccatgtttgctctcgccgcggcgggcgccggcgtctaagctcagctcagctcgaaacgacagtaaaaattttaaaaaacttgcagagatggatggggagcttaataagtgtgaagtgaaggtaattaagaagaaattaaccactgtttgatgtaatgacattgatattgacc

SEQ ID NO: 50 - DNA, 2248 bp, Sorghum bicolor
aaaaccactcatcgttctctgcctccgtccactcccgacgccgtgcctccatggccaccgccacggcgaccccgccgcaatgctggcgagggctccccgcctcggcgcgggcacctccacctctctcctctcccctccggccgcgccccgtagccgctcacttctatcccctcaggcgccgcatcgccactgctacagccagaggaaggcgagccccactggcctgctcccccaggtgtacgctggagacggccggcccgggcttcgaccctctggggctgtacgaggaggggtctgattctccgtcgcggtctcccctgtctaacttcttcggtatcctggcgccggtgtttgggagctccagcggcgggggtgccaggagggagaaggcgtcctatggccgaggagcagcagctgcaattgaggatagctccattgacattggtgacttcttcaagggccctctacctgggaagttcctgaagctccttggttttttggccttgtctaggcttggtgtgtatataccactgggtggggtcaaccgagaagcttttgctgggaaccttgaccagaacagcctgctgggcactttagattctttctctggtggaggtatcggccggcttggaatttgctcccttggcattgtaccatttatcaatgcacagattgtgtttcaactccttgcgcaactctacccaaaattgcaagaccttcaacggaaagaaggggaagcaggaagaaagaaggttcttcagtacacaagatatgcttctgttggatttgcaatttttcaggccattggacaagttctttatctccgtccttatgtaaatgacttcagcacagaatgggttctaacatctgtgacattattgacacttggatcggtctttactactttcattggtgaaagaatatctgatctgaaacttggaaatggaacatcccttcttatatttacaagtataatatcatatttgcctgcgtcattcgggaggacagttgcacaggcatttcaagatgggaattatgttggacttctcacaattatattgtcattctttctattagtccttgggattgtctatgtccaagaagctgagcgcaaaatacccctcaactatgcttctcgttacagcagtcgaactgggggacttcagcgatctgcatatctgccatttaaggtcaacagttctggtgtcatgcctatcatattttctacatcttcactggctttgcctggtactttggcacggttcgctggcttagactttcttaagaaggctgcgatagcccttaatccaggaggtgctctctatcttccaactaatgtattacttatagccttcttcaactattattacacgtttctccaattggatcctgatgatcttagtgagcaattgaagcggcaaggtgcttcgataccgcttgtgaggccaggaaaaagtacagctgcttatattaaaacagttcttagtcgcatatctgtcctgggatctgcatttctggctgtgctagctgctggaccatctgtagttgaacagataagtcacttgacagcattccggggatttgctgggacttcagtgcttatccttgttggatgtgcaacagacacagctcggaaagttcaagcagaaataatttcccagaaatataagaatattgagttctatgatgtcaaccgttttgaccaataattgatctcactggtcattcttttcaacctgtacttagttttttaattgtgtaattgaatattggatccgtaaggctgtaactaagcattttcttatttttcacttgggtcttaattttttgtactgtgtatagcacttaaatctatacttaaagtacataaatcattcatctgtacactaacatgtcagagcactcaagtcttaaagctatgaatgctcattgttattcacaattcttgttgctgatgatgtaacatgtattttgtccttaacaaaaaggagcttaaattacggatcccatccatatttattatgtttaactttattagatcaactgaagaactggctgaatggtcatgatttctatgaggcaaggtgagatgtactgattaaatagggctggggagttgaactcagctgtttcattttgtacaccactatgaacatgcacacctcgtttcctcatcttatgtgggtagtttctctttttttttcaggtttttatcttgtggttttattactatgtgactaagttctgc

SEQ ID NO: 51 - DNA, 780 bp, Sorghum bicolor
aagtccccgctcccggattcccgacgacgagctcggagctcctcctcccctgcccctgttcggtgctcgaagcaacagctgccgccatgtctgccgccaaccagctcgccgcgctcatccacaacatgttcgccacgggtttgcttgacgaccagttccagcagctccagatgctgcaggaccccagcgctcctaacttcgtcgccgaggtcgtcacgctcttctgccaggacggagagcggatcatcggagagctggccaagctgctggacaagcccgtcgtggattttgacagggtcgacgcctttgtgcatcagctcaaaggcagcagcgctagcgttggtgcactgaaggttaagaacacttgtgttcagttccgcgagttctgtcagcagaggagcaaagatgggtgcctgaagacactggagatggtgaggattaacttctatgagctgcgtggcaagtttcagaccatgcttcagctggagtgtcaggtcaacggcttccctcccaacaactaaaccaaatggcagcgctgagcttcatgtcaggattatgcatgcacctttcaaatctcaagacattctgaatgagctcctcaattggcttgtgggaagcctgtaatagcttagcagcagtagtagtgttaacaccaccgtagtagtatcattgttgtcgctcccaataatttctcttaggaatctgctcatggaacctggtggtgaaacaaactaaaatgctatggctattgtttaattataataggttgctgcgtttggt

SEQ ID NO: 52 - DNA, 3179 bp, Oryza sativa
gtcttccgccccgccccgcccctcccctccacccacgcggagaaggagaggaggagaggagaggagagagggaggcagcagctcgcccgccgccgcccctccctccgtgcccgcgccgcccaccccgccgccgggcaccggccaccatcgtcttcatcatcttcccaataaaccccccatggcgtcctccctctccctcgacgacatcaacgacgactccgtcgacctgtcgaaggcgccggtggcggaggtgttccagaagctgaaatgcgaccggaaggggctcaccggagcggagggagagagccggctgcggctgtacgggccgaacaagctggaggagaagaaggagagcaagcttctcaagttcttgggcttcatgtggaacccgctgtcgtgggtcatggagatcgccgccatcatggccatcgtcctcgccaacggcggcggccgcccgcccgactggcaggacttcgtcgggatcgtctccctgctcatcatcaactccaccatctcctacatcgaggaggccaacgccggcgacgccgccgccgcgctcatggccggcctggctcccaagaccaagctgctcagggatggcaggtgggaggagcaggaggcggcgatcttggtccccggcgacatcatcagcatcaagctcggcgacatcatccccgccgacgcgaggctgctcgagggcgacccgctcaagatcgaccagtcggcgctcaccggcgagtcgttgccggtgaacaagcacccggggcaggaggtgttctcgggctccacggtgaagcagggcgagatcgaggccgtcgtcatcgccaccggcgtgcgcaccttcttcggcaaggcggcgcacctcgtcgacagcaccaacaacgtcggccacttccagcaggtgctcaccgccatcggcaacttctgcatcatctccatcggcgccggcatggcggtcgaggtgctcgtcatgtacccgatccagcaccgcgcctaccgcgacggcatcgacaacctcctcgtcctcctcatcggcggcatccccatcgccatgcccaccgtgctctccgtcaccatggccatcggctcccaccggctgtcgcagcagggcgccatcaccaagcgcatgacggccatcgaggagatggccggcatggacgtgctctgcagcgacaagaccggcacgctcacgctcaacaagctcaccgtcgacaagaccctcatcgaggtgtgctccaagggcgtcgacaaggacatggtcctcctctacgccgccagggcgtcgcgcgtcgagaaccaggacgccattgacacctgcatcgtgaacatgctcgacgaccccaaggaggcacgcgcggggatccaggaggtgcacttcctccccttcaaccccgtcgacaagcgcaccgccatcacctacatcgacggcaatggcgactggcacagggtgagcaagggcgcgccggagcagatcatcgagctctgcaacatggccgccgacgccgagaagaaggtccacgccctgatcgacagctacgccgaccgggggctccggtcgctcggcgtgtcgtaccagcaggtgccggagaagagcaaggacagcggcggcgacccgtggcagttcatcgggctgctgccgctgttcgacccgccgaggcacgacagcgcggagaccatccgccgcgcgctccacctcggcgtcaacgtcaagatgatcaccggcgaccagctcgccatcgccaaggagacggggcggcggctcgggatgggcaccaacatgtacccgtcgaccaccctcctcggcgacaagaacagccaggtgaacggcctccccatcgacgagctgatcgagcgcgccgacgggttcgccggcgtgttcccggagcacaagtacgagatcgtgaagcggctgcaggagatgagccacatctgcggcatgaccggcgacggcgtgaacgacgcgccggcgctgaagaaggcggacatcgggatcgccgtggacgacgccacggacgccgcccggagcgcgtcggacatcgtgctgacggagcccgggctgagcgtgatcgtcagcgcggtgctcacctcccgcgccatcttccagcggatgaagaactacaccatctacgcggtgtccatcaccatccgcatcgtcctcggcttcctcctcatcgccatcatctggaagttcgacttcgccccgttcatggtgctcatcatcgccatcctcaacgacggcaccatcatgaccatctccaaggatcgcgtcaagccgtcgccgacgcccgattgttggaagctcaacgagatcttcctcacgggggtggtgctcggcacctacatggcattggtcaccgtgctcttcttctacctcgcgcacgacacgaacttcttcacggatgtgttcggggtgacgtcgatcagggagagcgagagggagctcatggcggcgctgtacctgcaggtgagcatcatcagccaggcgctcatcttcgtgacgaggtcgaggagctggtcgttcgtcgagaggcccgggttcttgctgctcttcgccttcttcgctgcgcagatggtggcgacggcgatcgccgtgtacgcgcgctgggatttctgccggatccagggcatcgggtggcggtggggcggcgccgtgtggcagttcagcgtcgtcacctacctcccgctcgacgtcctcaagttcatcatccgctacgccctcaccggcggcaaggccggggacagcgcccagaaaaagtgagggaatcctgggtgtttgtctcgcgcacacggcgttcacgacacaaggaggaggagctcacccagccccgccgccgcaaccgccgccgccgccgccgtctccgacctcctcgccgccggtaaggaggagctctccgagcaggccgccaagcgcgccgaggtcgcaagatcgactcggtggtgaagctgaacgccggtggccggagagcttgttcatgttgccgtaagcgtacgtctcgtgtttgcgtggttttgagcgggaatgagcttgtgagaaaaacaaaaaaaacaaaaaaaattcagtccatctgctggtatatacatatttcatctgttcagtttttcagtacatatatcttgtcaactgtgtatatttgtgcatgtctatatataccctatatacaagtgttcagttgaaattt

SEQ ID NO: 53 - DNA, 1615 bp, Zea mays
tcacgagccaagttaaaccgactcacgagccaacttcagtcaagccgagctcctctttgaaaagagagccgagctcgtctatcaaccagccaccgtgcagcggcaagggtgtcaaggtcccgtaaaatctggcttttctccctccccataccccgcagtcccgcacacacactcgctttcttcggttcttcctcctcgagcagccacttccgtctctaaccctacagcgacgacgagagcgaggccatgaaggggaagaagccggtcaaggagctcaagctcaccgtgccggcgcaggagaccccggtagacaagttcctgacggcaagtggcacgttcaaggatggtgagctgaggctcaatcagagcggcttgcggcttatctctgaggaaaacggggatgaagatgaatctacaaagctgaaggtggaagatgtgcagttatcaatggatgatcttgagatgattcaagtcattggcaaaggaagcggtggtgttgtccagctagtgaggcacaaatgggtgggcacattatttgccttaaagggtattcaaatgaacattcaggagtcagttcgtaaacaaatagtacaggagctcaaaataaaccaagcaacacagagccctcatatagttatgtgccatcaatctttttaccacaatggtgtaatatatcttgttcttgagtacatggaccgtggatcgcttgcagacattgttaagcaagtgaagactattctggagccataccttgcagtactttgtaagcaggtcttggagggtttattgtatcttcatcatcaaaggcacgtgattcacagggacataaaaccatctaacttgttggtcaaccgtaaaggtgaagtcaagattaccgacttcggagtgagtgctgtgctagcaagctcaataggtcagcgagatacatttgttggaacctacaactatatggcgcctgagcggattagtggtagcacttatgactacaaaagtgacatatggagtttgggcttagttatacttgagtgtgccattggccggttcccttatataccttcggaaggtgaaggttggttaagcttttatgaacttctggaggccattgtcgatcagccaccaccttctgcacctgcagatcagttctctccagaattctgctcatttatctcctcttgcatacagaaagatccggctcagaggatgtctgcttcagaactcttgaatcacccttttttgaagaagttcgaggataaggacttaaacctggggattcttgtggagaacctggaacctccaatgaatatacccgaatagcctgtcgtttttagtgatgaagcctttgttgtgccttcagggtttggcctcgaagcctcttggcatctgctcctcaactgcagcctccctacctgaatatgctataacatcattgtatgattcaagccccttatctgagcataagagtagagggaactatgctgcattccgtgtatggtcaccttattgtagctattgttgcgacgggccttgtgattttgagtcttgttttaacttttgcagtcttatcggctgtggattcaaaatgaacgaactgaatattcaaaacatgtttgccaac

SEQ ID NO: 54 - DNA, 1567 bp, Sorghum bicolor
tccatccatccatccatccatcgagcaccaacaagccacacacacacacacacacacgtacgtacagagagctagctagctagcgcacgagtcttcttcttcttctagagatcgactgatcgacgacgacgacgaacgcaatataatgggtcccaactcgtcggcgctgggcaagcagcagcaggcggcggcggccatggcgccgaagcgggcgtacgtgaccttccttgcgggcgacggcgactactggaagggcgtggtgggccttgccaagggcctgcgccgtgtcggcgccgcctacccgctggtggttgccgtgctccccgacgtgcccgaggagcaccgccgcaagctccgcgaccagggctgcgtcgtccgcgagattgagcccgtgtacccgcccgacagccagacgcagttcgccatggcctactacgtcatcaactactccaagctccgcatctgggagttggtggagtacgagcgcatggtgtaccttgacgcggacatccaggtgtactccaacatcgaccacctgttcgacctggagaaaggcaagttccacgccgtcatggactgcttctgcgagaagacgtggagccacacgccgcagtacaagatcggctactgccagcagtgccctgagcgcgtggcgtggccggagcaggagcaggagcaggagcttggcccgccgccgccgctctacttcaacgccggcatgttcgtgcacgagcccagcctgcgcaccgcgaaagacctgctggacgcgctggtggtgacgccgccgacgccgttcgcggagcaggacttcctcaacctcttcttccgcgacgtctactcgcccatcccgccggtgtacaacctggtgctcgccatgctgtggaggcatcccgacaagcttaaggtggtgcggctcgacgaggtcaaggtggtgcactactgcgccgccgggtcaaagccgtggaggtacacggggaaggagcccaacatggaccgcgacgacatcaaggcgctggtggccaagtggtggcacatcttcgacgaccagaccctcgactacaacggcggcgaggcggcggcggaccaggcgagtctgccgctgcgccaggccctggctcaggccggcgccgtcaagtacttccccgcgccgtcggctgcctaggcgacgccggttgcatgcaggccggccgggacgacgacgtgccaagcagctgggcgaatcggtcggccggctggtggctccggtcctctactactggcgctcaacgaggcgcttaattattattatattaataataatatggatatgtgtggattaattagcggtctacaggttttggaattgtagacattggccagcagtacaatcgctcatatatatgtttcgttattttagttttgtatgtggtgaaatgaaaaccaaagaagaagaaaaagagttttgatttttttttttagcttgagtaattaggtacgcatgcagtgttgggatcttcctgctatgtacatctgcaaagacaaacaagctagcattttgaagctaataaatcttttagttttgtataag

SEQ ID NO: 55 - DNA, 2182 bp, Zea mays
cacgcacgaacggccccgagggtttagagcccaacttctctcttcacatcgccgcgaagccagctccccgatgcgatctggccgagggaagatggcgactccgccgccgccaatccgccccgccgccgcgctcctcctcctcgtcctcgctggcgtcctcgcctccgccgcgagcgccgatctcgtcatctccaaggcagatcggagggttgatctgacctcgcatatcgttcgcgtcctcgcttccctcaaggctgaaaatgttggaccagaccctgtctctcaagttttactgccttttcccaatattcaagccaagaacttggcagctattagagcattcggcagtgaagggaaagtgaagggtcaaagtactgttctgccaattgaagttgttcaaccttctggagctcccccggagctgacattcttttcagcattgttgcccaaacctttggaaaaaggaaagactctgtacttggatgttctgactgtgttcacacactctcttcaaccattcccagaagaaatcactcaagccgaagcacaacttgttgtctatcaggatagtgctcactatctgtcaccttaccctgttaaggctcagacacttgctatcagattgcctggtggaagggttgaatcatacacaaggcatccaaacgcaaaacttgtggattcagaactgaaatatggaccatttcatgaccttcccccgttctcctacttacctgtgattgtgcattttgagaacaacaatccttttgcagttgcaaaggaagttataagggagattgagatatctcactggggaaatgtacagattacggaacactacaacattgctcatggtggtgccagactcaagggtgaattttccaggattgattatcaatctagaccttacgtaaggggtgtttcatcttttagacatcttattgcaaaactgcctccaagggcacactctatttattaccgagatgagattggtaatatttccacatcacatttgtggagtgattctatgaagacccaactggaaatagaaccaaggtttccattgtttggtgggtggcaaacaaccttcactgttggttatggtttaccacttgaagactttgttttctattctgatggaaagagatttctcaatatcacatttggttctccattggaggaaattctcattgaaaagcttatcgtaaaggttgttctacctgaagggtcaaaggatatcgaagtttcagctccctttccaacacagcagcagcaagaggttaagtattcacaccttgacattgtcggaagaccagttgttgtcttggagaaacctgatgttattccagagcataatttgtatttccaggtttactacagattcaacaacatatccttgctcagagagccgttgatgctgattactggtttcttcctcctgtttgtggcctgtattgtttacatgcgtactgatatgtcaatatccaagagctctccttcctacttggccaagctgcaatgggatgaggtgcaagcaactgttcagaaaatccagggtatctttgagcaatgcttagcagttcatgataaactggaggcctcattgcgggatttgtctaggacaggagacattcagtcttgcaaggcagctcgtaaagctgctgacacgcagtttaaggagctatcgaaagatctgaagccactgttggcgactctacagtcatctccccagtcttatcagatatggccaaaggtagaggacttgatcgtaaaggagagagagatgcaggagaagctcatgacaaggcattccaccgttgtcgacagctttgagaagaagctgcgcgggcaagatgtagagaacaggattgctttgcagcagcagaaaattgctgccctgaggcaggaggttgaatctcttttagagtacattagtgagatttgagcaaatgagtgctgctgtggcgtgatacatctttagcgattagactgcctttgtttggtttagggtttaccccaatattgaaatctactactctgagattgtgtcggtaaccatctagtttcccagttgagagacctggaagttgcaatgaccttgtaacatgataatcagtgtaattctggagctgactaaatttttgcatttaatatcaatatcacaggaaccgtcatcttttggact

SEQ ID NO: 56 - DNA, 2304 bp, Sorghum bicolor
atacgctctctcgtgtcccgtgccgtcgccgagtgcgctctctgtgtctactctggtggcgacgactgggggtcgggggaccgccgccaccgccgtacgccgggtgtccaggtccccatcttcgggcctttcgttacttcgccggcgacgagcatccaccaggttgcaagattttccagcactgcttgctcacccatttctcaatttggaaaacctcaatttctggatctcagaaccaaatcacgaccgtaccactttattcagccccgactgattgcaatggctgcagctccggccaatggtgattcacagagtggtcctcagaggaactatcaagttgttgttgctgccactcgtgacatgggcattgggaaggatggggttttgccatggaagcttcttggtgatcttaaattcttcaaagagcttacactaactacatctgatcctgccaagaagaatgcagttataatgggaaggaaaacatgggagagcattcctgttaagtcaaggccattgcctggtcgtttgaatgtcatacttactcgatctggtagctttgattttgcaacagtagagaatgttgttatatgtggaagtatgaagtctgccttagaactgctagcatcaactccatactgcttatcaattgagagagtttttgttgtaggaggtgggcaggtactgagagaatatcttaatggacccgcatgtgaggctatccatctaactgacattcagtcgagcattgagtgtgacactttcatccctccagttgacttctcagtgttccagccatggtattcatctttcccagtggtagagagcaacattaggcattcttttgtgacttttgttcgtgttagaaagtcagtggcagaaactcatgagtcaaatggcaaggaatcaactgaggttgataccaagaatgacaaatttgaaatagagaatttctcttttctccccgagatggtatatgaccgccatgaggagtatcaatatctcaatcttgttgaagatattataaggtctggtgctcagaaaaatgacaggacaggaactggaacattgtcaaaatttggatgtcagatgcggttcaacttaaggaaaaattttcctctgctgacaacaaagagggtattttggcgtggtgttgtcgaagaactcctttggttcatcaatggctcaacaaatgcaaaggttttgcaagagaagggtattcacatctgggatggcaatgcttcaagagagtatcttgacagtgttggcttggcacacagggaggaaggtgatctaggtccagtttatggatttcaatggcgtcactttggtgctgaatacactgacatgcatgctgactatactggaaaaggttttgatcagctaatggatgtgattgacaagatcaagaataatcctgatgaccgccgaataattatgtctgcgtggaatccttcagatctcaagaagatggctcttcctccttgccacatgtttgcacaattttatgttgaaaatggggagctatcctgccagatgtatcaacgctctgcagacatggggcttggtgttccattcaacatcgcatcatattctcttctgacatacatgatcgctcaagtttgtgatctttctcctggagattttgtccatgttataggggatgctcatgtctatagaactcatgttcgagctctggaggagcaaattcagaagatgcctaaaccatttccaattttgaagataaatccttcaaaaaaggatatagattctttcatggcatcagatttcaagctggttggctatgatcctcaccagaagatagagatgaaaatggcagtgtaatggtgacttagctggagccccagcctttgaacttggtgggtgaaatcagtcagactgggtactacataaaaattaaccggacatcgcactagcttgtttttggtgatggtgctgaatgttccgtgggagacgtttctccccttattagttgcgattgcatactatggtcgcttaaatgaactctacaaaaccggctcccttttatctggagcgagttgattgcgagtgagatgatctgggcatcataccctgttgcaagggcctactggtgtgtttgcccccgtgaggctgtgacgtttgtgctactgccccttgagaaccatgtaactgaaattgctgttgtgtacctggtagagctccatactgtttagtatccggttgccttaatgcgtgccctgattatttcagtttccagtttggacgcaagataacgacttgattgtaggtttttaagaaaca

SEQ ID NO: 57 - DNA, 2840 bp, Brachypodium distachyon
tcggtcgggaaggtcggtcttccccgacgtggtctcctcccacccatacacccttcttctagctcctacgcccacacaaccgccgaacccaattccttcctcctcctcctcctggcgctgcggctgctctgctctctctcccacgcacacacatccccacgcatcgtcttctcctctcccccatgggggactcatcggtgccgggcgcgctggtgccgacggtgccgaagccggagccggcgcggtctggggacgggtccgccgccgcgcaagccgtggtggcgcggcagcaggcggaggaggcgggcgcggcctcgcggtcgccggaggtggaggaggaggaggagcaggcgctggcggacggcgaggcggcggcggcggcgggcgcgccagacggggacctgctgtgcccgatctgcatgggcgtcatcaaggacgccttcctcaccgcctgcggccacagcttctgctacatgtgcatcgtcacgcacctcggccacaagagcgactgcccttgctgcggcaactacctcaccaaagcgcagctctaccccaacttcctcctcgacaaggtcgtgaagaaaatgtcggcccgccaaattgcaaagacagcatctcccgttgatcaatttcgacatgttgtgcaacagggaaacgatatgacagttaaagagctagacagccttatgactttgattgctgagaagaagagacaaatggaacaacaagaatccgagacaaatatgcaaatattgctagtcttcttgcactgccttagaaagcaaaaactggaagagttgaatgagattcaaactgatctacagtacatcaaagatgatataagcagtgtggagagacataggttagatttgtatcgaacaaaagaaagatactccatgaagttgcgcatgcttttggatgaacctgccgcatcaaagatgtggtcctctcctacggacaaacctagcagtctctttgcctccaattctcgggcaccgcttagtgcatcatctcaagggggtttacagaataggaggcttgatttgagacatcaggcaaaccatcagggatttcaaaggagggaagcccttgctagctcagaccctcctaatccccccatgcaatctggcaatgttattgctcggaagaggcgagttcaagcacagtttaacgagcttcaagaatactatctgcaaagacggcgtaatggagcacagtcacgcaggcaggaggaaagagacaccgttatgatgaataaagaaggttatcatgcgggtcttgatgattttcagtcagttctaacgacattcactcgatacagtcgcttgcgggttattgcggaacttagacatggagacctgtttcactctccaaacattgtttcgagtattgaatttgatcgtgatgatgagctattcgctactgcaggagtctcgaagcgcattaaagtctttgaattttctacagttgttaatgagccatcagatgtccactgcccagtcgttgaaatggctaccagatctaaactcagctgtcttagctggaacaagtactcgaagaatgttatagcaagcagtgattatgagggtatagttactgtttgggacgttcaaactcgccagagtgtgatggagtatgaagagcatgagaaaagggcatggagtgttgatttttcacgtacagagccctcaatgctagtatctgggagtgatgattgcaaggtcaaagtgtggtgcacaaaacaggaagcaagcgctatcaacattgatatgaaagcaaatatttgctctgttaaatataatcctggatcgagctattatgtagcggtcggatctgctgatcacaatattcattattttgatttacggaatccaagtacacctctccatatttttggcgggcacaagaaagctgtctcttatgtgaagttcttgtctaataatgagcttgcatctgcatcaactgatagcacattgcggttatgggatgtcaaggaaaattgcccagtaaggaccttcagagggcacaaaaatgagaagaactttgttgggctgtctgtgagtaacgattatattgcttgcgggagtgaaacgaatgaggttttcgtttaccacaaggctatctcaaaacctgcttccagtcataggtttgtatcctccgatgtggatgatgctgatgatgaccctgggacttatttcattagcgctgtctgctggaagagtgatagccctaccatgttaactgctaacagtcaggggacgattaaagttcttgtgctcgctccttgacgtgatcaagggctttctgagatccatagctagcttgtgtatatcatatatatatccagtcgtttcattgttgtgccgttatatgtcccaaagtgggagtggaggcatattgatctctccattgtagggcgcggaattttggagacagtcagctgacatagagtttcgagggctcggaatgtgcatagtggtggttctgttgtacagggggtaaagcagtcgacttatcatttatatgcggtgagaaataagccttgaatgaaagccaggcttgaatgtttaggaactgtgggaagatacgcactgctgagcacaccggcaataaaacattggttcatcgcgcttcttatgtgagtaaccaaggtgttcggttaggcttaacttgtgggtttttatttggcttgaaagcaaaaaaaatcatcatttctttgcgacctttttatatgcttttggttttaaaggccaaagctgaaaacacataaatagttgcttcctgtcatgtcggctggctttcgtgacctgtgatcaagcgcatccgttgtatgtacccta

SEQ ID NO: 58 - DNA, 2105 bp, Zea mays
cacggctcgagctgggagacagtgagacacacaagacacaacgctctcggatctgccgcgcccccgctctcctctggctcgctcgcgttctcgcgtacaccactccagacagtgacacagggacacacgccggcgtggctgctcacgtgttctcagttctcaccctgcgctctcgccggccggggctataagtggtcagcgaatatctctgcggcaagcccacgcttcggagtggacgtcaggcgcgctcgccagccccccacaccaccaccaccaccacaaccccaccaagctcacgtttccgaattcaccaactcctgcacgccgcgtcgagatcgttcacgccttagcttcgggaactccaccaataagcccaccggctggagcaatggggagcacggggcgcgagccggaggtgacccgcgccaacttccccgacggcttcgtcttcggcgtcgccacctccgcgtaccagatcgagggagcgagaagagagggaggcaaaggagacaacatatgggatgtatttacagatgacaaagaacgtgtcttagacagaagcaatgcagaaattgcagttgaccactaccatcgatacaaggaagacattgagctcatggcaagtctaggttttagcgcatacagattttctatatcttgggcacgtatatttcctgatggcttgggggaaaaggtcaatgagcaaggagtcgccttctataatgacctcatcaactttatgatttcgaaaggtattgagccttacgcaacactgtatcattgggatcttccaaacaatcttcaaaaaactctggggggctggatttctgacaagattgtggagtactttgcattgtatgcagaagcttgctttgcaaatttcggagatagagtaaagcgttggataacaatcaatgaacctctccaaaccgcaatcaacggttatgggattggaatttttgcgcctggaggatgccaaggtgaaactgcaagatgttacttggccgcccatcaccaaatcttggctcatgctgctgctgttgatgtttatagaagaaaattcaaggctgcacaaagtggtgaagtaggcttggttgttgactgtgaatgggcagagccattttctgaaaaactcgaagaccaaattgctgcgcaacggaggattgactttcaacttggatggtacctagatccaatatattttggtgattacccagaaagcatgcgtcagcgactgggcagtgatcttccaaccttctcagagaaagataaaaaattcatcaagaacaaaattgattttattggactaaatcattatacttcgaggctcattgctcatcaccaaaatcctgatgatgtttatttctacaaagtgcaacaaatggagagagtagaaaaatggagtagtggtgaaagcattggtgaaagggctgcatctgaatggcttgtcatagttccttggggccttcacaaattgcttaactatatagtgaagaaatacaacaacccagtaatttatgttactgagaatggcatggatgatgaagacgatcagtccgcgacgattgaccaggtcctaaacgacacgaagagagtcggctacttcaaaggatacctcaattcggttgcacaggcgatcaaggacggggctgatgtccgtgggtacttcgcgtggtcattcctggacaacttcgagtgggctatgggctacaccaagaggttcggcatagtctacgtcgattacaaggacgggctctccaggcaccccaaggcatcggccctctggttctcgcgcctcctcaagggcgaggctgccgaaaacagctatagctagagctgccacagactgagggaacagtccgcggcaagtacagaaacattacacacatttctcctgttgttgtgtcttgttgttgtgtcttaaaggtgagtgcacctatgtatgtatgtatgtatgtatgtatgtatgtatgtatgtatgtatgtatatatgtattcatcctaataatctcaggatgtgctagtctgtcgttgatgcgacgctggctgagatgtgttctccaagaacaagaacaaccagaacctcagcaccaaataagctttga

SEQ ID NO: 59 - DNA, 836 bp, Zea mays
gtggcagaaaaggcctcaggctaggatctagagatgcgaccaaaatcaatgtatcttcagagccaggcccaggctgtcgcggtgtacagctgggctctcgctagcctggttagcacgaccaggttgcccaggtgcgggcaaccaatcagctgatatagggcatttacccttttgtgactatggcactagcggctatctataaccttttcatcattaacaaatcaggcggccttatatactacaaggactatggttcagcagggaggatggataccaatgacagtctaagattagcaagtctgtggcattcgatgcatgctatctcccagcaactctcccctacccctggctgtactggcattgatctcttacaagctcataactttgatctccattgctttcaatccctcacagggacaaaatttttcgttgtatgcgaaactggagctccaaacatggaaatgctgctgaaagtgatttatgagctgtacacggacttcgttttgaagaatccgttctatgagatggagatgccgatccggtgtgagctgtttgatcacaacctggctcagatgatccagaaggaccgtgttgcgcttctgggtcggtgaatcttgaaaactcatggtctcagcccttgaaaaccctacttttcccgttttcgacgcttggacttgctctgctggaaccctaaattctaccttgcggcactgctgtgctgtgcataaccgataacttgaatagtgtgttgctcgcttgtaatcttcttgcggtgtgatgaaatgtagagctttgcgggcataaatgccgctgcaaatagtaacaacatggaagca

SEQ ID NO: 60 - DNA, 2483 bp, Oryza sativa
tctctctctctctctctctctctcccatggcgaagaagggcgcgccgcgcaggcagccaccgccgccgccgcctcggcaactggccgcggggaagaaggggaaggcctccccgaaggcggcgaagagggcggcgcccaagaagcagaggctgctcgagtcgtcctccgacgactccgagctggagcagcagcaggggcagcttcaggaggtggagtccgggtcagacctcgacgtcccctctgattccggcgccgaggagctctccgactcggacgacgcctcctttgagggaggagacagcggcgacgacgaggaggaggaagacgatgaggatggcgacgacgaccccctcgctgacgacttcctcgccggcagtgacgacgaaagtgacggaggagacgactctggtgtggactcagatgagtctgatgacttagaggcgaagtcgcgagcgattgatgaagagaaagagaaggcagaagaagaggctgaggaggagctcaagctcaatattagatcagaatctgatgagttccgattgcccacaaaggaggagttggaggaagaggcacttcgaccaccaaacctgccgaatcttaaaaggaggatatcagaaattgtccgggtactctcaaactttagtaagctgaggcaaaaagatgtgccgcgaaaggattatgtcaatcagctgaagacagatataatgtcatactatggatacaatgattttctcgttgaagcatttattgagatgttcccagctgtggagcttgttgaactactggaatcttttgagaaaaaaccgcctgaatgcttacgaacaaatacattgaagacccggagaagggatcttgctgctgctcttataccaagaggatttaatctggatccgatagggaagtggtcaaaggtaggccttgttgtatacgactccaccatttcagctggtgccactgttgaatatatggctgggcattacatgaaacaaggtgcaagttctttcttacctgtgatggctcttgctcctcaggagaaagagcgaattgttgatatggcggctgccccaggtggcaagactacatatattggagctcttatgaagaatactggaataatttatgcaaatgagttcaatgagaaaaggctgcatggacttttgggcaacatacatcgcatgggtgttaccaataccatagtttgtaattatgatggtaaagagctacctaaagttcttgggatgaattcggttgacagagttcttttggatgcaccctgcacaggcacagggaccatttggaaggatccacaaattaaaacgtcgaagggcattgaggacatcagagactgtgcttttgtacaaaagcaattgctattagctgctattgatttggttgatgccaactccaaaactggaggttacattgtttactcaacatgttcattgatgattccagagaatgaagcggttgttgactatgcccttaaaaagagaaacgtaaagcttgtaccttgtggattagattttgggcgtccaggattcatccggttccgagagcatcgattcgatacttctttagataaaacaaggagattttatccccacgtaaacaacatggatggtttttttgttgcgaagcttaaaaaattgagcaatacgatcccagtggcatctgagtcatctaatgtgcctgaagaagcaattgagaaggctgatcctagcagtgacgatcctcaaaaacagcccattcagtcaaaaaaacataaagatgtgaagacgacgaatgaagagacaagcatccttgatggggtgactaaggacaaaaggcagacacatgagacactcaagaaccacaagaagggtgagaagaaacgcaatggccctgagagtactaaaataaagggagaccagaaagaaacacacaacgaacaagaagagcctacaagtgaaaaaaagcagcctgtgtctgctgaaataaaaaaatctgttcccaagagaatatcaggtaacaaaggaaagaagctggatacgggcaaaggagagaagaggaaaagaaactggatggtgaggcgagactgggaagcttataagaagtcgaggagtaaacaagtatgaaaggcacggatgaaggagctctagccgtagacaaattgcagttaaatttgaaaacccacatacggggaagatgttagaaggagcgagaatacacaattttggcgttggttcaagttcgaggcgaaggaaaatttttgttgtacttaagtctagtgaagtgatcgtctgtagttttaccctttcttttccgtcttggtttaatgtaccaatactaaggcacttctcggacatgagttatgggagtatgtgattgacttcgtcatgttgcctggtaagtactatgctggccgatggaacagtatgatgttctgcttgctaagggcgacgtgtggttgtgctcagggttaggggcggaaatcgtgctggctc

SEQ ID NO: 61 - DNA, 2191 bp, Sorghum bicolor
cacgcctcgcagcctctgctctctactccacacgcgcgcctctgtgtgtctcactgtctcccctgtcccgcgtggtgggcatccatgggatgagagcgccttcctcgccatggccgcctccctcctgccccccgcagccaccctcgtcaagaagtacccagctctcctccacccgtccggcgccaagccgcacgcccagaggctgatcttcaggtgcggcgccaccagtgcggacgatggctgggcgtccttagtggacgagctcaagaggtcgctgcagcaggcggacacgtccgacacggtgaccagcaacgcgggagcgggtgtcacaccgaacgacctcgtgaccgcgctgccactggaaccttccaccaccaccggaccggcggtgggagacgcgactagtgccgccgccggcgcggtgaacgagctcctgggcgtggacgcggccagcagcgacggtggcggcgcggccgccatccccgacgggctcctgagcgcgctgctgcacctggacgcgtcgtccaacccggtggcgcgcgcggcgggcggcgcgctgtctggcctggacgcgctcacgtcggggctgtcggacgcgcagcggtgggcgctgttcgggttcctggccgcgacgtggctgtacctgacggcgcggcccggggtgctgagcggcgccgtggacacgtacgtgctggcgccgctgcagctggcgctggacagcgtgctgggccggcggagcctcaagatgagcgacttcgtcgtcggcgagcgcatcggggagggatccttcggggtggtgtacgccggcgccgtggtgcccaaggacggcaccgtcgtggaggagcggtccggcagggccaggacgaccctccagaacgacgacaggtacaaggagaaggtcatactcaagaagatcaagatgctgacggtgggggcgaaggagtgtggggactatgaggagtggttcaactaccgcgtggccagggcggcgccggagtcgtgcgccgacttcctcgggagcttcgtcgccgacaagaacaaggcagagttcgtcaagggtggcaagtggctcgtctggaagtttgagggggacagaacgttggccaattatatgagtgaccgcgggttcccgtcgaacctggagccgctcatgttcggacgcgtgctgcagggtctgcgcacccaggagcgcgacgcgctggtggtgaagcaggtgatgcggcagctgatcacgtcgctgaagcgcatccacgcgacgggcatcgtgcaccgcgacatcaagccgtccaacctcgtcgtcacccgccgcggccaggtgaagctcatcgacttcggagccgccaccgacctccgcatcggcaagaactacgtgcccgaccgcgccctgctcgacccggactactgcccgcccgagctctacgtgctccccgaggagacgccggagcccccgccggagcccatcgccgccatcctctccccgatcctctggcagctgaacagcccggacctgttcgacatgtactcggcggggatagtgctgatgcagatggccataccgacgctgcggacacagtcggggctcaagaacttcaacgccgagctcaggtccgccggctacgacctcaacaggtggcggcagagcgcgcggcggagacccgacctgcagatcctggacctcgactctggtcgaggctgggacctcgccaccaagctcatctcggagaggggccccaacggcgggggccgcctgtctgccgcggccgcattgcggcacccttattttctcctgggtggcgaccaggccgcggcggtgctgtccaagttctcgctcagcaaatagcatccatccatggctcatgcctgggcagtgccgcagtggacacctacagtatataatatatatacacattggattactggaatcctcccaacaattcatcatcggtgatggtgtacattgcgcattgttgaatccttagcataccagtggggcagtggtcagcaatggcactgtcatttttcgctgtaaagccaatcgtgagaggcatcaagagggagtcatctggcaactgatgttacaacttgttgttctgtatgggacttgcttgaacaatgtggtgcagaattttcagacactagctaaccttacattattctagacagaaatcctacttcctttggtcagttcctc

SEQ ID NO: 62 - DNA, 2422 bp, Oryza sativa
gtatgcaattattcacgcccagtcgccgcctccaccgccgccgcctgctcgactcaccaccgcagggcggcctcctcctgccgcatgggtgactcgacggtggccggcgcgctggtgccatcggtgccgaagcaggagcaggcgccgtcgggggacgcgtccacggcggcgttggcggtggcgggggagggggaggaggatgcgggggcgcgcgcctccgcggggggcaacggggaggccgcggccgacagggacctcctctgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtcttgaagaaaatgtcagctcgccaaattgcgaagacagcatcaccgatagaccaatttcgatatgcactgcaacagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgagattcaaactgacctacagtacatcaaagaagatataagtgctgtggagagacataggttagaattatatcgaacaaaagaaaggtactcaatgaagctccgcatgcttttggatgaacctgctgcatcaaagatgtggccctcacctatggataaacctagtggtctctttcctcccaactctcggggaccacttagtacatcaaatccagggggtttacagaataagaagcttgacttgaaaggtcaaattagtcatcaaggatttcaaaggagagatgttctcacttgctcggatcctcctagtgcccctattcaatcaggcaacgttattgctcggaagaggcgagttcaagctcagtttaacgagcttcaagaatactatcttcaaagacggcgtaccggagcacaatcacgtaggctggaggaaagagacatagtaacaataaataaagaaggttatcatgcaggacttgaggatttccagtctgtgctaacaacattcacacgatatagtcgcttgcgtgtaattgcggagctaagacatggagatctgtttcactctgcaaatatcgtatcaagtatcgaatttgaccgtgatgatgagctatttgctactgctggagtctcaaagcgcatcaaagtcttcgagttttctacagttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccagagtgtgatggagtatgaagaacatgaaaagagagcatggagtgttgatttttctcgaacagaaccctcgatgctagtatctgggagtgatgattgcaaggtcaaagtgtggtgcacaaagcaagaagcaagtgccatcaatattgatatgaaggccaatatttgctctgtcaaatataatcctgggtcgagccactatgttgcagtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtaaggacattcagagggcacaagaatgaaaagaactttgttgggctgtctgtaaataacgagtacattgcctgcgggagtgaaacgaatgaggtttttgtttaccacaaggctatctcaaaacctgctgccaaccacagatttgtatcatctgatctcgatgatgcagatgatgatcctggctcttattttattagcgcagtctgctggaagagcgatagccctaccatgttaactgctaacagtcagggcaccattaaagttcttgtacttgctccttgatgaaatcagtggttttcatgagatccctagatagcttgtatatttgatgtatacagttgtttccttttcgtgccattataccccaaatgggagtggaggtattactgatctccaacatagggcgcaaagttttgaaggtaatcagctgacatagggtttcgagggctcgaaatgtgcatagtccagaattctcatgtataggtttaaagcagtcaagtaattgattatacatatgtaacgtgagaattgagaaatgaacatcaaataagcttgtttggtt

SEQ ID NO: 63 - DNA, 2694 bp, Hordeum vulgare
ggcgcttcgtgacgtgggctatttcctcgcgccgcttcctcccgcccgccgcggcataccacgacgcagctgaatctttcgcctccgcggcgccgtccctctcagcctcgcgttagcactagtccgttcctatgtacctctactacaacccaatctaatccaatccttccgcgtttctgcttgcttggaactcgggatctcgtcgggagaggcggcggcggatttgggatttgggggccatggcgtggcggcgcgtcctctcccaggctgcaaggaaccaatcagcatatgcaatctataatgagttggcagcctcctctcctctgaggttacttagaagtgacatcagtgcaggtggtgcactcaggaacttacatgagaggtatcattcgagctattttggtggcctttcacgcagcatgcgagacctgggctcccaaagtgaagcttctatgctaaaagagatatacagaagtgacccagagcgtgtgataaaaatatttgaaagccagcctttgttgcgttcgaatccttcagcactatctgaatatgtaaaagctcttgtaaaggttgataggttggatgatagcaccttgctaaaaacattgcaaagaggtcttgctgcttcagaaagggcagaaggaagccttggtagcgtgccggcattaaagagtgctggtcaagtgacaaaagatggaattattggcactgcgaatgcgcctattcacatggttacagcagaaacaggtcaatttaaggatcagctttggcgcaccttccgaagcattgcactgactttccttttaatttcgggcatcggggctctcattgaggatagaggaatcagcaaaggccttggtctaaacgaagaggttcaaccaagcatggaatctagtacgaaatttagtgatgtaaaaggtgttgatgaagccaaagctgagctcgaggaaatagttcactaccttcgagatccaaagcgttttacacgtcttgggggaaaactgccaaaaggtgttctgcttgttggccctcctggcactggcaagaccatgttagcgagggctattgctggggaagccagcgtcccttttttctcgtgcagtggtagtgagtttgaggagatgtttgtaggcgtgggagctagaagagtgagggatctttttgctgcagcaaaaaaacgatcgccttgtatcatatttattgatgaaatcgacgcaattggtgggagtagaaatccaaaggatcagcagtatatgaagatgaccttgaatcagttgcttgttgagctggatggctttaagcagaatgaggggataatcgtcatcgctgcaactaacttccctgagtcattagataaagcactagtcagacctgggcgctttgatcgtcatattgttgttcccaatccagatgttgagggcagacgtcaaatcttagaggcccacatgtcaaaggttttaaagggtgatgatgtggatttgatgatcatcgccaggggaacaccgggattttcaggtgccgaccttgctaacttggtgaatgtggctgctcttagggctgccatggatggtgcaaaatccgttagcatgaatgatcttgagtatgccaaggaccggatcatgatgggtagtgagcgcaagtcagcagttatctctgatgagtgcaggaaactgacagcataccatgaaggagggcatgcccttgttgccatgcacactgatggtgcgcaccctgtccacaaagctaccatcgtgcccagggggatggcccttgggatggtggctcaactccctgacaaagacgagactagtgtgtcaaggaaacagatgctagcaagattggatgtgtgcatgggaggacgggtggcagaggagcttatatttggggatagcgaggtgacatctggtgcttcatccgactttgagcaagcaactttgatggcaagggcaatggttacccagtatggtatgagcaagcaggtgggtcttgtttcgtacaactatgaagatgacggaaagactatgagctcagaaacgaggcttctaattgaggaggaggtgaagaatttcttggagagagcatacaacaatgcaaaggctatcctcaccaaacacaacaaggaactccatgctctagccaatgcacttcttgagcatgagaccatgagcggaacccaaataaagaacttgttggcccaagtagataacaaacagccgcagcagggtcatgctgttgaagccccacagaaggcgccagcttcacccccatctccagcggcagcggcggcagcggctgccgccgcggcagcacaacaagcggcagcgcaagccaagggagttgctggtatcgggtcttagcatccacatgtttgcattgtgtatattaattcaccaaattagcaggttgttccgtcaaactgtcaactgatgagcatcccccaggaagaatatgctacactgctgcatcaccacgaggacacatggatgttgcttggggtgtgaatagagaaagaaacacatggaagaaatgcacacatagtagcaggcagatgtaagctagtgttcgagtgatttttctacttgtgctgttgataacttcacatctcaataattgttatcgttaaaatctgccttgtatttgtacgatacacgtttggtcatgaaagttaccaataatattttgctcatcagccgc

SEQ ID NO: 64 - DNA, 1086 bp, Hordeum vulgare
tctggatccttctggacgcgccacgcactgtccccggcaacatctcgaaccttcgcttcctcctccttatacccgctcccgacctcgctcccgcactccgcactgcagaacccatcactgctcaccgagctctccaagtcgacacgcaccgccccacccacacgcagcgaagaaccagtcgaggaggaggaaggagaagccatggccgagctgctgttcgcccctgccatggccggcctcgtccacctgccggaggtgctcgaccgcctcgccgccgcggacgccgaccaccgcgaccacgcccaccaccacgccgcccacgggcacgggcacgctcacccccgcgcgcacatcggggccggcggcggcgcgcccgtggacatcgtggagacccccggcgagtactccttcctgctcgacgtccccggcctctccaagtccgacatccaggtgactctggaggaggacaacgtgctggtgatgaagagcgccagcagcagcaacggcggcggcgccaacgggaagcggaagcgggaggaggaggaggcggactgccgctacatccggctggagcgccgcgcgtcgccgcggtcgttcgtgcgcaagttccggctgccggaggacgcggacgcgggcgccgtggccgcgcgctgcgagaacggcgtgctcaccgtcaccgtcaagaagcagccgccgcccgagaagaagaccaagtccgtccaggtcgccatcgcctgatctgtacctcagtcgcgccagctttcggtacctcatcggcgtttgtcatcagtgatcagtgtagcagtagtcggtagactagtgtggcgagtcaggtagatttgggtggtgttctgttctcttgtggtcatgtcatgctctgttcgtgatctggccggagattaggtgtgctggttgtggcggacatcttttgtgaatcttgctgttaatggaactatggagcacgaattgtttgttgtcatgtctctgcatgtatcttcccggcttgatcgaaagcagccgcgtgcctggaccctgtccagtatatattcagaatcgggtgctctgctcgagcatctccaactcaac

SEQ ID NO: 65 - DNA, 1633 bp, Hordeum vulgare
gacaagtgtggcccacagaacagtcgtgtgcggagagctgagaggtcaggctcaggcgagctcacaccactcacctccgactccggccatggcgaccatctccgcagctctctctgtctccatcctcccgcccctggcccggcgcgccgtctccaccgccacctcctccccgccgcgcttcaagagagccgcgcggttccggtgctgcgccgagcctccttccccggagcagaaggagacctccgcgcctccgccccctcctccggcgccgccttcgtccctgtggggcgtctccacgagcgcctggaccgcgggcgtcgcggggctggggctcctggagaccggctacctcagctacctcaagctcacgggctccgaggccttctgccccgtcgccgggggaggctgcggcgacgtgctcgacagcgactactccgtcgtattcgggatccctcttccattagttggtatggtgacatatggtatggtgaccgcactttctctgcaagaaaatggagatgagttgctccctgggctcgatgacttggatatccgcctgaccttgcttctgcttgctacttcattggcgactgcgagtgcttattttctcttcatcctgaacaccaaatttgtcgggacgtcttgcttatactgcctatcgtcagcatttatctccttcacattatttttcatcagactgaaggaattgttgcaggacattggcttggcacgtatccagaagttcgttggtcttcagttagctgtagctgtcattgttgctcttgctttaacaaactcatatagttcggctactactcaattaaagggtacaggcgatttcgtattagaaccatacaaaacagaggtaacatcagaatcaaccccttttgctatttcactggcaagacatctacattccataggtgctaagatgtatggagcattctggtgtactcactgcaatgaccaaaaacaattgtttggccgtgaagccatggaaattctggattacgtggaatgcttccctaatggagccggtaaggggaagaaaatggccgaggaatgtgtaaccactggtctggaaggttttccaacatgggtcatcaacgggaagctcttgagcggcgaccaggaactctcagtcctcgcagaagaatccggttttgtctccgagagcccagagcaatcctgaggccatggagcttgacgagcagaagcaccccgccgaatcgaggagcagaaatcgagagctctctagaggcaagaacctgaagcctgtggcagttaacagcaacaccacaaaactcccaaccgagcttcagatgaggtgcattccatggtgcataattagagtatactactaaatacaaccactaaccactgtaataccatgtaaaaaaaacctaccatcctgccgtagaaaggcggggaaggagagcatcgaacccccggggcgaatgtactacgacctttttgtagagcctgtagtttgtgctatgaaacttgtagtcctgggaaaccacacagtttttgataattgagccaatggtactttcctggtaaaactgaatttctgcctgatttgtacagaaagtcagaaacacaaagaaatgatgtaattctcgcagcaaca

SEQ ID NO: 66 - DNA, 1506 bp, Gossypium hirsutum
aatgagtaccgagtcttgctttctctcctaagctctagtcactccccaaatctctccctcccttccctgtaaattcacagttatgccatcctctcccaagttcttccacgcgcgcacttcgccgccggcaacacctcacaccagatctactctcctcatcttcgcctccctcctcaccttcgccattgtctctttcctctttgccctctcttctttcctttcctccggtggatccggttaccgttgccggaactccgaccctagatccgtccgtgtcatttgggacaaaactggtcatggcaacaacggtctttccgctgctggtgatgatgatgggactaagaggcataaaataatgggcttcgttgggatccaaaccgggtttggctccactggtcggagacagtctttgagaaagacgtggatgccttctgatcgtcaaggccttcaacgattggaagaagcaactggattagcttttaggtttgtaattggtagaacaaatgataaatcaaagatggcagagctgaaaaaagaagtagcagaatatgatgatttccttttgttagatattgaggaggagtacagtaagctcccgtacaaaacgttagcattttttaaagccgcgtatgcactctttgattcagagttttacgtcaaagctgatgatgatatatatttgaggccagatcggctatcacttttactagtaaaagaacgttctcactctcagacttaccttggttgcatgaaaaagggtccggtattcaccgatcctaagctaaaatggtatgagccattatcctttctcctaggcaaggagtactttcttcacgcctacggtccaatatatgctctttcagctgatgttgttgcaagtttggttgctctaagaaacgacagttttcggatgttcagtaatgaggatgtgaccattggtgcatggatgcttgcaatgaatgtcaaccatgaggataatcgagcattatgtgagccagagtgtacgcaatcatctgttgctgtctgggatatccccaaatgttcagggctatgcaatccggagaaaaaaatgttggaacttcatcagatagatgcctgctctaaaagtccaactttgccatcggacgatgattagcttaattggcaaaacacagattttattaacatggaaaggtgtcagaattgtttgttctggtaagttgatcttattgccctcagacatatctcaattaccccgttcgatcatcgcaagccatttttgtcttccgccatcgttttagtctgtaatatatcaagcttttttttcactgacgatgcaagttaccaagagatttttacaataccattcttttgccgttacatttgatcaaaatgagggcttacttggttctactgtctatattgtaatatgtcctatgctacaaattagaatttgtgagagtgaaattaccccttttgatataaaaaaaattggtgtaatgatatatttagccgttaatgtttact

SEQ ID NO: 67 - DNA, 1960 bp, Setaria italica
cccgccgcttctctctctctctctctctctctctctctctctctctctctctctctaccattgtcgaggaagagagcgcaggagcgccgggttcagcgccggctatctgcgatgatggacctgcgcgtcgccgccgccgcgcccgctgggaccggcgtgcgcgtgctcggcgggagcgtcgcgcgcgtgccgccgcggccgtgggcgctccgcggcaagaggcgcctctccgtgcggatgtccgtcgcgaccaccgaggccgccaccgccgccactgccgtgggcgcctccgaggaccaggtgctggagtcgaggaacgccaagacggtggtggcggtcatcctcggcggcggcgccgggaccaggctcttcccgctcaccaagcgcagggctaagccggcggtgccgattggcggctcgtacaggctgatcgacgtgccgatgagcaactgcataaacagcgggatcaacaaggtgtatatcctcacgcagttcaactcgatgtccctcaaccgccacctctccaaggcctacgacttcagcaatggcgtggcgtttggaaacggattcgtcgaggttctagcagcaacacagaggcctgggtcggagggaaagaggtggtttcagggtaccgctgatgcagttcggcagttcgactggctttttgatgatgccaaagctaaagacattgaagatgttttgattctttctggtgatcacctctaccgtatggactacatggactttgttcagagtcatcggcaaagaggtgcaggcatcagcatctgctgtttgccaattgatggcagccgggcatctgactttggtctaatgaagatagatgacactggaagagttatttcattcagtgagaaaccaaaaggagatgaattaaatgcaatgcaagttgataccacggtgctaggcttatcaaaggaggaagcagaacagaaaccctacatagcgtcaatgggggtctatatttttaagaaagacatactactaaaccttttaagatggcgtttccccactgcgaatgattttggttctgaaataattcctgcttcagcaaaagaaatcaacgtaaaggcatatcttttcaatgattactgggaagatattggaaccatcaagtccttctttgaagcaaaccttgcccttactgagcagcccccaaagtttagcttctacgatgctgacaaaccaatgtacacatcacggagaaatctaccaccatctatggtcaacaatagtaagatcactgattcaatcatttcccatggatgtttcttggataactgcaagatagaacacagtgtggttggagtccgttctcggataggccgcaacgtgcacctcaaggatacagtaatgctcggtgctgattactacgaaactgatgcggaaagaggagaacagcttgctgaaggaaaggttcccattgggattggggacaatacgacgattcaaaagtgtatcatagacaagaatgcgaggatagggaagaacgtgacgatctccaactctgagggtgtagaggaagctgatagaacatccgaaggcttctacatccgatctggcatcactatcgtactgaagaactcaataatcgctgacggattggtcatatgagctgaaaaaaagctcacgagacaggcatttgcagcataaataatcataggagtcctttgtagttttacaataagatgtgatgtgcagcattcaagagcttctgcctgtctatacaaagatcatttttgtttgcaaatctgccatgtctcaccatgttgcacatgactaaaatacttgagaccatgaacatattctgcgtttcagcatttcagttttactggttcttggacaatgtacacaaaaagcttttaccacgtttaagttgacaagatggtacctatgtttttttccagatccgtcgtgtaaccaggttacgagttgcttgtgc

SEQ ID NO: 68 - DNA, 1107 bp, Zea mays
ctcctccaaaccggccaagccaccaaccagcgccccccaccgccgcctttttatttcatccacgctgctcgtgctcgctgcctgcttctcgcgcgatcgtctcggcctctcgggactctagagtggcggccggctctccgcctgttcttgtcgtcgctgctcctttcccaggatgtcggaacgttctgagagcgcaactgaaaagattatgagcagcatcatggataccattgctgacaaccttcctaagcagaagtctgggaaatttgatccaggttcagtctctgacaaagtgaagaacaagctgtttggtcgtcagaagaccttgcatggagttctgggtggtggaaaacctgctgatgtgctgttatggaggaacaaaaagatatcatcgagtgttctggctcttgcaacagctatttgggttttctttgagtggctcgactaccactttctgacaattgtttcatttgcccttgttcttggaatggttgtccagtttgtttggtccaacttctcaaacatgctaagcagcggatcccgttctcaggtgccccgagttgaattgcctgatgagttatttgtgaacattgccgttgcaatcggtgcccaagtaaacaagttcctgtgcttccttcaggatgtttcttgtgaaagaaacttgaagcattttgtagtggcgatcgcaggactgtgggctgctgcggtgattggaagttggtgcaatttcctgactgtcatatatgtcgggtttgtttgtgttcacacgcttccggtgctctatgagaagtacgaagaccaagtggacgatttcctctacagccttcttggtctgctgcgagatcaatatcagaagctcgaccaaggcgtcttgagcaagattcccaaggggaacatgaaggctaagaagaacgagtagtttagcagatggtttctcgtgaatgagatcaatatcgttttgacttgtgtcgattattaatttattacctaaggcgtgtgtgccattctgaacctggctgctagttcatcgcccaccggggttttaaactactaagctgcaatgcacaagtaatgaagtgtgctagttcattgcccacaggtgtacta

SEQ ID NO: 69 - DNA, 2099 bp, Zea mays
tagatttacagaaatttacggaggggctagatgaactttcctcttcaacggcccccttgtcttctccatttgttcatttcgcgtggcttcccttgccccctattaaaccaccgagctgggcgcctccccgtggcgctcgcggccgcattagcgcggagatcgagagacaagagagggaaggcggcggcttgccggcttaagccttctctccctccgtcgtcgcctcctccttacgtccgcttcttcctcctgaatggagacgtcagcgccgcccaatgcccccgctccgccggcgcagccacggaggcggttgccggacttccagcagtcagtgcggctcaagtatgtgaagctggggtaccactacctcatatcccacgggatgtacctgctgctgtcgccgctgatggcgctcgtcgccgtgcagctctccaccgtctccccgcatgacctcgccgacctgtgggagcagctccgcttcaacctcctctccgtcgtcgcctgctccacgctgctcgtcttcctctccaccgtttacttcctcacccgcccgcgccccgtgtacctgctcgacttcgcctgctacaagccggagtcggagcgcaagtgcacgcgcgagaccttcatgcactgctccaagctcaccggatccttcacggacgagaacctcgagttccagcgcaagatcctcgagcgctccggcctcggcgaggacacgtaccttccccccgccgtgctccgggtgccccctaacccgtgcatggacgaggcgcgtaaggaggcgcgcgccgtcatgttcggcgccatcgaccagctgctcgagaagaccggtgtcaggcccaaggacattggtgtcctagtggtcaactgcagcctgttcaacccgacgccgtcgctgtcagccatggtggtgaaccattacaagctgagggggaatattgtgagctacaacctcggcgggatgggctgcagcgccgggcttctgtccatcgacctcgccaaggatctgctgcaggtgcaccccaactcttacgccctggtgatcagcatggagaacatcacactgaattggtactttgggaacaaccggtccatgcttgtgtcgaattgcctgttccggatgggtggcgcggccatcctgctctcgaacaggcggtctgacaggcggaggtccaagtatgagctggtgcacacggtgcgcacgcacaagggcgccaacgacaagtgcttcggctgcgtgacacaggaggaagatgagattggcaagattggcgtgtcactgtccaaggacctcatggcagtggccggagacgcacttaagaccaacatcaccacgctggggccgttggtgctcccattatcagagcaacttctcttcatgggcacattgattgccaagaaggtgctcaagatgaaaatcaagccatacatccctgacttcaagctggctttcgagcacttctgcatccacgcaggcggccgcgctgtgctggatgagctggagaagaacctggagctcactgactggcacatggagccatcgaggatgaccctgtacaggtttggcaacacatcaagcagctcactctggtacgagctggcgtacactgaggcaaagggtaggatcaggaagcgcgacaggatctggcagatcgcatttggttctggattcaagtgcaacagcgccgtctggaaggcactccggacggtgaacccggccaaggagaagagcccctggatggatgagattgacaacttcccggtggatgttccaaagatttcaaaggttggtggcgcttgaagaaccattcttcttattattaggtggcaagtggagttgggtgattgtcaggggctgggcagagatttattccatcgtttccaccgttggttcttgtattcagttgtagcatggcatctgtgaaggaacttgagtagatgattcggttaggtagaaagggtgtgttcttcggctcgctagggttgtctgaatgcctgatatgtcctatttattcagattggagagagcaatcgatttgcattctttgctgcgtgattgagatgttcccattgcaggccaacttaaacttgaaattccc

SEQ ID NO: 70 - DNA, 1228 bp, Zea mays
accgcactggcctcatttcgggcaatacacacaggttgtctctttatggaatggagtccgttgtttgcactgcattaccaagtgataataacggatctcattcagcctctctatagcataggaccaagatcatagtgccgtccctgccggcagagagcaagatggtctcacactcactctcagcatggctcatgtcctcggcgccgccgccggcgtggttcgccgccctggtcgccgtgggcatgtacacggcgctgcggtccgccgccaccttcctggcgtggctccaccgcgcgttcctgcggccaggccgggacctggcggggcggtacgggacgtgggcggtggtgaccggggccacggacggcatcgggcgcgcggtggcgctggagctggcgcgcgcggggctccacctcgtgctggtggggcggagccccgacaagctggcgcgggtggcgaaggagctcgcggccgccgcgccggcgtgcaaggtgcggagcgtggcgttcgacctcgccgtgaccggggacgccgcgcggcgcggggtggcgcgggtggcggccgccgtggagggccgcgacgtgggcgtgctcgtcaacaacgccggcgcgacgtacccgtgcgccgcctacttccacgaggtggagggccccgtgtgggaggccgtgctgcgggtcaacgtcgaggccgccacgcggatcacgcgcgccctgctgccggcgatggcggccaggggcaggggcgccgtcgtcaacgtgggctccggctccagcgtcgtcgtcccggccttcccgctctacgccgtctacgcggccagcaaagcgtacgtcgaccagttttctcgaagcctgagtgtggaatacaaacaatacggcgtagacgtgcagtgccagatacccctgtacgtcgctaccaagatgtcgcccgtgaagggcgcgtctccgttcataccgtcgcccgaggagtacgccagggccgcccttcgctgcgttggctacgaggcgaggtgcgtcccgtactggcgccactcggtccagtggttcttggcgtccctagcgccggacgctgctctcaaccactggcgcctccaaactggcctccagaagaggaacgagacgaaggctctgctcgggggaaaagactgcagttagattaataatagtagtaataattgttgtatagattggattattatagccttccagacagtactcgcgatcgtgcactt

SEQ ID NO: 71 - DNA, 3098 bp, Zea mays
cccacctcctataaaccctagccgcctcattttcattcctcctctccctcgccggagttgagtttcatttgaataggcgggtgggaaagcatcctaaaccaccctccgctatccccaaccgccccgaaccatagcctcccctccgtgtcgccgtccggatctcgtgggttcgcgtgcagcggggatccgtccaggcttggattgatttcttatctgcgcggatacagccatggatatcactcaggttctgatagctgctcaatctccagatgctaaccttcggaccgtggcagaaggcaacctcacacagttccaggagcagaattttcctaactttctcctctccttatcaatagagctctcgaacgatgaaaaacctccagagtctagaaggcttgctggtattatccttaagaattctttggatgcaaaggattctgcgaaaaaggagctactgactcagcaatgggtaagtgtggatccatctatcaaattgaaaatcaaggagttgttgctggtgacactaggatcttctgtgcatgatgcaagacatacctcttcacaagtcattgccaaggttgcatcaattgagatagcacgtcgagaatggcaagatctcgttgccaaattactggggaacatgacttctgcaggtgcacctgctcctttgaaacaagcaacactagaggcattggggtatgtgtgtgaggagatttctccacaggacttggagcaggaccaagtgaatgctgttctgactgctgttgtccagggaatgaaccagacagagctcagccctgaagttcgtcttgctgcagttaaagccctatataatgctcttgactttgcggagagtaactttgcaaatgaaatggagaggaattatataatgaaggtggtttgtgatactgctgtgtctaaagaagtggagatcagacaggctgcatttgaatgccttgttgcaatagcatccacctattattcacacttagagccttttatggaaaccatattctacctgacagctaatgcagttaaaggtgatgaggaaccggttgcacttcaagctgttgagttctggagcgctatctgtgacgaagagattgcactccaagatgaatatgagggatctgaggatggtaactctgctatacacttccgctttattgaaaaggccctccctttacttgttccgttgctgctagaaactttgttgaagcaagaggaagatcaagatcaagatgataatgcttggaatatttctatgagtggtggaacatgccttggactcatttctagaactgttggtgatgcagttgtccctcttgtgatgccatttgtcgagaccaacatcacaaagcctgattggcattgtcgtgaggcagctacctttgcatttggttctatccttgaaggcccctctgttgggaaacttgctccacttgtccaggctggtcttgatttcttgctcaacacgatgaatgatgcaaatagccaggtaaaagatactactgcttggactcttgggagagtatttgagctcttgcattctccagctggtataaactcaatcataaatggttcaaaccttccccgtatcatgtctgtattgcttgagagtactaaagatgctccaaatgtagccgagaaagtctgtggagctatttattttctcgcccaaggttatgaagatgcagagtcaacgtcttctgtcctcacaccttatctatctaatacgattgctgctcttctttctgccgcagaccgtgctgagaccacccatttcaggcttcgtgcttctgcttatgaagcactgaatgagatcgtgagggtcagcaacatacctgaaacttcaggcatcatagcacaattattgcaggagatcatgagaagattaaaccttacatttgatctccatatactttcttctggtgataaggagaaacaaagcgatctgcaggctttgctatgtggtgttctacaggtcatcatccagaaactgagcagcacagatgcaaagtctataatttctcagaccactgatcagctgatggtgctttttctgcgtgtctttgcctgccacaattctactgttcatgaagaagcaatgcttgcaattggtgctcttgcatatgctactggtccagattttgtgaaatacatgcctaacttctttacatacctggaggctggtttgcagaattatgaagagtaccaagtgtgttccatctctgttggagtggttggtgatatttgtcgtgccttagaagataaaagtttgcctttctgtgatcgcattatgacggttcttcttaaggacctatcaagctctatgctcaatcgatctgtgaagcctctgattttctcgtgctttggagacattgctcttgctattggtgagaattttgagaaatacctaccttatgccgtgccgatgcttcaaggagctgcaggactccttggtacacttgacctgagtgatgatgatatggttgattatggcaaccagctcagacgtggcatttttgaggcatactctggtatactccagggcatcaagggcccaaaagctcagctgatgatcccatatgcaacccatctactacagttcactgaagctgtctccaaagataggagcagggatgacagtgtgacaaaggctgcagttgctgtccttggggatctcgcggacacgcttggccaaagctcaaaggatctgttcaagacccacctattccatgttgagttcttgagggaatgtcaagctcaagagttggatgatgaagttcgggagactgcacaatgggcccaggggatgataaaccaggcggtggtctcttaatgcgggatgattttggtttgttagttacgggtggtttcttctgtggtggtgccaagttcatttgccacagatgaacgaaaggataccaatatatatgtagcgtcagtcttaggatcctggttggtctgtcaagccggtgtgggtcacattggaccgggtggtttctgtccatgaatgtcttgaacagcaaaaattggttcatttatcatgatattttttaatgctggggatgtgtttgcctccaaatttccattta

SEQ ID NO: 72 - DNA, 1274 bp, Zea mays
tccacccaacgacgtcaccggcgcacaggcacagccacccggacccggcaccgctcgtcccactcccggcctcctcctctcctccttaaatacgcgccgcgccgagctctagtatagccaaccgtttccaccatcgaccatccatcacctcacctccaagctccaaggaatctaccctcgctcttctcacaaagcgctgcagcggacagcagagcagcacgagagagccgagcgcgaggtgcaggaccgcaaaacagaggcgaagcgaaggacctaacctacgtagcaccgctcagctccgctccgcggcgatgggtcaccgccgccacgaggggtcgtgccgctgcgagctctgcggcgcgcccgcggccgtgcactgcgcggcggacgaggctttcctctgcgccgcctgcgacgccaaggtgcacggcgccaacttcctcgcgtcgcggcaccgccgcacgcgcctccgcctcgcggccgcgggacccccgccgccggacgacgaggccgggtacgggtccgccgcgagctcctgcgtgtccacggccgactcggcgccgcggccgaggcgtggggcccgcgcgccggccgggagcgtgcgccccgaggccgtgctcgaggcctgggccaagcggatggggctcggggcgggggcgcgccggcgcgtcccgccgcgcgtcgccgtggccgccgctctctggtgggaggcggcggggcggggcggggtcgggggccacgcccaggcgctgcggcggctggaggcgtgcgcgcacgtgccggcgaggctcgtgctggccgtcgccgcgtccctcgcgcgcgcgcgcgcgctcttgcggagggccgccacggacgccgtggagggctgggacgagtgcgcgtgggcggggcccaagtccagcccgtcacgctcttgatcctctccctcttcctttgtcgtgctgctgctactgctcgctgaagaaacaacacgaggagcatatggacatggcggccggctggagagaggaagagggacatgctttgcgatttgtggaccttgttcgtctcatttattagtttgcccaaggtacaagaaaacttgtggttaggaataggggagagagcatgcataaagtggggtcttaatgtaggtcagtgtttttcattagagacttgtgagctaactgtggctctccaaccacggcggtacgtgcaagtgcaatggttcccagcagtgtatattttcagcagctctgtaattcaagtttcatttcttctctcactcagctcct

SEQ ID NO: 73 - DNA, 2564 bp, Oryza sativa
agtttcctcctcattattcctcctcttcccccctcgccgcttacaacatccatccccaaacccgcattcaaaacaagcaaccctcctcccgaatcgaacaaggaaacagatatcgcctctaaaacccccatcgtctcgtctcgtctcgttcccctctccatcttccgcggctttccgcgcgatccaccgatccggtttccccgcgccgtgcccggagtcggcgctccattcccgcgccgggttttggggtggtgtgttgatgcggcgggattcgagccctggcctgtgagttgggcgtcggctcggcggctgcggggtcggcgcgggcgcggacgcggcggatgtctgctatgaggcggcggccggtgctgccgactcaccaggacgacatggagaaggtgggcgggaagccgccgcagtcgcgcctctgcttcctcgccacgctctgcgccatgttctgggtcctcatcttctacttccacttcttcgtcatcgccaacgagcctggctccgcgggggcggacaccgccgccggcgccgcggcgagcattgcccgcgcagaacttccgctccccgaacccgagcgcgtctccgatcccgcggttcccctccctccgcctgccctcgtctcggagccgccacctaccaccgctactgtcgccaaagtggaagatgaggagaagcccacggccgtcgcccaccaggaggcggcgcccagggattacgcgttccagcgagcgctcaagaccgcggagaacaagagcgacccgtgcggcggccggtacatctacgtgcacgagctgccgccgcggttcaacgacgacatgctccgggagtgcgagaggctcagcctctggaccaatatgtgcaagttcatgagcaacgaagggcttggtccgccgttgggcaacgaggaaggggtgttctccaacaccggctggtacgcgacgaaccagtttatggtggatgtcatcttcaggaaccggatgaagcagtacgagtgcctgaccaaggactcgtccatcgctgccgcggtgtttgtgccgttctacgccgggtttgatgtggcgaggtatctttgggggcacaacatttcgacgagggatgccgcgtcgctggatttgatagattggctgaggaagaggcctgaatggaatgtgatgggcgggcgtgaccatttcttagttggcggcaggattgcgtgggatttcaggcgcttgacggacgaagagtcggattggggcaacaagctgcttttcatgccggctgcgaagaatatgtcgatgttggtggtggagtcaagcccatggaatgccaatgattttgcgataccatatcctacttacttccaccctgccaaggatgctgatgttttgctttggcaggatagaatgaggagcctggaacgaccatggttgttctcgtttgctggggctcctcgtcctgatgatcccaagtctatcagaagtcagcttattgatcaatgcaggacatcaagtgtctgtaaattgctggagtgtgatcttggggagagcaagtgccattcccctagcgcaatcatgaatatgttccagaactctttgttctgcttgcagccccaaggtgattcgtatacgagaagatctgccttcgactcgatgctggctggttgcattcctgttttctttcatcctggttcagcgtatgtccaatatacgtggcatcttccgaagaactatacacggtactctgtcttcatccctgaagatggcgtccgtaagggaaatgtcagcattgaggacaggcttaaaagtatccatccagatatggtcaagaagatgagggaagaggtcattagtctcatcccaagggtgatatatgctgatccaaggtcaaagctggagaccctgaaggatgcattcgatgtttctgtagaggcaataattaacaaggtgacacagttgagaagagatatcatcgaagatcatgaagataaagattttgttgaagagaatagctggaagtatgatctgttggaagaagggcagaggacaattgggcctcatgaatgggacccgttcttctctaagcccaaggacaagggtggagattctactaatccatctactaatgctgccaagaactcctggaaaaacgaacaaagaggtcagaactaaaatacaggtagttagatatgtgatcgaggaaaggaactagatatcctctctagagaagctccttgcaaataccttgcccatatgtcaaagatcctccaacgcagtagctctgatgatcatgtatgttcttgatgatctagcccctacaggtgtaagtggtggtagaaaagatgcttggggaaaaaaatgcacggccttcgagttgcccttataaataccatttcacactctatttttgttttgctttgctcaataatcctttgtaagtccttacgggatttataggtatatcaattttgctgttgtttctgttttgtttgctttgatctgtatgtgtatggtttagaatttgtgtatactacctttttatactcacaattagtaagcaatcaaagagatttttgtaga

SEQ ID NO: 74 - DNA, 1975 bp, Oryza sativa
actcgcacgcacagtctctcccaccaacaaacacgtacgactttgaacgcaaagtcttggcgccactcgatcgatcactctctgctcatcaggtgtttgtggaaagtgcagagatgggggagaacggtgtggtggcgagcaagctgtgctacccggcggcggccatggaggtggtcgccgccgagctcggccacacggccggctccaagctgtacgacgacgacggccgcctcaagcgcaccgggacgatgtggacggcgagcgcgcacatcatcacggcggtgatcggctccggcgtgctgtcgctggggtgggcgatcgcgcagctgggttgggtggccggccccgccgtcatgctgctcttctcgttcgtcacctactacacctccgcgctgctcgccgactgctaccgctccggcgacgagagcaccggcaagcgcaactacacctacatggacgccgtgaacgccaacctgagtggcatcaaggtccaggtctgcgggttcctgcagtacgccaacatcgtcggcgtcgccatcggctacaccattgccgcctccattagcatgctggcgatcaagcgggcgaactgcttccacgtcgaggggcacggcgacccgtgcaacatctcgagcacgccgtacatgatcatcttcggcgtggcggagatcttcttctcgcagatcccggacttcgaccagatctcgtggctgtccatcctcgccgccgtcatgtcgttcacctactccaccatcgggctcggcctcggcgtcgtgcaggtggtggccaacggcggcgtcaaggggagcctcaccgggatcagcatcggcgtggtgacgcccatggacaaggtgtggcggagcctgcaggcgttcggcgacatcgccttcgcctactcctactccctcatcctcatcgagatccaggacaccatccgggccccgccgccgtcggagtcgagggtgatgcggcgcgccaccgtggtgagcgtcgccgtcaccacgctcttctacatgctctgcggctgcacggggtacgcggcgttcggcgacgccgcgccgggcaacctcctcaccgggttcggcttctacgagcccttctggctcctcgacgtcgccaacgccgccatcgtcgtccacctcgtcggcgcctaccaggtctactgccagccgctgttcgccttcgtcgagaagtgggcgcagcagcggtggccgaaatcatggtacatcaccaaggatatcgacgtgccgctctccctctccggcggcggcggcggcggcggaaggtgctacaagctgaacctgttcaggctgacatggaggtcggcgttcgtggtggcgacgacggtggtgtcgatgctgctgccgttcttcaacgacgtggtggggttcctcggcgcggtggggttctggccgctcaccgtctacttcccggtggagatgtacatcgtgcagaagaggataccgaggtggagcacgcggtgggtgtgcctgcagctgctcagcctcgcctgcctcgccatcaccgtcgcctccgccgccggctccatcgccggaatcctctccgacctcaaggtctacaagccgttcgccaccacctactaattcatcgagcacctcgcgtgcatgcacataccgtacgttattacgcgtggtcgagatgaagtacagatgattgtatcctaattaatcaattaatcaaccaaaattaattaactaattactatttagttattattgtcacacgtgtggtgaaaaaaaaaagtgaaaagaggaatttgagacaggttgcatagagtgttgtttatgctattgttgcttgtatactgcctgtattaattccaaccgatgctactaattttgattgtttctggtccgtgttaatgttaaccaaaaggaggtagaatggtgtatttccaagtgaagagatgtgtttgtaattacataattaaatgagaaatgcactttcttatggc

SEQ ID NO: 75 - DNA, 992 bp, Oryza sativa
ctctgctcctgctcatcatcttcttcttctccgctctccctaatccaaaaaaaggcggctgctttggtcgctcgctcgctcgcgcggacgttggaggagaagcagctaccgggatggacgccatggccgtgctcgcgaggacctcccgccccgccccgaccctcctcgccgcgacctcccccgcggtgtcccggcgcccggcggccgtctccttcgccgccgccgcctccccggggtcccgcggccgcgtcgcgctgagcgccgcgtggggcgggagggcggccagggggcgcgtctccgccgccggccgcatcgtcgcgtcgtcggttgagcaatcctatattatgatcaagcctgatggtgttcagcgaggcctggttggcgagattatttcccgtttcgagaagaaaggctttgtgttgaagggcttaaagctttttcagtgccccaaggacttggcacaggagcactacaaggatttgaaggaaaaacctttctttcccggtctgatcgagtacataacttctggccctgttgtttgcatggcttgggaggggaatggtgttgttgcatcagctcgcaagttaataggagctactaatccccttcaagctgaaccagggaccatacggggcgatcttgcagttcaaacaggaaggaatgttgtccatggaagtgacagtcctgataacggcaagcgtgaaatcgctctatggttcaaagaaggcgaactctgcgaatgggaatctgttctgacaccatggcttgtagagtaatgctcccagatcagtgcaagaactggatgcagtgcttgttcttgatttgaggggttatgtatgagttcagatcagcagagtaaagtagcttataccaaagctcggccttctcatgattgtacaccctgacattccccttttttgtaatacccaacattctctttttcgcgtttgaccgattactctctgttgtcaaatctcttggcatgtctgtaa

SEQ ID NO: 76 - DNA, 3157 bp, Oryza sativa
aaccccaccaaaatcatcatcgctttcgacgaaacaggtcggctcgtctctcctcggcggcgaaggaaaaaaaaaaaacgcgcgtcgccgccgccgctcgccgcgaagcttctcctcccccggccgccgctcgccgtcggctcgggcctgaccgcccttaacgccgcccgctggtcgtcgcgaggaaccgggaaccctagatcgctccgctctcttccagtccccccccctcaacctctcctcctctctcctctccaatctgtgcagggccggaggtagggtagggctctcgcctgctctcgcgcgcggcgcggcgcgggggcgagcgggcccgtgggcacggtgggggacggcgcacggccgggtctggagggggagcggccgacgcgtccgacctcgttccattcgattccgtctcgattcgggtcggattggagctgaaaccccgtgttaggtctgcccctgcctggaatccctggatgctagctgctgctgctgctgtgctcttgtttgttgatagttcatgtaattctccccttcctcctgtaatgtttggaagggtttagggtaataggaaagaggagtttgtaagatagactcgggaaaagattgaattttacgttgtaaagaaggttaaaagcaagtgaaataataaatttctgagctagctagtaagaggcagcagaattcctgtggggcttattgtagacctgtctctatggcgaagagtaacaatggtaatggctacctcggtgtgactgagccaatctcattgagtggtccaactgagaaggatgttgtccgtacgcaggaggttgagaagtgtcttgctgacgctggcctgtatgaaagccaagaggaagctgtctcacgagaagaggttttaggcaaactggaccagattgtcaaggcttggattaagaaggcaactcgagctagtggttttggcgaccaatttgtgcaagaagcaaacgcaaagatttttacttttggctcataccgactaggggttcatggccccggtgcagatattgatacgctttgtgtgggtccaaggcatgcaactcgaactgaatactttttccaggctctttatgatatgctagttgatatgccagaggtcacagagttacatccagtgccagatgctcatgttcctgttttgaaattcaaacttaatggggtttctattgatcttttatatgctaatcttacacatgttgttattcctgaggacctggatctttcgcatgactctatattgcacaacgttgacgaacaaactgtccgaagtcttaatggatgccgagttactgataaaattctacgattggttccaaatattctgactttccggacaaccttgagattcatgagattttgggcaaaacgccgtggagtctactcaaatgttatagggtttcttggtggtataaactgggcacttcttgttgctcgtatatgtcaactatacccaaatgcatcaccaagcatgttgatatctcgttttttcaaagtctacagcaagtggaagtggcctaatcctgttatgctttgccatattgaagagggttctcttggtcttcttgtgtgggacccaaggagaaattttagagacaggggtcatcatatgcctataattacacctgcttatcctagtatgaattctagctataatgtatctatcagtactaggcatgtgatggtccaagaattcacacgagcttctgatatctgtcaggcaatagacgaaaggaaagcagactgggatgctttgtttgagccatatccattttttgaatcgtatagaaattatctaaagattgagatcacagcaagaaatgaagatgacctcaggaattggaaaggttgggtagaatcccggcttcgtacgcttgtattaaagattgaacgatttacacgtgagatgctcctctcacatcctaatcctagagatttcatcgacagctccaggccattgcattgtttttactttatgggtctctggaaaaaacaaatcagccaagctcaagaagctgagcagtatgacattagagcaattgtgaatgaatttaaaagcaatatccatgcatatcaacactggagagaaggaatggaaattgaagtttcccatgtaaaaagaaaagatatcccatcatttgtttttcctggtggaatccgtccttctcgcccatcaagaacagttggcaaggaagctcgggctgtttcaagaagtaatatttcagctaatgttcaagaaagaaatgttccaagcatggcccagcctatgccatataagagtagtgaagtaaacaaaattccgtcagatcctcatggtggctatcagtcgcaagaaagaaataatgcagtggtctctagtttgccctgtgaagaaactggccatatgttcaatgggtatgcaaatctccatacagaatctgttgagctggaacacttgagaagctacaagggaagtacatctgttcctgagaaccatgttgtgcatgatttagtcaagccaccagagagcatgccacctaactcaatccatgtttatccaagtccaacaaatggattgggccatcttttagatagttcttgtaaaaaaccagcagacatcattgtaaataaaaccacaaatttctcttcagctgtcctagcagtacctgatgaacttgatgagctggattctcatcaagtgaaggtaaatcagaaagatttaactgcagtagatcaaggattatctttggagcataaagttggaagtaatgggggcaaagcaggaaccacaggttcacctgacaacaatcatctgaagcgtaaagctgaggaagagcttgagccacttgagcttgctgccccactagttcgccctcctgcaccaacgtccacgacccagaggagacccttgagactgagattgtcaactgtggtgcaacccaaacctgctgaaggaacttcatgaatcgagttgcttggagacatggagattattctcttcaagggagggaggccgcctcaagctatccggtcctgtagagctgtgtaacggtagcaggaaaaaggcactgaaatgtctaatagagcaacatgtaaactaaatattgatgtaaaatccaaaattccaagttctaataaaattatcgtgttttgcccc

SEQ ID NO: 77 - DNA, 1768 bp, Oryza sativa
actgatcccattctgcgtcgagctgcctagctatcgatcttcgtacgtaaatacgtctccctcgtctccggcgagccaccggccgtgagagatggcgccgccgtcagccatgaacacgtcgagggcggaggagaaggccatcgacgactggctccccatcacctcctcccgcaacgccaagtggtggtactccgctttccacaacgtcaccgccatggtcggcgccggcgtcctcagcctccccttcgccatgtccgagctcggctggggtccgggggtggcggcgatgatcatgtcgtgggtgatcacgctgtacacgctgtggcagatggtggagatgcacgagtgcgtgccggggcggcggttcgaccggtaccacgagctcgggcagcacgcgttcggggacaagctggggctgtggatcgtggtgccgcagcagctcgtcgtcgaggtcggcgtctgcatcgtctacatggtcaccggcggcaagtcgctcaagaagttccacgacctcgtcgcgccgccctccgcgccgccgatccggacctcctacttcatcgtcatcttcggctgcctccacctcgtcctctcccagctccccaacttcaactccatcagcggcgtctccctcgccgccgccgtcatgtcgctcagctactccaccatcgcctgggccgcctcgctccaccaccacaaccacaacaatggcgctgccgccggaggtgtggactactcgctgacggaggcgacgccggcggggaggacgttcaacttcctgagcgcgctgggggacgtggcgttcgcgtacgcggggcacaacgtggtgctggagatccaggcgacgatcccgtcgacggcggagcggccgtccaaggggccgatgtggcgcggcgtcgtgctggcgtacggcgtggtggccgtatgctacctccccgtggcgttcgcgggttactacgtgttcggcaacgccgtcgacgacaacgtgctcatcacgctggagcggcccgcgtggctcatcgccgccgccaacatgttcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtcttgttcaccatgttcgttgccatcgcggtccctttctttggtggactgctaggcttctttggtggctttgcgtttgctccaacgacctacttcttgccatgcattatgtggctgtcgatcatgaagccaaagaggtttggcttgtcctggtgcatcaactggttctgcatcatcatcggcgttcttctgtcggtgttcgcaccaatcggaggtctccgctcgatcatcgtgaatgcccagagttacaagttcttctcttgagtgattaattgagagaaaaggtgttttaccgttcaattaagtgtgttcttaattaattaggggattgttttagataatgcacagagttctatttaattaattagatgaaagagaaattcgtgtgtccctatgagacatctgtgtggattgatatagtagtcgatcaaatgaaggcatattatttatttggcctttgtttgtcgatctagtactctagcgttaatttaattcgtgtcgagtttatcccaatttttgatgatgtttgtgctctattatcacgtggtgtggcattcgttttaagggtttatgattggttcaaacttcgtcctagttttt

SEQ ID NO: 78 - DNA, 1560 bp, Sorghum bicolor
ctccacagcgcccgcgccagaagccaaaaccctcccccgccccctgcaggctgcaaccgcaatgtcggcggccgggacgctctccggcggcgccgccggtctatccggcctcctccgcctccgccgccgggccgcccccgcccccgcgatcgccgcgccgtcgctccaccccgctgggaccatcaagtgcaccgccgtgcccgatgccgccccgattgtctggggccgccagctccgaccggcgctcctcctccccgcggcactgctcccgtcgtcgcagcccgccaagaagcacaatctgcgcccggccgccgcagccgccgagtccgcaggggaggccaagggtttcctggagaaatacccggccctggtcaccggttttttcttcttcatgtggtacttcctcaacgtcatattcaacatcctcaacaagaagatctacaactacttcccctatccatactttgtgtccttgatccatctagtagtgggtgtcgcatactgcctcgtcggctggagtgtcggtctccccaagcgagcgcctatcaatgccaatctcctgaagctgctctttccagtggcattgtgccatggtattggtcacgtcactagcaatgtgtccttcgctgctgttgcagtctcatttgcccacactatcaaagctctggagcccttcttcagcgcagctgctactcagtttatccttgggcagcaagttcccctctctctgtggatgtctcttgcccctgttgtcattggtgtttcaatggcatcccttactgagctttcgttcaactggactggcttcatcaatgccatgatatcaaacatctcattcacttacaggagcatttattccaagaaagctatgactgacatggatagcaccaacgtgtatgcttacatctcaataattgctctcattgtttgcattccacctgcaataatttttgaagggccccagctaatgtcgcatggatttagtgatgccattgcaaaagtaggtttgacaaagtttgttagtgacctagtcttggttggactgttctaccatctgtataaccagattgctacaaacaccttggagcgagtggctcctctgacacatgctgtcggcaatgtgttgaaacgtgtttttgtcattggtttctcaatcgttgtttttggcaacaaaatttccacacaaactggaattggcacgtccattgccatagcgggtgttgctttgtactcttacattaaggctaagattgaagaggagaaaaggaaaaagagcgcatgatgaggtgactgctgtgaatattatcgggtggctgagttatacctcctcggacacaacatcgtcgacaatctcgacctacttctatgccttgttttgttttcatcttgagtcagttggtccattgtttgttcccaatctggtgattaactctgcaaattctgtttgtggaattggcagtgatacaaatttcggttcttaagtaaaactggttgctggtactggtagacagtggtattcgcctgtaacttaatggatgcttggaataccgggtgtaccgt

SEQ ID NO: 79 - DNA, 2042 bp, Sorghum bicolor
gcagcggcaatcgatatgactgaggtgacccgacgccgaccagattgactgactgactgcgtctgcgatctgttgagagtgagtgagcgaactaggccgtgcttgagctgatactgccgtgccgctctagctcgccggccgggatgggcgccgccgccgcggggcctgctgcggctccgccggcgacgacgcattgccgctgcatccagctactgctgctggcgctggccgtcgtgccgctcggcagccgcgggcttcgcgtccgagccgtcggggcggacacgggagggctgagccgggacgcgttccccaaggggttcatcttcgggacggcgacgtccgcgttccaggtcgagggcgcggccacgtccggcggccgcgggcccagcatctgggatcccttcgtccacacccccggaaagatttctgaagacgggaacgcagatgttacaacagatgaatatcatcgctacaaggaagatgttgatctcatgaaaagcctaaattttgatgcataccggttttcaatctcctggtccaggatcttcccagatggcgaagggaaagttaatgaagaaggagtacagtattacaacaatcttatagactacatgattaagcaaggtcttactccttacgccaaccttaaccactatgatcttccacttgcgcttcagaaaaagtaccaaggctggttaggcccaaaaattgtggacatattcgctgactatgccgatttttgtttcaagacttttggcgatcgagtcaagaactggttcacattaaatgagccaaggatagtatcattccttggttatgataaagggattgacccccctaatcggtgcacacaatgcactgccggtgggaactcatcgacagaaccttacattgttgttcataacatcctcttatcccatgctacagctgttgcaagataccgcaataaataccaggcaactcagaaaggcaaggttgggatagttctagacttcaactggtatgaacctcttaccaactcaactgaagatcaagcagcagcgcaaagggccagggacttccatattggttggtttcttgatccattaataaatggacaatatccaaagacaatgcaggacattgtgaaagatcggctaccaagtttcacacctgaacaagctaagctagtcaagggctcatcagattatttcgggatcaatcaatatacaacaaactacatttcaaatcaacaaactactcagcaaggaccaccaagctactcgtctgactggggtgttcaatataactttgaaagaaatggcgtgcaaattggacagctggcacactcagtctggctttacatcgtcccaacgggcatgtatggagtcgtcacctacctaaaggaaaagtaccagaatccgaccatcatcatatccgaaaacgggatggatcaacctggagacctgacacgcgaggagtaccttcacgacacggttcggatcgacttctacaagaactacctgacggagctgaagaaagggatcgacgacggcgcaaacgtggtgggctacttcgcgtggtccctcctggacaacttcgagtggctgtcgggctacacgtccaagttcggcatcgtctacgtcgacttcacgacgctcaagcggtaccccaaggactcggcgtactggttcagggacatgctctcagggacgggctcgaaggccgccgccgccccgcagaccggttcaggcacccgtccggctgtctcggcttcggccacctcgaatggcgctgccctgctggtctctctgttcgtctccttgtgtgtcctgcttccatccgtcttcatggtttcctcagtttaattaggagtattttttttcttctagtgtgaattttgtagtggatggcagcgtgttgcttttaagacatgttgcatcaaggagggacctgttgtaggaatgagactatgattgagggtggtctgatggttttaagacatgttgcatcaatgcagagcagctttggatgtgtatttatggatagctcgtgttcttcgt

SEQ ID NO: 80 - DNA, 1617 bp, Sorghum bicolor
cggcgccgattccattggagctccgccacccttggctcccagcctcacttttttcgctcgccgcgctaccccaccccacagagacacgtcccgtcccactcccactgccacaccctgccactgccagctagctcccgcgatcggcgccccgcggggagctcgagctagtgtaaatataccgtgggcggcgggaggatcagcagagccggttcgttcgtcgtgccccgcgcgctctgcactgcgtggtcaccaccaccaacaccaccaccaccagctaaggtagccgaagagagccagggagcgaagcggagcggaggcgagatggaccacgcggcggacgcgcaccggacggacctgatgaccatcacgcggcacgtgctgaacgagcagagccggaacccagagtcccgcggcgacttcaccatcctgctctcccacatcgtcctcggctgcaagttcgtcgcctccgccgtcaacaaggccgggctcgcccagctcattgggctcgccggcgagaccaacgtgcagggagaagagcagaagaagctggatgtcctgtccaacgaggtgttcgtcaaggccctcgtcagcagcggtcgcacctgcgtccttgtgtccgaggaggacgaggaagcaacgttcgtggaccctaagctacgtggaaagtattgtgtttgctttgatcccctcgacggctcctccaacatcgactgtggcgtctccatcggaacgatctttgggatttatatgatcaaggacaaggacaatgtcactctggccgacgtactgcaaccaggcaaggacatgcttgccgctggatactgcatgtatggcagttcctgcacgcttgttctgagcactggaagtggtgtcaatggcttcacacttgatccttcacttggcgagttcatactaactcacccagacatcaagatacctaagaaggggaagatttattcagtcaatgaagggaacgccaaaaattgggacgtgcctgttgcaaagtttgtggagaagtgcaaataccccgaagatggtacgccaccaaaatctttgaggtacattggaagtatggttgctgatgtgcaccgtaccttgctatatggaggtgtatttttgtaccctgctgaccagaagagcccaaatggaaagctccgcgtcctgtatgaagttttccccatgtcattcctaatggagcaggctggaggtcagtccttcacaggcaaagaacgggctcttgatctagtcccaaccaagatccacgacagatccccgatattcctcggcagctacgacgatgtggaggaaatcaaagccttgtatgccgagcaggcaaagtcaagctcggcttgatcagcgaacccaaatgaggtgtaaatcgacctgattcagacatttcttcccttggtgtcgtcgtaagtttgtaacattcagtgtaatatatagtatgggggcccggaacagcttcacaagcaactaaggtcctccgaaaaaagttacatactcatagtttgattcgagttatccataaattatatacatacatgcatgcacatatgcatctctagcacctaaaagccttgtgttattaccaacctaagcatacttatagtttgc

SEQ ID NO: 81 - DNA, 1497 bp, Sorghum bicolor
atttctccaaatctcatcgtcttcgcttactacaggggagcgtccggccgtccgcgtctcgcagaccgccgccgatctcgtttctcctgccgctcttggtcgtactgcttcgaaccctagccgctggagaatcagatcagaaagggacttggcggtggagcataaaatcggagcctcgcccacagtggtgctactgctgggcatcaaatcggaagtgggcagcccagcgcccgggcatggcgtgggcgcggtcgccggtccggtcgacactcacacagaagcatggcccaactccggtctccagcaaggtggtatacacacttggataatggccttaggtgtgaatattgaccagctccgccactcctccatctcttatcttgcaggaatcccactaagtatacttccaccatcaattttagtgaagaattgattgtctccaagctgttctgattcaccatgccacagtcatccgcagaaaaaatgccgtcagtttatctgtacatccctaacatcattgggtatttcaggatcatcataaatttcattgcgtttgctgtttgctattccaacaggctcctctttgctatgctgtacttcttcagttttgtcctggatggcgtggatggttggtttgcacggaagtttaatcaagcatctacattcggagctgtgttggacatggttacagatagggttagcactgcttgtttgttggcccttctctcacagtgttacagacctggtttagttttcttgatgctgcttgggttggatattacaagccactggtttcaaatgtacagttctttcctgtcaggtaagactagccacaaggatgtaaagaacacaggcaattggcttctgaaattatattatgggtataggccatttatggcattctgttgtgtttcttgtgaggttttatatattatcctctttctctttgctgatgagaaatcgacaagcttgcttggtacatgcagaggtgtcctgaagcaaggtcccctcactctcttggtgtttatttcaactctagttggttgggcagtgaaacaagttaccaacatcatccagatgaaaacagctatggatacgtgtgtcgagtttgatccgaagcgcagcaagtgaagctggaaggcccgtttttgttttatatttgacatatccaaggaaacactccatgtgaggcatgtacaccaatgttcatacatatagcacctgcttcatttttgtgatggcgctggtctgtaggaccagacagcagcatgctggtggctctccctcaaaaaaacaatatgctgtgggaagaacagcataaaaaaacaggagataagtgtgtgttcacgatctttgttatcttgactagagtagcctttttgagcatatctgaacaattttcatgtcccattgaaatcctactccactcaaggatgattttagtattgtaaacattgcatgtacttgagttgaagacttccccagttttgtgttaaa

SEQ ID NO: 82 - DNA, 1557 bp, Sorghum bicolor
ggcgccgaggtgagagagagagagagagagagagagagggagaaactgtgcgcccgcctgccccctccttccgtcgtttataagcgacggcaacgcaggcgaagaagccggggagggaggggcgcacgaggcaatttatagggaggaggaaggaagaggagcggccgggcctgagcagagcagtccgggccagccatctctcctctgcggcgtccgagcgggggcggcgcccgagatgggggactccggcggctccgtcgtgtcggtcgacgtcgagcgcatctccttcggtggcaaggaacaccatatacaaacgagtcatggacctgtatctgttgcagtgtatggtgaccatgacaagcctgcccttgttacttatcctgatattgctttaaaccatatgtcctgcttccaaggactattgttctgtcctgaagctgcttcactgctgcttcataatttttgcatttaccatattagccccccaggacatgagttaggagctgctccaatttcgccaaatgctcctataccttctgttgatgacttggcagatcaggttgcagatgtcctcgatttctttggattaggctctgttatgtgctttggtgtcactgcaggtgcctacattctaactctgtttgcgacaaagtatagggagcgggtactaggtcttatccttgtttcacccctatgtaaaggccccacttggactgagtggttatacagtaaggtgacatccaatctgctgtattactatgggatgtgtgggttggtgaaggagtgcctacttcagcggtacttcagcaaggaagtgcgaggattctctgaattacccgaatcagacatagtgcaggcttgtaaaagcttgctcgatcagcggcagagcatgaatgtatggcgctttgttcagactatgaatgagagatatgacttgactgaacagctaaagcaacttcagtgtagaaccctgatttttgtcggtgagaattctcagtttcacaccgaggctgttcacatgacatcaaagctcgacaagagatattgtgctctagttgaggtccaagcatgtggatcactcgtaactgaggagcaaccacatgcaatgcttataccaatggagtacttcttcatgggatatggcttgtacaggcctagccagctggactgcagcccgcgcagccccctgagcccattctgtatatcgccggatctcctgtcacctgagagcatgggggtgaagctaaagccgatcaaaacgcgagtcaggcttgaagtgtagcagaagtgagtaatgggatggggcgcttaggggctgacatggtgagaggttaggctaacttgcaggtctgtcttaatttttttggaggtataaagtcaagatacctgttatactgccatgtacatataggaaaatgctaggttggtgagctcggctggggtgggtgggttcttgtattctttgatttgtagcctgatgaaacctgtaaatttggtatacattgtttatcaaaggaaagtgaaagaaataatagcagaaggtgaggtgttgccaat

SEQ ID NO: 83 - DNA, 1288 bp, Sorghum bicolor
gagccaggtcttcctagtcaagtctttgtgtcaccgtcctgctctctgcaggcactgtacgctacgggatatccttctcagtgcgacgacctagcttgttattagtttaaccaactccactggctgtaactaagctagtagtgtctctgctaattgcgcccgtgtttacaaaaaggaagcagcggtagtgtctgtgtgtgtgtgtgcacactactcctgccagcgccaaggcaaagcctcctgctcgagcttgcagaaagagcagtgtgtctggctcttgctctgtttgtttctttcctcgcctgagtcctacgtacgtacttcaggagaaatgaggaaggagatgatcatacgggtgcagacgacgggctccgagaagggccacagcaaagctatcaaggtggctgctgcaatctcaggggtggagtccgtgacgatcgccggcgaggacaagaacctgctgctggtgatcggcgtcggcatcgactccgaccgcatcaccaagaagctgcgccgcaaggtgggccacgccgaggtggtggagctgcggaccgtcgacgccgccgccctcgcggacgacctcgtcggcggcggccgcgccatcgccgccgccgaccacgcgtaccgctaccacgcgagcccgagcccctacaggcatcaccaccactcgggtgcgcgcgaccactactacggcggcatggaccactactacgccggtggcggatccgcgtacgcgccgccggcgccgccgccgctctactacggcggcggcggcgggggatacccggcgcaggcgcagtacgagcagcacgactacttgtaccacccggcgggcgccaagacgcacacggtggtgcaccacgagtacgccagcgaccccaacggctgctcgatcatgtgatggcgccgttggtgtttcgatcctgtgatctgggaggtaggtgaccctgcatggcatggccacctggtgtcgacgtgtgttcgtgtcacacgtcggtgcggtgcagtgacttggcgggtcactcacatgcagacactacgcgcgctactttctgcttctggttctgttctgtgtgaccagtgtacagcataagcagtgcatccgtggatgcgtcaatctgtgtagtgtgtacgtacggtgccaagtgcaagcttttactgcttgattgggacgaactaattgaaggaagaacatgaccctttttcttccggtcagtttgtaacactatttctcccgttctgttgatgaaaaaaatgcatgtgatctgcacgttctcaaaaaaaaaaa

SEQ ID NO: 84 - DNA, 1432 bp, Solanum lycopersicum
atcatttgcaacactaattcaattttccgtaaaacttgataaccggtgtagcgacaagtaatcccaagttccaaagtgcgccgatatgttttttccataggatgggaagggtaaggctaagcgtgaagcgattggagagtaatagtaacaggcaatccacttattgcaaacgaagatgtggaatcctgaagaaagcccaggagatatctgtgctatgtgatatagacattatccttcttttgttttccccaactggaaaaccaacgctatttcaaggcggacaaagcaattttgatgaaataattgcaaaatttgctcaattgactcctcaagaaagggcaaaaaggaagttggagagccttgaagtaagtctgatattcatcaccactatgtgttctcctcttgctatgctttgttgttacttcataatccaagtgaaagtaataacaatgctaatggttacactccagacattgaggaagacttttaagaagcttgacaacgatataggcgtgccagagtttctagatgctagtgatccatcagttgaagaattgcatagtcaagtgaaacttttgcaatctcggcttactgatgtagaaatgagactcaactggtggagcaatcctgataatataaataaagtggaagatttcgcgctgatggagtctgcactaagggagtcacttaatgcagttcatgttcggaagctccagaagacgacgcatttgcatcttttgatgaacagtgaactagatgggaatactcatcagtggcatccagaaaataaaatcctgcacatgccattccctcagactccaaacattctaccccaggaaaatatgggatactttggagataattcagttgctgaatcttctcatgttctgggctctggagaagttgatcaagctagacaggccacaactgcaattctagataacggtgtcttgaatgatctaagtagtatagcatgcttgagacagcaactaagtgagcagtattcatacaaccccaatgaggatcttgatctgcttgaaaggaacatgttggatcctcagagtgatgccaatttgaaaggatatttgatggattatgaatttcaaagaaacttaaacctaacaaggtctgtggattcagtcaattatagtgcagtcaatgccgttgctgttccagattttgatgaaaaatcatatgcacagccagcaacttccagtgattagacattcgagataagtcacactactcgagtagagaataatctgtgatcgtgggtgaggtttacaggtgcagtggttgttgatagataattatgtttgaatatgtatagttgttttgctttgcgaaccccgacacccctcatggtgaaagtaggataggagcttgttcatatatgagatgtgaataaaagaccagtttcactttgctggga

SEQ ID NO: 85 - DNA, 1445 bp, Triticum aestivum
aattcgcccaacaccttcggaaccccaatggcgagctttaacgccgccggcgccggcgccgccaaccccaaccctaacaaatccctcgaggtgaatccggcgcccggggactcggtttccagcctcagcttcagccccaaggcgaaccacctgattgccacctcctgggacaaccaggttcggtgctgggaggttcagcctggcggccaatgccaggcgaaggcgtctatttcgcacgatcagccagtcttgtgctctgcctggaaggatgacgggactactgttttttcgggaggttgtgacaaagtggtgaagatgtggccgctgctgtctggcggccaggccacggccttctcagggcacgaggcgccggtcaaagaactcgcctggataccacagatgagccttcttgtcagtgggtcttgggataagactctgaggtactgggacattcgacaacctaatccagcgcacgttcagcaacttccggagcgctgctatgcactctcacttagttatcctctaatggcggtcggtactgctgatcgcaacgtagttatcttcaatctgcagaatccacaggctgaattcaagaggatcgtgtcacctttgaaattccagacaaggtgtatcgccgccttccctgatcaacaaggattcttggttggatcaatagagggacgcgttggtgttcatcatgtggatgattctaatcaaagcaagaatttcacattcaaatgtcaccgcgagggcagtgatatattctctgttaactcgctgaactttcatcctgtgcaccatacatttgctactgcaggctctgatggaggtttcaacttttgggacaaggacagtaaacaaagactgaaggcttttagtaagtgcccatcacccatcacatgcagcacattcaatcaggatggctcaatctttgcttatgcggtatgctatgattggagcaagggtgccgagaagcataatccttctactgcaaagacaaatatctttctgcatagcgtgcaggaatctgatgtcaaaggaaagccccgtactggaaaaaagtagagacttggtaatgacaagctgcagatctgtgctccgaacctgatgagttcgccatcgcctgatgctaattacctgcacgagtgttttagatcttgactctgtagggcattccttcatctctgagactgcaagcatatcttctataaaaagcagttgcatttcttcccatgtaaatggcaggtcgtaatttgttgctgtagttcagctgtttttctgcaagttggacgtcggagttttttaggaacaaagagttgaaggactacttggctttaaatccgtcgagatttgctgacatgggagttacggagcgaatgggagaacaggattttttggaacctggtttcacgcgcctgttagaacattataattaagaaacaata

SEQ ID NO: 86 - DNA, 2097 bp, Sorghum bicolor
ccgcctccatgccgctgccgagcgctgctggaaagttttaaaactcacggggagctcggagactccacgacgaccgccgcttctctcggccattgtcgagggagagagcgcgcgagcgacctaggtcgtcagtcggcttcgggtgttcggcgccgtcagctagctatccgcgacgatgggcctgcgcgtggccgccaccgcgccagctgcggccggcgtgcgcgtgctcggtggcggcgccgcgagcgtgaagccgcgaccgtgggtggcgctcggaggcaggagacgcctctccgtgcggatgtccgtcgccactaccgagaccaccacctccgccgccgccgccgtgggcgcctcggaggaccaggcgctggaggctaggaactccaggacggtggtagcggtcatcctcggcggtggcgccgggaccaggctgttcccgctgaccaagcgcagggccaagcccgcggtgccaattggcggcgcgtacaggctgatcgacgtgccgatgagcaactgcataaacagtgggatcaacaaggtgtacatcctcacgcagttcaactcgcaatccctcaaccgccacctctccagggcctacgattgcaccaatggcgtggccttcggagacggattcgtcgaggttctagcagcaacccagaggcctggatcggagggaaagaggtggtttcagggtactgctgatgcagttcggcagttcgactggcttttcgatgatgcaaaatctaaagacattgatgatgtgttgattctttctggtgaccatctctaccgaatggactacatggactttgttcagagtcatcggcaaagaggtgcaggcatcagcatctgttgtttgccaattgatgacagccgggcatctgattttggcctaatgaagatagacgacactgcaagagttatttcattcagtgagaagccaaaaggagacgaattaaaggcaatgcaagttgacactacagtgctaggcttatcaaaggaggaagcagaaaagaaaccttacatagcttcaatgggggtctatatttttaagaaagacatacttctaaaccttttaagatggcgttttcccactgcaaatgattttggttctgaaataattcctgctgcagcaaaagaaatcaatgtaaaggcttatcttttcaatgattactgggaagatattggaactattaagtccttctttgaggcaaaccttgctcttgctgaacagcctccaaggttcagtttctatgacgctgacaaaccaatgtacacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgacgcggaaagaagagaattgcttgcagaaggaaatgttcctattgggatcggagagaatacaacgattcaaaagtgtatcatagacaagaatgcgaggatagggaagaatgtgataatctccaattctgaaggtgtagtggaagctgatagaacctccgaaggcttctacatccgaaccggcgtcactgtcgtactgaagaactcgataattgctgatggattggtcatatgaactgaaaaggtctcacaaggctggtatttgcggcagaaacaaccataggagttcttttgtagttgtacaataagatgctgtataccagtcaagaggttctgcttgtctatacaagagaacttttgtctacaaatcttgtctcaccatgcgtatttgactcaaacaacgttgcagatctttttacgagaacacgtctgtggacgagacgtgttttttcattattaagaggaaaccaagatacaagcttcaggcacaaatcactagctctggtgcagtgacgcgaggagcgtttgcactaggtttgcgactgctgaactgccctcgccggaggaccagctccctagaaaagttgctgatggattggtcatatgaactgaaaaggtctcacagcgttgcag

SEQ ID NO: 87 - DNA, 1654 bp, Sorghum bicolor
atcccgtatattctccttgtgcccaactgaagtgactgcgtcctctcgatctccctcagtctctcttgtgcctttgggggaacgtgtcgtcgtcgatcggaggtcgagatggcgccgccgtcgagcatgtcgacggagaaggaggagaaggccatcgacgactggctgcccatcacctcgtccaggaatgccaagtggtggtactccgccttccacaacgtcacggccatggtcggcgccggcgtgctcagcctgccctacgccatgtccgagctcggatggggccccggcgttgtggccatgctcctgtcgtgggtgatcaccctgtacacgctgtggcagatggtcgagatgcacgagtgcgtcccggggaagcgcttcgaccgctaccacgagctgggccagcacgccttcggcgacaagctgggcctctggatcgtcgtcccgcagcagctcatcgtggaggtcggcgtctgcatcgtctacatggtcaccggcggcaagtccttcgagaagtgctacgccgtctcctgcccggactgcaagcccctcaacaccagctcctggatcatgatcttcgccgccatccacctgctcctctcgcagctcccaaacttcaactccatcacgctcgtctccctcgccgccgcagtcatgtcgctcagctactctacgatcgcatgggcggcgtcggcgcacaaggggcggcacgccgccgtggattacagcatgaaggcgtccacggcgacggggcagacgttcaattttctgagcgcgctgggggacgtggcgttcgcgtacgcggggcacaacgtggtgctggagatccaggccaccatcccgtccacgcccgacaagccgtccaagaagcccatgtggcagggcgtcgtcctcgcctacatcgtcgtcgccatctgctacctccccgtggcgttcgtcggctactacgtcttcggcaatgccgtcgacgacaacatcctcatcacactcgagaagccacgctggctcatcgccatggctaacatcttcgtcgtcgtccacgtcatcggcagctaccagatctacgccatgcccgtgtttgacatgctcgagacgttcctggtgaagaaactccggttcaggccaggcctgcctctccgtttgatagcgcgctcactctatgttgtgttcacagctctggttggcatcgccgtgccgttcttcggggggttgctagggttctttggtggctttgcatttgcgccgacaacctactatcttccctgcatcctatggctcaagattaagaagccaaagacgtttagcctctcatggttcatcaactggttttgcatcatagttggcgtgctcctgacggtgtttgcacccattggtggcctccggtcgatcatcgtcaacgcctccacctacaagttcttctcgtgattgattattccattcgttacccaagagtttattagatatctagctagataaacataagcaagtagctagaggtttaatcgatctacttatctgtgtcaaaaggcaaggatattattatatgccatatggtgtgtgtgtgtgtgtgtgtgtgtgtgtgtgtgtgtgtgtgtgtgtgttcaatttgcattggatatggatggatgatggcactcggtttaatttgtgctat

SEQ ID NO: 88 - DNA, 1122 bp, Oryza sativa
cgcacaaacaaagccacccaaaaaagttggggagaggagagaccgagatcgatccgcacccaccgcgacaaacgctctcccctcccctcccctccccctccgcccttcgctcccatccgctccgccccctcgccgcgcagcgccggcggcgagaaggttgagttcgtggggggtgtgaccgaacgatggcgtaccgggcggacgacgactacgactacctcttcaaggtggtgctcatcggggactccggggtcgggaagtcgaacctgctgtcccgcttcacgcgcaacgagttcagcctcgagtccaagtccaccatcggcgtcgagttcgccacccgcagcatccacgtcgacgacaaggtcgtcaaggcccagatctgggacaccgccgggcaagaaagatatcgagctattacaagcgcatactatcgcggagcagtaggggcactcgttgtctatgatgtcacgcgacatgtcacctttgagaatgtggagaggtggatgagggagctcaaggatcacacggacgccaacatcgtgatcatgcttgtggggaacaaggcagatttgcgccaccttagggctgtctcgactgaggatgcgaaagcatttgctgagaaagagaacactttcttcatggagacgtcggccctggagtcaatgaatgtggagaatgccttcactgaagtgctcacccagatatatcatgtagtgagcaagaaggctcttgacatcggcgatgacccagctgcaccaccaaaggggcagaccatcaatgttggtggcaaagatgatgtctctgcagtgaaaaagtctgcttgttgttcatcagcgtagatcgaaaggacttgacaaacatggagatacccgaggtggttgatactatgcagtaggacacaggatgttattgcattcatagacctcatctgtattcatgtgttactaagtgtctccttcgttttgccatttgaaacattaattcattcaggacataatcttgccggtatagtttagggatatgaaattgtgaggccgtcagattttcatacaggccatttgtttgcttctattatggtttgaccgcttgatttatttatatgttgctgtctatttttcagta

SEQ ID NO: 89 - DNA, 2628 bp, Oryza sativa
aagccagcaaggctccccctcttctccccctcactcctaaaacctctctctcctccgccccctccatctccgccgccgccgccgcggcggctaatggagggcttccacaacctcctcgcccgccccaactcggcgccattcgccttctccctccctcgcccgcgcccgcgcccgcgccgcaggccgccgcctcacccctccgctgcctgccgcgccgcgagccgctgggccgaacgcctcttcgccgacttccacctcctccccaccgccgcgccctccgacccgccgtccccggccccggccccggccgccgcgccctccgcctcccccttcgtcccgctcttccccgacgccgccgaacgctccctcccgctccaagtcgatttctacaaggttctaggggcagagccacatttccttggcgatggcatcaggagggcgttcgaggcacggatagccaagccaccgcagtatggctacagcacggatgctcttgttggtcgtcgacaaatgctgcagattgcccatgacactctcatgaaccagaactcccgcactcagtatgatcgtgcgctttctgagaaccgtgaagaagctctcaccatggatattgcttgggacaaggttccaggtgtgttgtgtgcgcttcaggaggctggggaggcacttgctgtgcttgtaactggagaacagttgcttctggatcggccacccaagcgcttcaagcaggacgtggtgctagcgatggctctggcttatgtggatctatcaagggatgctatggcagcaagccctccagatgtaattggctgctgcgaggtgctcgagagggctctcaagctcttgcaggaagatggagcaagcaatctcgcacctgatctgctttcacagattgatgaaactctcgaggagattacacctcgctgtgtattggagcttctctcccttcctattgacacagagcatcataagaagcgccaagaagggcttcaaggtgcgagaaacattttgtggagcgttggcagaggaggtattgctaccgttggaggaggattttctcgtgaagccttcatgaacgaggcttttttgaggatgacatcaattgaacagatggatttcttttcaaaaacaccgaatagcattcctcctgaatggtttgaaatttacaatgtagcacttgcacatgtcgctcaagcaattataagtaaaaggccacaattcatcatgatggcggatgatctttttgaacaactccagaagttcaacataggttctcattatgcttatgataatgagatggaccttgcattggaaagggcattctgctcattgctagtcggagatgttagcaagtgcagaatgtggcttggaattgataatgagtcttcaccatacagagaccccaaaattctagagtttattgtgaccaactctagcatcagtgaagagaatgatcttcttccagggctgtgcaagcttttggagacttggcttatctttgaggtttttcctaggagcagagatactcggggcatgcagttcagacttggagattactacgatgatccagaagttttaagctacctagaaaggatggagggtggtggtgcttctcatttggctgctgctgctgctattgcaaaacttggtgctcaagctacagctgcacttggtactgtgaaatcaaatgctattcaagcgttcaacaaggtttttccattgatagaacagttagacaggtcagccatggaaaatactaaagatggccctgggggatatcttgaaaattttgaccaggaaaatgcacctgctcatgattcgagaaatgccgccttgaagattatctctgctggcgcactgtttgcactgttggcagtaattggggccaaatatttgcctcgtaagaggcccctttctgctattaggagtgagcatggatctgtggcagttgctaatagtgtcgactctactgatgatcctgcactagatgaagatccagtacatattcctagaatggatgcgaagctggcagaagatattgttcgcaagtggcagagtatcaaatctaaggccttgggaccagaacattcggttgcatcattgcaagaggttcttgatggcaacatgctaaaggtgtggactgaccgagcagcggagattgagcgtcatgggtggttctgggagtatacactatccgatgtgacgattgatagcatcactatctccctagatggtcgacgagcgactgtggaggctacgattgatgaggcaggccaacttactgatgttactgagcccagaaacaatgattcatatgacacaaaatacactacccggtatgagatggccttctccaagctaggagggtggaagataacggaaggagcagtcctcaagtcgtagaacagtgtgcagtagcttgtcctttcagtttgattgtgtaaatagacagtgtagatgtcttcgttctttctgacagttttgttagatgagtgctgagatccccctgtgttcttcattttcgcaaagaatgtaggtgtatttagctgtaataactatattattgctagctcagaacttttggagataaaaagaggaaacctctgcagacatgctggcatgcacaaa

SEQ ID NO: 90 - DNA, 1073 bp, Setaria italica
aggaagatgtgatccggcccacgaacaaagcctggcccgggcggccacgacagcgctcggggagcccgctctgccgccgtgccggatgtctggacacaatcacaccacagggagctgtagagggcggagagcagaggccggcggagccatggcgaccactctctcgttatcttctcccctcttcctcgcagctccggccagagctagagatgtggccttgtgcggagtgccttcagctagtacatcatggagcactgcaaatgctctaagcaagggctacatggttagagtacatgagcgggggaaacagcgacgcatggcaatagtatccgtgattggaagaaagtcaacgactagagaaacagttgtccctgaccccgactataggttaccaattgctatacttgggattgctggtgcttttgcatatgcagacaatcttctagctgctgcacctgtaggactgctgggactgctgcttttgttccagactacaagagtgaggttcgtctttgataatgaggccctggaggtgaaagttggagaccagttgcaggagtcaggtgaaaatgtgtttgttggtggcaagaaccgttggaagtactcaacgttcataaattgggagctatggtggccacaatttcctatcttggtttacttcaaagagagccaaacaaaacctgaggggcagatccacttcttcccagtgatattcaatggccgacaactctatgatgtcatggtggagcgtgctggaccctcaaagacgagcggccctaagtagaagtagtgctgatcttccctcaagatgatgagctgagttccatggcgtgctgctgtggcaccagttgacgctccaggaagcaaaggctccgtgcctttttcgacctacctgatgtgtggtcctatgcattaccttcgagataaaatgaaggatgaatggatgatgtattagctgtagatatattagaaactgatgtaatgcaacatcaactactcatctgaggcaatacattggtgtgtacttggatttatattcagatgctaccaaaaaaaacacccatctgcaggca

SEQ ID NO: 91 - DNA, 4439 bp, Oryza sativa
gacctccccaccttcgtccgtctccgtcctgggcacccaacgcccaagggccaaggccataccatcgtcctctcccccaacctccttcccgcgccagatcagatccaccgccctctctctctctctctctctctctctctctctctctctcctccgctcgcctcagcggctaggggtttcgcctgccgctgccgccgccgccgccgctgggggacggctagcgaagatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacccagccgctcttcgtctccggaggtgatgattacaagattaaggtgtggaattacaagacacaccgctgcctcttcacacttcatgggcaccttgactacattcgcaccgtgcaattccaccacgagtacccatggatagtaagtgctagtgatgaccagacaatccggatatggaactggcagtcacgcacatgtgtggctgtgctgactggacataaccactatgtcatgtgcgcatcattccatcccaaggaggatctggttgtgtccgcatcactggatcagactgtccgtgtatgggatattggtgctttgaggaagaagacggtgtcacctgcggatgacatcctgcgcctcacccagatgaacactgatctgtttggaggtgttgatgcagttgtaaaatatgtgttggaagggcatgaccgtggggtgaactgggcgtcatttcaccccacattgccgctcattgtttctggggcagatgaccggcaagtgaagctatggagaatgaatgacaccaaggcttgggaagttgatactttgcgggggcacatgaataatgtgtcctgcgtgatgttccatgcaaagcaagacatcattgtgtccaactcagaggacaaaagcattcgtgtctgggatgccaccaagcgaactggtattcaaacattcaggcgggaacatgatcgtttctggattcttgctgcccaccctgagatgaatcttcttgccgctggtcatgacaatggtatgattgtgtttaaattagagagggaacgtccagctttctctgtgagtggtgatactgtcttctatgtgaaggaccgttttcttcggttctttgaatactccacacagaaggaggttcagttggctccaataagaagacctggatcggtcagcttgaatcagtcacccaggacactgtcgtatagtccaactgacaatgccgtcctgatttgctctgatgtggatggaggctcctatgaactctatatagttccgaaggattctgctggcaggactgattatttgcaggaggcaaagaagggagctggtgggtcagctgtttttgttgcacgcaacaggtttgcagtcctcgagaagagtagcaatcaagttctggtgaagaatcttaagaatgaaattgtaaagaaaagccctcttcctattgcgacggatgcaatttattatgctgggactggtaacttgctgtgcaaagctgaagaccgagtgaccatctttgatctgcagcaaaggttaattcttggcgagctccaggcacctgctgttaaatatgttgtttggtcgagtgatatggaatctattgcattgctgagcaagcatgcggtggttatagcaaacaagaagcttgtccatcgttgtacgctccatgaaaccatccgtgtgaaaagtggtgcctgggatgagaatggtgtgtttatttacactactttgaaccatatcaagtattgtcttcccaatggagatagtgggatcattaaaacccttgacgttcctatttacataacaagggctattgggaataatattttctgcctagatcgtgatggaaagaacaagctgatcacagttgatgcttctgaatacattttcaagctggcccttctacggaaacgatacgatcatgtgatgagtatgattaagaattcccagctgtgtgggcaggctgtgatttcttatttgcaacagaaaggctttccagaagttgccctccactttgtgaaagatgagaagacaagatttaacctagctcttgagagtggtaacatccaaattgcagttgcttctgccaaagagattgatgacaaagatcactggtaccggttgggaatcgaggccctgaggcagggaaacgttggtattgtggaatatgcgtaccaacgtacaaagaattttgagaggcttgctttcctatatcttattactggttacatggacaaggtggggttcatgtgcaaaattgctggacagaacaataacctgatgggtcaattccacaatgctctgtatcttggtgatgctatgaagagagttgagatcctagagaatgctggacagctacctcttgcttatattactgctgccacccatggactcacagaaattgctgataggcttgctgctgaattgggtgaaaatattccttctctacctgaaggaaaaactcgctctcttttgatcccccctgcacctctcacagccagtggtgattggccattgcttagggtgatgcgtggtatctttgagggtggactggatgctactgggaaggctgaacttgaggaagacgatgaagctgctggtgctgactggggtgatgaggacctggatatggttgatgcaagcgaagcgatggcgaatggtggtgatggttttgatgctgaggagggtgaagcaaatgaggaggatggtgaggaaggtggctgggacctagaagacctggaacttccgcctgaagcagagacccctaaaaacgccagtaatgcactctcagtggtctttgttgctcctcctccaggcatgcctgtcagccagatttggactcagaaatcttctcttgctggggagcacgcagcagcaggaaactttgacactgcaatgagattgcttagccgtcaattgggcatcaaaaactttgctcctctcaagcccctatttctcgatctgcacatgggcagccactcatatcttcgtgcacttgcaactgcccccattattccggttgctgttgagaaaggttggagtgagtctgcaagtcctaatgtgagaggccctcctgcacttgttttcaccttctcacaaatggaagacagactcaaggctgcctacaaggccaccacagaaggtaagttcccagaagccctgaggcagttccttaacatcttgcataccatccctcttatcgtggtagactcgaggagggaagtggatgaagtgaaagagttgatcgagattgtgagggagtatgtccttggcctgaggatggaacttaagaggaaggaattgagagatgatgtcaaccgccaacaagaattggcagcttacttcactaactgcaagcttcagagagttcatatgaggcttgtgcttggaagtgctatgggtttgtgctacaagcaaaagaactttgctactgcagagcactttgcaaggatgctgctggagaacaaccctaatgagagccaagcaaagagggcccgacaggtgcagcaacagtgcagtggaaagaaggatagctgtgagctgaactatgactacagaaatccatttgtcgtctgtggtgccacatatgttccaatttaccgtggccagaaggatgtttcctgcccgtactgtggatcccggtttgttccttccatcgaagggcagctttgtaccatatgtgagcttgctgtggttggtgcagatgcttcaggcctcctctgctcccctacgcagttgagataagtggcgctagatgccttatttccagctcaggaaaaacaattggacctttaatgcttacatggatggaaaaatgggatgttagatttgatttgtgatcagagaaggccattacatttgtgcaaaattttgaaatttaatagttcatacaaaaaagtgtgcaaatccaagaccaggctcaggataccaaggaacctcatcttgcctatgtaaattaactactttgagcagctgtggctagaagaatggatatatatcggccatgcctcatgtcagagcatttcagaataaatattcgtgtttagaatagactttttgatggtgaaatatttcaccgaggaattgtgagttcttacttcaaagcacattgcaaattgaggtcgtgttcctggatggttcgtcatttgtcgctgttatcttaacaagcggatttcacagcataattttttgctgagctacataaaagtgaaattggatttgatatgtagctcttatcttttgtctccaaatacaattaagatttttatctggaactaaaaatagatttggatttcataaa

SEQ ID NO: 92 - DNA, 1725 bp, Hordeum vulgare
tcctcgccgcgcgcgccgtccacgccgccgccgcccacgtcgccgaccgcggcctccgcgccgtcctcatcaccctcgccatggccgcgctcaagttggtgccgggggttggcggatacatcgccgcccagaagagcaaggttgttgagcagttgcagtcaggaagtgcatccagcaagaagaacctgcgaaccgagctgcccgccatcggggatcccgacggggtaataggcgagctccaggcgctcaaggacaaggatgtgagatggcagggcaaatgctccggcaccgtttatatcgctgggagcgagtccgaaggccatttttcacttataaacaaggcctactctatgttttcacacacaaatccactgcatcaggatgtattcaagagtgtggcacagctagaggctgaagtagttgcaatgacagcagctttgcttggcagcaaagaaaaggcatctggtggacaaatttgtggcaatatgacgtcaggtggaacagaaagcatattattggctgtcaaaacatcacgtgattatatgcagtcaaagaaaggaatcacaaagcctgaaatgataattgctgaatcagctcattctgcctatgacaaagctgctcaatatttcaatattaaagtgcggcgtgtacctgtgaataaagaatttcttgcagatgtaaaaggattcaaacggtgcataaatggaaacaccataatgatggttggatctgcaccaggatttccccatggtttaattgatcccatcgaggaacttggggagttggcttcagaatatggtatttgcttgcatgttgatctatgccttggtggcttcgtattgcctttcgcccgtaagcttgggtaccctgttcctccttttgatttttctgtcaaaggtgttacgtcgatctcaacagatgttcataagtatgggctagccccaaaaggcaccagcactgtcctatacaggaatcatgaaattagaaagcaccaatttgttgctgtgactgaatggactggtgggctctatgtttcccctaccatggctggaagcaggccaggtgggctaatcgcaggagcttgggctgcgatgatgtctcttggattgaatggttacttggaaagtacgggtcaaatcatggaagtctcaaagaagatacaaaaaggaattgatgatatctcaggtttatttgtgattgggaaaccagacatgactgtcgtggcctttgggtcggacgcggtcgacatatttgaggtgaatgacataatgtcatcaaaaggatggcacctcaatgctcttcagagacccaacagtttgcacatctgcgtgacacttcaacacacggcaatttacgaggaattcctcaaggatctcgaggattctgtaaacaccgtgaaagcgaatccagggcctatcagcggggggatggctccgatctacggggcggctgggaagatgccggatagaggcacggtcaaggagttacttgtagagttcatggacagctcttgctaaccattgactataccccattggttatctctctgtaccatgtatgtacaacccgcagtgacagtgttgtgtgatcttacatatttagtttggctgcaaaactgaaggcacacattgcctacaatatagacatgtatctatgtatcagctaaatgggttcaataaagttacattttcagcctattgctcctatatactgcttgccctgccg

SEQ ID NO: 93 - DNA, 1286 bp, Brassica juncea
cccttatctggattcaggtcaggaatctctaagggagtatttgatattgtggcattgacctcaaagaatgcactcaaagagctgagtactccactgatgctaaagctcgtgggtgttgtagcttgcgcgtttctcatagttccatctgcagatgctgttgatgcgctaaagacttgtgcatgcttacttaaggggtgcaggatagaactcgcaaagtgcattgccaacccttcctgtgcagccaatgtcgcttgcctccagacctgtaacaaccgtccagatgaaaccgagtgccagataaaatgcggagatctgttcgagaacagtgtagtcgacgagttcaacgaatgcgccgtgtccagaaaaaaatgtgttccaagaaaatctgacctcggagagtttccagcccctgacccttctgttcttgtcaagaacttcaacgtcagggactttgacggcaagtggtacattacaagtggcttgaatcccacctttgatgcctttgactgccagctccatgagttccacacagaagatgggaagcttgttggaaacatctcctggagaataaagaccccagacagtggtttctttactaggtcagccgtgcagaagttcgtgcaagatcctaaccaacctgctgttttctacaatcatgacaacgagtaccttcactatcaagacgactggtatatactgtcatcaaagatagagaacaaacctgaggactatatctttgtgtactaccgtgggcgtaacgatgcttgggatggatatggcggtgcggttgtgtacacaagaagcgcttctttacccaacaccattgtaccggagcttgaaaaggcagctaaaagcataggcagagagttcagcacgttcataaaaacggataacacttgcggtcctgagcctccgctggtggagagacttgagaagacggtggaggaaggggagaagattatagtcaaagaggttgaggagatagaagaggaggtagagaaggaagtggagaaagtcggcaagactgagatgactttgttccagagattagctgaagggtttgaagaactaaagcaagacgaggagaatttcttgagagggttgagtaaagaggagatggagttgttggatgagcttaaaatggaagctaatgaggttgagaaattattcggaaaagctctaccaatcagaaagttcaggtagagaaactatattattattactacacatacatacactgttgtaaaaacattcaaccatttcataaaattggatacacaaagaca

SEQ ID NO: 94 - DNA, 1894 bp, Medicago truncatula
aaaaaaataaaaataaaaaagtctagtccagttgcaagaagaagtaagaagagtccctagaaagttggaagagtcgacgtgtagaattgtggtggcagtgtgtttgcagtccacatacaccatgctcttattcttatctaatcttcttcgccgcttctcgtcccttctttctttcttctctttttcttttttcatattattattccactgcacctccaatttgaaaggtggaattgcttcattctaatatagatatagaatgtatatggcaacattgggtgcaaattcaaatattataattaaaaatgatataagatttcgccgaacaacaacaacaaggttggcagtgttcaaagtattgcctacacgattgcatttcttaagacatgatcgtaattctcgtggtttggtggtatgccaatgtcaacaccaccaccacaaagggaaaccagattcttcttcaaacatatcacggatattagaaaatggggtgaataggatgcttgttgttcttgaagattggagaaattcacgcataatccaattagttgccatactggtttctattttaatgattgttccatcagctgatgctgttgatgcactcaaaacttgtgcttgtttgctcaaggaatgcagggtagaattggctaagtgtcttgcaaacccatcatgtgctgccaacattgcttgtctccaaacttgcaacaatagaccggatgagactgaatgccaaattaaatgtggggacgtatttgaaaacaaagtggttgatgaattcaatgagtgcgctgtatcgaggaagaaatgtgtacctaagaaatctgatgtgggagaatttcctgttccaaacccggatgtccttgtgaagagctttaatattgcagattttagtggcaagtggttcatcactagtggcttaaatcctacatttgatgcctttgactgccaattacatgaatttcacacagaatcaaataaacttgttggtaatataacatggaggataccaactccagatggtggatttcttacaaggtcagcggtgcagagatttgttcaagatccttcaaatccaggaatcctctataatcatgataatgagtaccttaactatcaagatgactggtatgtcgtgtcatctcaaattgagaataaaccagatgactatatatttatatactaccgaggtagaaacgatgcatgggatggctatggtggtgccgttgtgtacacaaggagtgcagttttacctgaatctattattcctgaacttgatagagcggcaaagagtgtaggaagagactttagcaagttcatcagaacagataacacatgtggaccagagccttccattgtggaaaggctggagaaaaaggttgaggaaggagagaaaaccattgtgagggaagttgaagagttagaagaggaggtggagaaggatttggagaaggttggcaaaacagaaatgaccttgttacaaaggctggcagaagggtttaaagtgtttcaagaagatgaggaaaatttcttaagagggttatctaaagaagaaatggagatactggacagtctcaaattggaagctgaggaagtagaagagctctttggacgtgccttgccactaaggaaactaagataacttataaatatgagaaaaaatgttgtaacatattttttgatatacgtgtttaatattgaatgaattctcatgttggttctctgctgaataatatcaactcattctttataaatgctgtcctcgtatatgtcatagaagaagttggggttctcataagaattcatgttatcttatgcttaaaagaaggtatcaaagaatgtggcgctgtgatttttctgtttggattcttatatctttgcacgcccatcattg

SEQ ID NO: 95 - DNA, 2572 bp, Solanum lycopersicum
ccgtgcaccgattttgctaacgtgcgcgaccagtccgtcaacggggatatattacgtttatattttgattggtgattccgagttccgaccggtatatatcggtcggcggctgacttggtgaaacagaaatggccgaagtttctagattgattgctctgctttcttgttgtaccgtgctcagtgtgacggtctgttgctaaaggaattggattggatgactacgtgatcagcaagatgatgttgtgctgaactgacagccataactttaattattgtagttttttgatccctgtagtggagcgggaagtaatagtaatggaagttctccaatcacagttttgggagagctagggttgtattagaaccctaatttttgtgtttgtgtgtaatggttatggagaagaatgagactgtgaggacaggggatgtgtttattgacaggagtaaagttaggattttgctgtgtgatagcgatgccaaaagctcggaggaagtttttactctcttgtgcaaatgttcttatcaagtgatatcagtgaggtcacccagacaggtgattgatgcattgaatgcagaaggatctcatatcgatctcatcctttcagaagttgaccttcctatgtctaaaggatttaagatgttgaagcacattatgagggataagcagttgcgacacattccagtgatcatgatgtcatcgcaagatgaagtctctattgttattaagtgcctgaaatttggagccgctgactacctggtaaagcctctcagaactaatgagctattgaacttgtggacacacatgtggagaagaaggagaatgctcggactagtagagaagaacatcataaattatgacttcaatctggtcgtatcagagcccagtgatcccaacacaaatagcactactcttttctcggatgacaccgatgataagtcatggaagtgtgttaatccagaaatatgtccctctactatgctgcaagaagaagcaagatgcaagtctaatgcttcaactgatgccgctcccgtagagactgcggttgtagttccatttgagcatccacctaatgcaccaggaactgatgatcaaagcacaggagaaatttcactatttcctaagaagagtgaattgaagataggtgagtcttccgccttttctacatatgtcaagtcaagcttgccgaaaagcactggccaaagcccaacctctatccgtggaagtgtgcctcagcaattggggattgaagaaaacacttcattgggaggacatgaacacattgattctaacatacaagtcactggagatgtagaaagtcacttgcaaggtgatggctatgacaatattccaacgtctttttctatcgagaggtcatgtactccccctttatcacaggaatttccacatcactggaactcaaaaatggaggaattctctcaggtgcatatgcatctcaaaaatgaggctcagcatgatgtttccagttttcatgcacaaactccttatccctattatatttcaggagtaatgaatcaagtcatgatgccgtcaactcaaatatatcacgagagcctgcaacatctccataatcatgctaattcagctatgttgcctcaatacaattatatgccgcaatatcctcatatgcatggaatatcatcttatcctttctacccgatcggcatgtgcttacaaccaggtcaattgccagcagcacatccatggcattcgtttggcagttcatcttctgccgaaatcaaggtgagcaaagttgatcttagagagacagctttgatgaagttcagacagaagagaaaggaaagatgttttgacaagaagattaggtatattaaccggaagcaagtggcagagcagagaccacgtttgaggggacagtttgtaaggaaggtcaatggtgcgaatgtagatgtcaatgggcaaccttcttcagcaggcaatgacgatgttgaagaagaggaagtacaaatagaatatgtggattcttcacacgaggatgatctgtgaacatgtcagttgattgcaactttgtgatagttctcttgtattatcagaattccctgggacggagatgtactatagctcatggatgaatgcagaatgacgccttgatctacatgcacacaaatggcacaagcttgctttcagctgccaatcaaaggcatctgcggtctacatgcagcatcggggtgcaatgagattgacctgctgcctatccctttcattcctgtgattttgagcttaagtggatactcttgagagcaccctggacatgagatctcatgtgtggcaggtactatggttttgccatgttatgtccctggaagtaaaagttcttagatccatgttcgaacgagggaagtagagccacaatgcactttgacggtgtaaaaaagtaacgagatcactgtgacattccctaagggaagtttcatgaagtttaccatatgaaattaaatgtaatagactgatcatatagtaatcttctgacactttgttgtaatgattaagttcataatgcaacatgttattcagcagttggcgttaccaaac

SEQ ID NO: 96 - DNA, 2667 bp, Oryza sativa
acgcacatttgcccgcagcgccgcggcgcgcgaggctaccccgaccccgacgtggtctcctcccacccatacacccttccgcttccacgcccacacacagaacccaattcccctccctcctcctccacccgcccctccctcccacacacaccacaccaccaccaccaccacccacccctcgtatgcaattattcacgcccagtcgccgcctccaccgccgccgcctgctcgactcaccaccgcagggcggcctcctcctgccgcatgggtgactcgacggtggccggcgcgctggtgccatcggtgccgaagcaggagcaggcgccgtcgggggacgcgtccacggcggcgttggcggtggcgggggagggggaggaggatgcgggggcgcgcgcctccgcggggggcaacggggaggccgcggccgacagggacctcctctgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtcttgaagaaaatgtcagctcgccaaattgcgaagacagcatcaccgatagaccaatttcgatatgcactgcaacagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgagattcaaactgacctacagtacatcaaagaagatataagtgctgtggagagacataggttagaattatatcgaacaaaagaaaggtactctatgaagctccgcatgcttttggatgaacctgctgcatcaaagatgtggccctcacctatggataaacctagcggtctctttcctcccaactctcggggaccacttagtacatcaaatccagggggtttacagaataagaagcttgacttgaaaggtcaaattagtcatcaaggatttcaaaggagagatgttctcacttgctcggatcctcctagtgcccctattcaatcaggcaacgttattgctcggaagaggcgagttcaagctcagtttaacgagcttcaagaatactatcttcaaagacggcgtaccggagcacaatcacgtaggctggaggaaagagacatagtaacaataaataaagaaggttatcatgcaggacttgaggatttccagtctgtgctaacaacattcacacgatatagtcgcttgcgtgtaattgcggagctaagacatggagatctgtttcactctgcaaatattgtatcaagtatcgaatttgaccgtgatgatgagctatttgctactgctggagtctcaaagcgcatcaaagtcttcgagttttctacagttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccagagtgtgatggagtatgaagaacatgaaaagagagcatggagtgttgatttttctcgaacagaaccctcgatgctagtatctgggagtgatgattgcaaggtcaaagtgtggtgcacaaagcaagaagcaagtgccatcaatattgatatgaaggccaatatttgctctgtcaaatataatcctgggtcgagccactatgttgcagtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtaaggacattcagagggcacaagaatgaaaagaactttgttgggctgtctgtaaataacgagtacattgcctgcgggagtgaaacgaatgaggtttttgtttaccacaaggctatctcaaaacctgctgccaaccacagatttgtatcatctgatctcgatgatgcagatgatgatcctggctcttattttattagcgcagtctgctggaagagcgatagccctaccatgttaactgctaacagtcagggcaccattaaagttcttgtacttgctccttgatgaaatcagtggttttcatgagatccctagatagcttgtatatttgatgtatacagttgtttccttttcgtgccattataccccaaatgggagtggaggtattactgatctccaacatagggcgcaaagttttgaaggtaatcagctgacatagggtttcgagggctcgaaatgtgcatagtccagaattctcatgtataggtttaaagcagtcaagtaattgattatacatatgtaacgtgagaattgagaaatgaacatcaaataagcttgtttggttgcatatattggattggattttgggaactgggaagacaagctgtactgggctgatttcagcaacac

SEQ ID NO: 97 - DNA, 1422 bp, Zea mays
gcacctttgtgcgttcgcccatggagctatcgctgctgagcgggggagcatgggcagctcagcttttgcattcattccggccattgcaatcacgcaactgcctttaacgccgctacagctgcacgcacggcaccgcactggcctcatttcgggcaatacacacaggttgtctctttatggaatggagtccgttgtttgcactgcattaccaagtgataataacggatctcattcagcctctctatagcataggaccaagatcatagtgccgtccctgccggcagagagcaagatggtctcacactcactctcagcatggctcatgtcctcggcgccgccgccggcgtggttcgccgccctggtcgccgtgggcatgtacacggcgctgcggtccgccgccaccttcctggcgtggctccaccgcgcgttcctgcggccaggccgggacctggcggggcggtacgggacgtgggcggtggtgaccggggccacggacggcatcgggcgcgcggtggcgctggagctggcgcgcgcggggctccacctcgtgctggtggggcggagccccgacaagctggcgcgggtggcgaaggagctcgcggccgccgcgccggcgtgcaaggtgcggagcgtggcgttcgacctcgccgtgaccggggacgccgcgcggcgcggggtggcgcgggtggcggccgccgtggagggccgcgacgtgggcgtgctcgtcaacaacgccggcgcgacgtacccgtgcgccgcctacttccacgaggtggagggccccgtgtgggaggccgtgctgcgggtcaacgtcgaggccgccacgcggatcacgcgcgccctgctgccggcgatggcggccaggggcaggggcgccgtcgtcaacgtgggctccggctccagcgtcgtcgtcccggccttcccgctctacgccgtctacgcggccagcaaagcgtacgtcgaccagttttctcgaagcctgagtgtggaatacaaacaatacggcgtagacgtgcagtgccagatacccctgtacgtcgctaccaagatgtcgcccgtgaagggcgcgtctccgttcataccgtcgcccgaggagtacgccagggccgcccttcgctgcgttggctacgaggcgaggtgcgtcccgtactggcgccactcggtccagtggttcttggcgtccctagcgccggacgctgctctcaaccactggcgcctccaaactggcctccagaagaggaacgagacgaaggctctgctcgggggaaaagactgcagttagattaataatagtagtaataattgttgtatagattggattattatagccttccagacagtactcgcgatcgtgcacttatttatctgtcagctctattccgtacatacgcgaacccatgggggcggagtccagtttattaa

SEQ ID NO: 98 - DNA, 1274 bp, Zea mays
tccacccaacgacgtcaccggcgcacaggcacagccacccggacccggcaccgctcgtcccactcccggcctcctcctctcctccttaaatacgcgccgcgccgagctctagtatagccaaccgtttccaccatcgaccatccatcacctcacctccaagctccaaggaatctaccctcgctcttctcacaaagcgctgcagcggacagcagcgcagcacgagagagccgagcgcgaggtgcaggaccgcaaaacagaggcgaagcgaaggacctaacctacgtagcaccgctcagctccgctccgcggcgatgggtcaccgccgccacgaggggtcgtgccgctgcgagctctgcggcgcgcccgcggccgtgcactgcgcggcggacgaggctttcctctgcgccgcctgcgacgccaaggtgcacggcgccaacttcctcgcgtcgcggcaccgccgcacgcgcctccgcctcgcggccgcgggacccccgccgccggacgacgaggccgggtacgggtccgccgcgagctcctgcgtgtccacggccgactcggcgccgcggccgaggcgtggggcccgcgcgccggccgggagcgtgcgccccgaggccgtgctcgaggcctgggccaagcggatggggctcggggcgggggcgcgccggcgcgtcccgccgcgcgtcgccgtggccgccgctctctggtgggaggcggcggggcggggcggggtcgggggccacgcccaggcgctgcggcggctggaggcgtgcgcgcacgtgccggcgaggctcgtgctggccgtcgccgcgtccctcgcgcgcgcgcgcgcgctcaggcggagggccgccacggacgccgtggagggctgggacgagtgcgcgtgggcggggcccaagtccagcccgtcacgctcttgatcctctccctcttcctttgtcgtgctgctgctactgctcgctgaagaaacaacacgaggagcatatggacatggcggccggctggagagaggaagagggacatgctttgcgatttgtggaccttgttcgtctcatttattagtttgcccaaggtacaagaaaacttgtggttaggaataggggagagagcatgcataaagtggggtcttaatgtaggtcagtgtttttcattagagacttgtgagctaactgtggctctccaaccacggcggtacgtgcaagtgcaatggttcccagcagtgtatattttcagcagctctgtaattcaagtttcatttcttctctcactcagctcct

SEQ ID NO: 99 - DNA, 1615 bp, Solanum lycopersicum
atcatttgcaacactaattcaattttccgtaaaacttgataaccggtgtagcgacaagtaatcccaagttccaaagtgcgccgatatgttttttccataggatgggaagggtaaggctaagcgtgaagcgattggagagtaatagtaacaggcaatccacttattgcaaacgaagatgtggaatcctgaagaaagcccaggagatatctgtgctatgtgatatagacattatccttcttttgttttccccaactggaaaaccaacgctatttcaaggcggacaaagatgccatcatgaacttgaattggatgtgtcaattgacaaccgttgttcctatgaagagcctttactcctccagaagatgctcttcaattttgatgaaataattgcaaaatttgctcaattgactcctcaagaaagggcaaaaaggaagttggagagccttgaagtaagtctgatattcatcaccactatgtgttctcctcttgctatgctttgttgttacttcataatccaagtgaaagtaataacaatgctaatggttacactccagacattgaggaagacttttaagaagcttgacaacgatataggcgtgccagagtttctagatgctagtgatccatcagttgaagaattgcatagtcaagtgaaacttttgcaatctcggcttactgatgtagaaatgagactcaagtatagtcctgcattcctttttgtagctagatcatatgggcttaatgaatcgtgtcatttttcaccttgtattaaccttactcctttgcttcgtcgtagctggtggagcaatcctgataatataaataaagtggaagatttcgcgctgatggagtctgcactaagggagtcacttaatgcagttcatgttcggaagctccagaagacgacgcatttgcatcttttgatgaacagtgaactagatgggaatactcatcagtggcatccagaaaataaaatcctgcacatgccattccctcagactccaaacattctaccccaggaaaatatgggatactttggagataattcagttgctgaatcttctcatgttctgggctctggagaagttgatcaagctagacaggccacaactgcaattctagataacggtgtcttgaatgatctaagtagtatagcatgcttgagacagcaactaagtgagcagtattcatacaaccccaatgaggatcttgatctgcttgaaaggaacatgttggatcctcagagtgatgccaatttgaaaggatatttgatggattatgaatttcaaagaaacttaaacctaacaaggtctgtggattcagtcaattatagtgcagtcaatgccgttgctgttccagattttgatgaaaaatcatatgcacagccagcaacttccagtgattagacattcgagataagtcacactactcgagtagagaataatctgtgatcgtgggtgaggtttacaggtgcagtggttgttgatagataattatgtttgaatatgtatagttgttttgctttgcgaaccccgacacccctcatggtgaaagtaggataggagcttgttcatatatgagatgtgaataaaagaccagtttcactttgctggga

SEQ ID NO: 100 - DNA, 2582 bp, Sorghum bicolor
cgggcggagaggcgacgtgtggacgtcaggcctcgcgccggatagcgtgccgactggcgatccagcgagagaagcccctcccccgtgcgcccaccgattccacgacaaccccgcactcactgacagctccgccgcactccgtgtggagcccatccatcagtgatgcaaacccgtgggtttgtgtagctgtgagagctttttttatgcgtcgctgcctcgccttcccttcttccgctccacctccaccgcctccatgccgctgccaagcgctgctggaaagttttaaaactcacggggagctcggagactccacgacgaccgccgcttctctcggccattgtcgagggagagagcgcgcgagcgacctaggtcgtcagtcggcttcgggtgttcggcgccgtcagctagctatccgcgacgatgggcctgcgcgtggccgccaccgcgccagctgcggccggcgtgcgcgtgctcggcggcggcgccgcgagcgtgaagccgcgaccgtgggtggcgctcggaggcaggagacgcctctccgtgcggatgtccgtcgccactaccgagaccaccacctccgccgccgccgccgtgggcgcctcggaggaccaggcgctggaggctaggaactccaggacggtggtagcggtcatcctcggcggtggcgccgggaccaggctgttcccgctgaccaagcgcagggccaagcccgcggtgccaattggcggcgcgtacaggctgatcgacgtgccgatgagcaactgcataaacagtgggatcaacaaggtgtacatcctcacgcagttcaactcgcaatccctcaaccgccacctctccagggcctacgattgcaccaatggcgtggccttcggagacggattcgtcgaggttctagcagcaacccagaggcctggatcggagggaaagaggtggtttcagggtactgctgatgcagttcggcagttcgactggcttttcgatgatgcaaaatctaaagacattgatgatgtgttgattctttctggtgaccatctctaccgaatggactacatggactttgttcagagtcatcggcaaagaggtgcaggcatcagcatctgttgtttgccaattgatgacagccgggcatctgattttggcctaatgaagatagacgacactgcaagagttatttcattcagtgagaagccaaaaggagacgaattaaaggcaatgcaagttgacactacagtgctaggcttatcaaaggaggaagcagaaaagaaaccttacatagcttcaatgggggtctatatttttaagaaagacatacttctaaaccttttaagatggcgttttcccactgcaaatgattttggttctgaaataattcctgctgcagcaaaagaaatcaatgtaaaggcttatcttttcaatgattactgggaagatattggaactattaagtccttctttgaggcaaaccttgctcttgctgaacagcctccaaggttcagtttctatgacgctgacaaaccaatgtacacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgacgcggaaagaagagaattgcttgcagaaggaaatgttcctattgggatcggagagaatacaacgattcaaaagtgtatcatagacaagaatgcgaggatagggaagaatgtgataatctccaattctgaaggtgtagtggaagctgatagaacctccgaaggcttctacatccgaaccggcgtcactgtcgtactgaagaactcgataattgctgatggattggtcatatgaactgaaaaggtctcacaaggctggtatttgcggcagaaacaaccataggagttcttttgtagttgtacaataagatgctgtataccagtcaagaggttctgcttgtctatacaagagaacttttgtctacaaatcttgtctcaccatgcgtatttgactcaaacaacgttgcagatctttttacgagaacacgtctgtggacgagacgtgttttttcattattaagaggaaaccaagatacaagcttcaggcacaaatcactagctctggtgcagtgacgcgaggagcgtttgcactaggtttgcgactgctgaactgccctcgccggaggaccagctccctagaaaagttgctgatggattggtcatatgaactgaaaaggtctcacagcgttgcagatcatgaatatttgtcggtttcattttttctttcttggacatttacacaaaccttttcaatttttctttcttaattaacaccaaaagctttaattctaatcagtatgcaaccgagtttcaagttcattgtgccaaattcaatgtgcttgatcatgtattcacatcataggttgcatgtttgaaactgctttaccgatgattttgaaagtagaggtagtctgcctggtccagatactttgc

SEQ ID NO: 101 - DNA, 1776 bp, Sorghum bicolor
ccagagtccagatcccgtatattctccttgtgcccaactgaagtgactgcgtcctctcgatctccctcagtctctcttgtgcctttgggggaacgtgtcgtcgtcgatcggaggtcgagatggcgccgccgtcgagcatgtcgacggagaaggaggagaaggccatcgacgactggctgcccatcacctcgtccaggaatgccaagtggtggtactccgccttccacaacgtcacggccatggtcggcgccggcgtgctcagcctgccctacgccatgtccgagctcggatggggccccggcgttgtggccatgctcctgtcgtgggtgatcaccctgtacacgctgtggcagatggtcgagatgcacgagtgcgtcccggggaagcgcttcgaccgctaccacgagctgggccagcacgccttcggcgacaagctgggcctctggatcgtcgtcccgcagcagctcatcgtggaggtcggcgtctgcatcgtctacatggtcaccggcggcaagtccttcgagaagtgctacgccgtctcctgcccggactgcaagcccctcaacaccagctcctggatcatgatcttcgccgccatccacctgctcctctcgcagctcccaaacttcaactccatcacgctcgtctccctcgccgccgcagtcatgtcgctcagctactctacgatcgcatgggcggcgtcggcgcacaaggggcggcacgccgccgtggattacagcatgaaggcgtccacggcgacggggcagacgttcaattttctgagcgcgctgggggacgtggcgttcgcgtacgcggggcacaacgtggtgctggagatccaggccaccatcccgtccacgcccgacaagccgtccaagaagcccatgtggcagggcgtcgtcctcgcctacatcgtcgtcgccatctgctacctccccgtggcgttcgtcggctactacgtcttcggcaatgccgtcgacgacaacatcctcatcacactcgagaagccacgctggctcatcgccatggctaacatcttcgtcgtcgtccacgtcatcggcagctaccagatctacgccatgcccgtgtttgacatgctcgagacgttcctggtgaagaaactccggttcaggccaggcctgcctctccgtttgatagcgcgctcactctatgttgtgttcacagctctggttggcatcgccgtgccgttcttcggggggttgctagggttctttggtggctttgcatttgcgccgacaacctactatcttccctgcatcctatggctcaagattaagaagccaaagacgtttagcctctcatggttcatcaactggttttgcatcatagttggcgtgctcctgacggtgtttgcacccattggtggcctccggtcgatcatcgtcaacgcctccacctacaagttcttctcgtgattgattattccattcgttacccaagagtttattagatatctagctagataaacataagcaagtagctagaggtttaatcgatctacttatctgtgtcaaaaggcaaggatattattatatgccatatggtgtgtgtgtgtgtgtgtgtgtgtgtgtgtgtgtgtgtgtgtgtgtgttcaatttgcattggatatggatggatgatggcactcggtttaatttgtgctatggctaagtcgatctcattcgagtttcgataggatagtgattaattttgccttcgatcattttccagatttcaggtcatactgcctgtgtttgggctgataatcataccctg

SEQ ID NO: 102 - DNA, 1753 bp, Hordeum vulgare
tagagctgcaggcgtgccgcggtccgccttcttccgcgccgccgccgccgccgccatcgccgttcccgttctacaaaccgacctccaaattttctgggtgtgcaccggcacgccaggcacaacatctggatccgcttctgcctgccattcagctcgctgggatggcgacgcagctgccgtgcttcacgcagctcaccccgccgtcacctggatggagaaacgaagccgggagtctcggtgctacatctgggagggcgttggtcaggagcactccatttccgggtcactctcacttcaggtgccgcgcaagcccacgcagcgctaactcgtttcagaagaaagactccttcctggaccttcatccggaggtgtccctgctccgaggcgagcagaacgacgagtctattaacccaaggaaagcttcttctgatgggagcacgttggaggggctgggggtgccgccgagccaggacgattacaacgctgccaagatcaaggtcgttggggtcgggggtgggggttcaaatgctgtcaacaggatgattgagtactccatgaatggtgtcgagttttggatcgtgaacaccgatgtacaggcgataaggatgtcccctgtgcattcccagaacaggctgcagattgggcaggagctcactcggggtttgggtgcgggtggaaaccctgatatcgggatgaatgccgccaaggagagctgtgagtccatagaggaagcacttcatggtgctgacatggtttttgtcacggctggaatgggtgggggaaccggaactggaggtgcccctgtaattgctggaatcgctaagtccatgggtatactgacagtgggtattgtcacaacacccttttcatttgaggggaggaggcgcgcagttcaggctcaagaaggaattgcagccttgagaaatagtgtggacactctcattgtcatcccaaacgacaagctgttgtctgctgtttctccaaacactcctgtcatggaagcattcaacttggctgatgatattctttggcaaggaattcgtggtatctctgatatcatcacggttcctgggctggtgaatgttgattttgctgatgtgcgagctataatgcaaaatgcagggtcatctttgatgggtatagggactgcaacaggtaagtcaagagcaagagacgctgctcttaatgccattcagtcaccactgctagatattggaattgagagggctacaggcatcgtgtggaatatcactggaggaactgatttgactttgtttgaggtaaatgctgcagctgaagtaatctacgatctcgttgatccaaatgccaacctgatatttggttctgtcatagacccatcactcaatggccaggtcagcataacattgatcgctactggctttaaacggcaggatgaagcagaaggtcgcaccgcaaagggtggccagcaaatgcaaggagacaacggtcgagatccatcttccacaggtggaagcaaggtggagattcctgagttccttcggaagagaggaccgtctcgcttcctgcgaatttgactcttccccaggatccctttctcagatatgcctgatgatacttgcccctcgtagattagatgccctcttgtaagataccagaccggtagagtctagttgttttccgtagagttttttttcccatagttttgtttgatctttctgttctttatcttggaatgttactgccaataatgtgtagctgtgagcatgccagt

SEQ ID NO: 103 - DNA, 801 bp, Gossypium hirsutum
ggaattcaagagcttagcctttctcatagttcaattccttgccagctttgaaccatggagttccctaatctagacccagaaagctcttcccagaaaaaaatgggaagaggcaaaatcgagattaagcggatcgagaacaccactaatcgacaagttaccttctgcaagcgccgcaatggactgctcaaaaaggcctatgaattatctgttctttgtgatgctgaggtggctctcatagtcttctccagccgtggccgtctctatgaatatgctaacaacagtgtgagagcaacaattgagagatacaagaaagcatgctcagatgcaacaactccagggtctgtggctgaagccaacattcagttctaccagcaagaagccaccaaactccgacgacaaattcgtgatgttcagaacatgaacaggcatatccttggagaggctctgagctcattgacctttaaggaactcaagaaccttgaaggcaggctggagaaaggcatttgtagaatcagatccaaaaagaacgaattactgtttgcagaaattggattcatgcaaaagagggaagttgaactgcagaacgataacatgtacctgcgagcaaaaatagctgaaaatgaaagagcgcaacaacaatcaaaccagctgatgcaagcagcctcctcctacaatcgcaactttctgccagtaaacctgctggaacccagtaataatgattactccaaccaagaccaaactcctcttcaacttgtataagcttctctcttccacctccatctattcaagctgacatgctag

SEQ ID NO: 104 - DNA, 580 bp, Gossypium raimondii
ttcaagcggctatgttttccagaggaacaaatgcaccatctggcatgggagtggctgatcacagcaaaagcacttacctggagctgcaaagaaagaaggtgtttcgatacgtgatctttaagatcgatgagaagaaaaaggaggtagttgttgaaaaaacaggaggtccatcagagaactatgatgatttcactgcttcattgcctgagaatgattgccgctatgcagtttacgactttgattttgtgacttctgagaattgtcagaagagcaagatcttttttattgcatggtcaccgtctgtttcaaggatccgtgccaagatgctgtatgcaacatccaaggaaaggttcataagggaattagagggcattcattacgaaatccaggcaactgacccaactgagatggatctcgaggtgattagagagcgtgcaagttaaaagtgttgaaatcccgtcatcaatgccgcatgcttaggaaactcctgtgtttaattattgttaaataacaactaggaaggctgattaggagctcagggtgttcaaaacatgtcgggactttatgctcctcattccac

SEQ ID NO: 105 - DNA, 2667 bp, Sorghum bicolor
attcaaagccctattccagaccctgaatcttacacaagccgcagtcgtccgtgatggaggcgttcagtgggttctacgtggacgagaaggcggcgcgggtggagaacatcttcctcgagttcctgaagcgattcaaggagtcggatggcgcgggggagccgttctacgaggtggagatggaggcgatgcggtcacgggagtccactaccatgtacgtagactttgagcacgtcatgcgcttcaacgacgtcctccagaaggccatctccgaggagtacctcaggtttgaaccatgcttaaggaatgcatgcaagaggtttgtgttggagcaccgggctggcgagaaccgtgccccaatcatctcagatgatagtcccaacaaggatatcaacattgccttctataacatcccgatgctgaaaaaactgagagagcttgggacagccgaaattggtaagctcacagcagtaatgggtgttgtgacacggacaagtgaagtgcggcctgaactattgcaaggcaccttcaaatgccttgactgtgggaatgttgtaaagaatgtggagcagcagttcaagtacactgagccgataatatgcgttaatgcaacttgccagaaccgaacaaaatgggcccttctccgccaggaaagcaaattcacagattggcagcgggtcagaatgcaggagacatcaaaagagatacctgctgggtcgcttcctcgttcccttgatgtcattctgcggcatgagattgttgagaaggctagagctggggacacggttatatttactggaactgttgttgcagttcctgatgttatggcactaacttcacctggtgaacgagcagagtgtcgcagggaaggtcctcagcgaaaaaatggaggtgttcaagaaggtgtaaagggcttgaagtcccttggagttagggatctctcttatcgcctcgcttttgtagcaaattcagtgcaggtcgcagatggcaggagagaagtggacatcagggatcgtgacacagatggcgatgacagtgagagacagaaattcacagaagaagaggaagatgaggttgttaggatgaggaacactcctgatttctttaataagatagttgatagcatatgccctaccgtctttggtcatcaagaaattaagagggcagtgcttcttatgcttttgggtggtgttcataagataacacatgaagggatcaacctgagaggtgacatcaatgtctgtattgttggcgacccaagctgtgcaaagtcccagtttctaaagtatactgctggtattgttccaagatctgtttacacatcagggaagtcgtcatctgctgctggtctgacagcaactgttgctaaagaaccagagactggtgaattctgtattgaggctggtgccctgatgttagctgataatggcatttgttgtatcgatgaatttgataaaatggacattaaggatcaggtcgctatacatgaagcaatggaacagcaaacaattagcataaccaaagcaggaatacaggcaactttgaatgcacgaacatcaattttagctgcagcaaatccgacaggtggccgttatgacaagtcaaaaccacttaagtacaatgtggcattgcccccagctattctttcaagatttgatctggtctacatcatgattgatgaacctgatgaaaacactgactaccacattgctcatcacattgtaagagtccatcagaaacgtgaagaagcacttgcccctgcatttagcacagcacaactgaagcgttatatttcttttgcaaagtctttgaaacctcagctgagttcagaagcaaagaaagttctggtggagtcgtatgttacccttcgtagaggggacagtactcctggaactagggttgcttacaggatgacagttcgacaattggaagcattgattcggctgtccgaagctattgctcgaagccatttagaaagagttgttctcccagctcatgtccgcctggcagttaaattgctcaagacatccatcatcagtgttgaatcaagtgaagttgatctctctgacttccaagatgctgaagatggaacaaatgtaccttctgagaatgatgctggacagccagctgaagaagatactgctcctcagcagcagggtgcagaaaatgaccaagcagcggacaacggtaagaagaaattggtaataactgaagaacacttccagagagttactcaagctttggttatgagactaaggcagcatgaagagtcagtcaagaaagatggcgatggtttggctggcatgaagcaaggggatcttatcatttggtatgttgagcagcagaatgccaaaggggcatatagttctacagcagaggtgaaggaagaagtgaagtgtatcaaggccattatagagagacttatacagcgggaaggccatcttatagtcattgatgaaggcacagcagccccagccgaagatggcagtggcgtaagaagaacatcagagagcagaatattggcagttaacccgaactatgttgttgattagcaacagctttgtaacatgctgctaactcaagtcagctgatgtggttaacgaacataagctgtagttcgggtgatgtgcctgttgtgccctggcattgttgtaccatctccgtcactga

SEQ ID NO: 106 - DNA, 2318 bp, Oryza sativa
ggctaatggagggcttccacaacctcctcgcccgccccaactcggcgccattcgccttctccctccctcgcccgcgcccgcgcccgcgccgcaggccgccgcctcacccctccgctgcctgccgcgccgcgagccgctgggccgaacgcctcttcgccgacttccacctcctccccaccgccgcgccctccgacccgccgtccccggccccggccccggccgccgcgccctccgcctcccccttcgtcccgctcttccccgacgccgccgaacgctccctcccgctccaagtcgatttctacaaggttctaggggcagagccacatttccttggcgatggcatcaggagggcgttcgaggcacggatagccaagccaccgcagtatggctacagcacggatgctcttgttggtcgtcgacaaatgctgcagattgcccatgacactctcatgaaccagaactcccgcactcagtatgatcgtgcgctttctgagaaccgtgaagaagctctcaccatggatattgcttgggacaaggttccaggtgtgttgtgtgcgcttcaggaggctggggaggcacttgctgtgcttgtaactggagaacagttgcttctggatcggccacccaagcgcttcaagcaggacgtggtgctagcgatggctctggcttatgtggatctatcaagggatgctatggcagcaagccctccagatgtaattggctgctgcgaggtgctcgagagggctctcaagctcttgcaggaagatggagcaagcaatctcgcacctgatctgctttcacagattgatgaaactctcgaggagattacacctcgctgtgtattggagcttctctcccttcctattgacacagagcatcataagaagcgccaagaagggcttcaaggtgcgagaaacattttgtggagcgttggcagaggaggtattgctaccgttggaggaggattttctcgtgaagccttcatgaacgaggcttttttgaggatgacatcaattgaacagatggatttcttttcaaaaacaccgaatagcattcctcctgaatggtttgaaatttacaatgtagcacttgcacatgtcgctcaagcaattataagtaaaaggccacaattcatcatgatggcggatgatctttttgaacaactccagaagttcaacataggttctcattatgcttatgataatgagatggaccttgcattggaaagggcattctgctcattgctagtcggagatgttagcaagtgcagaatgtggcttggaattgataatgagtcttcaccatacagagaccccaaaattctagagtttattgtgaccaactctagcatcagtgaagagaatgatcttcttccagggctgtgcaagcttttggagacttggcttatctttgaggtttttcctaggagcagagatactcggggcatgcagttcagacttggagattactacgatgatccagaagttttaagctacctagaaaggatggagggtggtggtgcttctcatttggctgctgctgctgctattgcaaaacttggtgctcaagctacagctgcacttggtactgtgaaatcaaatgctattcaagcgttcaacaaggtttttccattgatagaacagttagacaggtcagccatggaaaatactaaagatggccctgggggatatcttgaaaattttgaccaggaaaatgcacctgctcatgattcgagaaatgccgccttgaagattatctctgctggcgcactgtttgcactgttggcagtaattggggccaaatatttgcctcgtaagaggcccctttctgctattaggagtgagcatggatctgtggcagttgctaatagtgtcgactctactgatgatcctgcactagatgaagatccagtacatattcctagaatggatgcgaagctggcagaagatattgttcgcaagtggcagagtatcaaatctaaggccttgggaccagaacattcggttgcatcattgcaagaggttcttgatggcaacatgctaaaggtgtggactgaccgagcagcggagattgagcgtcatgggtggttctgggagtatacactatccgatgtgacgattgatagcatcactatctccctagatggtcgacgagcgactgtggaggctacgattgatgaggcaggccaacttactgatgttactgagcccagaaacaatgattcatatgacacaaaatacactacccggtatgagatggccttctccaagctaggagggtggaagataacggaaggagcagtcctcaagtcgtagtga

SEQ ID NO: 107 - DNA, 1722 bp, Gossypium hirsutum
cagatatgaagcgaactgccacgaagaagaataggcggcctcgtgcgacgaaaacgccggcggtcaacgattcgtcacgtcatgcgttaagtcagcgggatcagcggcgagaaggagaaggagaagacgatgaagaacaaaaaaggcttctcggctcgttaatggaagccttcggttcgatctctctagaagaagccacgtcagcttataaccaagccgacggtgatttggacaaagcggccgagattctatccaatttgatcgataacggtaacaatagtgaagatcccgatccgtcaacgagctcgatatcgagtggctcgtcatcgtcaggttcgtccgggttcggtttttccgaaacgagttgcttacaaaatctgaatagcagaaggggacgtagcagatggggaaaacagcagaagcgagtggtagcgtcaacggggacggtttcgaccgtcctcgggaaagattacgttaggtcaagcccatggcgagacccggctgcagtggcaccggcgaaatcggtgttggcgacggaagaagcggaacagtttttatgctcaatgcttggggaagagtgtgaacttagcatggctgttgttagagatgttttgtgtcagtgtgggtacaatgttgagaaggctttggatgcattacttgatttatctgcttcctcctatgaaaaatccaagagttttaatgacaatttgaacagtagacaagatacaggattcgtaattgaatgtgcagacaatttaacagataggacatctgactgcatatctaagttgttggaaagcgaacttcaagatagtatatggtcagccggatatggtcacaggaattactctaaggttcttgctagttctgaagctatgcaaccaccttgcccaaggaataatgtgtcgaatctccctcaggaggtcctggattctttatttaaaatccccaagagttctgagcatgaaccaagcactatgagttggaggaatgtagtaaagaagatgcagttgttgggaccacctattgatttttgtccatctactgatgcagaacctcagcaggatatctatgctaagggagatgaatatcacaaatttagagagtgtgccaaagaacattgggattccatgagatcttattatcagaaggctgctactgcatattcaaagggagagttggagtatgcagcttatctttctgatcagggaaagatacagactaaattggcacgggaagcagatgaaagggcaagccagaatatatttaaagccaggaacaaagcctttgaaaatgtgataacaattgatttgcatgggcaacatgtcaaacaagcgatgaaacttttaaaactacaccttctatttggaatacatgttccttctgttcaaactctgagggttattactggctgtggaacacatggtatggggaagtcaaaactgaaacagtcggtcactaagcttcttgaaaaggaaggcattcagtggcgtgaagaaaaccgtggaactgtactaatcaagcttggcggatacagagagttcagctttttagaatccaatagtgacacggagtaaattaattatctaataccaggtttgcatcatttaccatctgtttgtacaagacaaggatgtaatgtaacaaggttaattagtggttcaaaaacagggatcagatgtttatatgtacattactagaaatccttgtaccctttcctcc

SEQ ID NO: 108 - DNA, 1050 bp, Setaria italica
ctactgctgctgcttccaccagcgggagtgggcgggatgaaggtcaccgtcgtgtcccggagcggccgggaggtcgtcaagggcggcatcgacctcaaggactcggccaaggtcgcggatctgcaggaggccatccatgccaggactaagaagtattatcctgctagacagcggctcaccctccctcttcaacctggaaaaggtggaaagccagttgtcctcaatccaaaagccagcctatcagaatactgtgagaagggttccgggtcactgactgtagtcttcaaagatttaggcccacaagtctactacagcacactcttcttctttgagtacttgggtcctcttatcatctaccccatgttctattatctgcctgtctacaaattcttcgggtacgagggggaacgggtcatccaccctgtccagacctatgccatgtactactggtgcttccactacttcaagaggatcatggagacattcttcgtgcaccgtttcagccacgcgacatcacctctgtcaaacgtcttcaggaactgtgcctactactggactttcggcgcttacatcgcttactactgcaaccacccgctctacaccccagtgagtgaactgcagatgaagattgggtttggcttcgggatcatctgccagattgcaaacttctactgccacatcctgctgaggaacctcagaagcccaagtggtagcggtggttaccagatccctcgtggtttcttgttcaacattgtgacctgcgccaactacaccaccgagatctaccagtgggttgggttcaacattgccactcagactgtagcaggctacatcttcctcgtggtggctgcaagcatcatgaccaactgggcgctaggcaagcacagccgcttgaagaagctgtttgatggcaaggacgggaggccgaagtatcctcgccgctgggtgattctccctccattcctgtgaagaggtgatgattgtgattgctgctggcctgtcacgaatgcaatacctactgcgttccagtgttcagaagaagttccatag

SEQ ID NO: 109 - DNA, 779 bp, Setaria italica
tgccggatgtctggacacaatcacaccacagggagctgtagagggcggagagcagaggccggcggagccatggcgaccactctctcgttatcttctcccctcttcctcgcagctccggccagagctagagatgtggccttgtgcggagtgccttcagctagtacatcatggagcactgcaaatgctctaagcaagggctacatggttagagtacatgagcgggggaaacagcgacgcatggcaatagtatccgtgattggaagaaagtcaacgactagagaaacagttgtccctgaccccgactataggttaccaattgctatacttgggattgctggtgcttttgcatatgcagacaatcttctagctgctgcacctgtaggactgctgggactgctgcttttgttccagactacaagagtgaggttcgtctttgataatgaggccctggaggtgaaagttggagaccagttgcaggagtcaggtgaaaatgtgtttgttggtggcaagaaccgttggaagtactcaacgttcataaattgggagctatggtggccacaatttcctatcttggtttacttcaaagagagccaaacaaaacctgaggggcagatccacttcttcccagtgatattcaatggccgacaactctatgatgtcatggtggagcgtgctggaccctcaaagacgagcggccctaagtagaagtagtgctgatcttccctcaagatgatgagctgagttccatggcgtgctgctgtggcaccagttgacgctcc

SEQ ID NO: 110 - DNA, 1088 bp, Setaria italica
ctcttgcactctgccgaaggtcataatgagcctgcttctgtccacgccgagacaagatggccttgctagctgcagatgcggaggcgcgatggccaacgtccccaacgccggcgccggcgtggttcaccctcctgttggctctcggcctccttgtcttggtccggtccgcggccaccttcctcgcatggctccaccgcgcgttcctgcggccgggccgagacctggccaggcggtacgggacgtgggcggtggtgacgggcgccacggacggcatcggccgcgcggtggcgctggatctcgcgcgccggggtctccacctcgtcctcgtggggcggagccccgacaagctggcgcgggtcgggaaggaggtcctggccgccgcgccgtcgtgcaaggtgcggagcgtggcgttcgacctcgcctcgacgggggacgacgcgcggcacggggtggcgcgggtggcggccgccgtggaggggcgggacgtaggggtcctcgtcaacaacgccggcgcgacgtacccgtgtgcggcctacttccacgaggtgggggatcccgtgtgggaggccgtggtgcgggtgaacgtggaagcggcgacgcggatcacgcgcgccgtcgtgccgctgatggcggcgaggggaaggggcgccgtcgtcaacgtggggtcgggctcctccgtcgtggtgccggcgttcccgctctatgctgtctacgcggcgagcaaagcgtatgttgatcaattttctcgaagcttaagtgttgagtacaaacaatatggagtagacgtgcaatgccagatccctctgtatgtcgctactaagatgtcccctgtcaagggtgattccccattcataccatcacctgaggagtacgccaaggctgctcttcgttgcattggctacgaggcaaggtgcgtcccgtattggcgccactcggtccagtggttcttggcatcgttagttccagatgctgctctcaaccagtggcgcctccaaattggcatccggaaaagaaacgagacgaataaggctctggctggagtgaagaaagtcctcggctaaactgttgtacagatagtaacggagtag

SEQ ID NO: 111 - DNA, 3276 bp, Zea mays
cacccgcctattagtctccaacgcggacgcccccgcccccggctgcactcgtcgcgccatcctctggtgcctggtctccgggattctgcaggttcagttgagtagaccagtgtttgagcaagggttgaacataggaatgcgctgtttgttcctagagtagcagttcaaaatccaaacccgcccgcgatgaaaagcggcgtcatggttctcggtgtcggcagccctgaagaggcccctgaccgcaacgatgcggagccacggcgcgatatgggccaatcgcagatgcaggtcggtggccccgttgttctcaaccgatcagctgagctcgggtcaggtgattttatggctatcgatgacgctccagttcaagcaccatcgggccagccggcggcggcaaaacatcagtctcctgctgctctgacggacaccatcatggaggtgcagaagcaactgaagcgaaagagggcttctaataacccagtgattgctgccgcggacaaggacgctctcgctgccgggtgccggcaagagcttgagggtctcttccagttttacaaggaggtttctgaccgtaaggtgcagcttgacggtggtaacctgtccgtcaacggaatggttggctgcttgcttgaggagagcagccttgggctgaccaagttggtggacgggatatatgaaaagttgaagggattggatggtgtgtctgtggcttcagtccgtggctctgtgctgctcgttgggcagaggatgatgtacgggaaatcatccttggacgctgatgtgttggaagatgatacagagtcggctctttggtgctgggagacaagagatctgaaattgatgcctgtgaaagcacgcagtgttcttagtacacggaggtctgtcagaaagaaaatccatgagagaatcactgccatctattcaactctatcggttcttgaaaacccaggagtttacgtccaagtaaatgatctaaaaaaggcatcattaagattaaacaaatcgctgaacctggaagggatcagatcaatggtggaaagagtggcacaaaagaacctagaacggggtgtgaaagttgctggatcagcaattaaggaattgaagcaagagacagaaaaaaatgaccaaaatcttagaagacttgaggatactagcgtctctgagctgcagaatggaaattcgcctgataatgaaaaagaggttcaaaaggcacaaaaacaggtggagaaggaaataaagcgccaggagaaagaagaagctcggatgaaaaaactgcaaaagaaacagcaagaagatgtcctaagagaacagaagagacgtgaaaaggaggaagctgaagctaagaaacaacaaaagaagcaggaggaggaagcactgaaagaacagaagcgtcgtgaaaaggaagaagctgaaatgaagaaacaacataaaaaacagcaagaggaagctgagaaagaacagaagcgccttgagaaggaagctgcacaactcaagaagcaactagccgtgcaaaagcaagcttctatgatgcaaagatttttcaaaagtaagaaagacaatggaaaacttcaaaaatctggagagaacaactcagctgatggtccgtgcaatgacaacaaagagaccgtaccatcaaccacatcaaaaattgattattcattgtctcaacaagagagctgggttttggaggatctttggaggttgcagatcactggttggaagaagctatctagccacaataggtcctccagatggggtgtaagatgcaaacccaagacgaaagcatttaatgaactgaagcttcagaaatcctcagatgatatggttgatgaaatactttctactccaaataaagatggctgccacacttcaagtcaggaaaatgaacatgctacgcttgaaagtgacattgacatgctacaagctattgaggtgcaatgtcatgacaccaataaccctaaacctctgcaaactagattaattagaaggaaacttctgcaatttgacaaaagtaacaggccagcgtattatggatcctggaggaagaaaagtgttgttattggtccaaggtgtccacttaagatggatcctaatcttgactatgaggttgatagtgatgatgaatgggaagaggaggatcctggtgagagtctttctgactgtgagaaggataatgatgaatttatggaagaagattccaaaattacagatgaagaagatgaagatagctttgttgtgcctgatggctatctatcggacaatgagggaatacaaattgaaagcctattggatgataaagatgaggaagccagtagctcaccaactggtcagtgtgcagaagttgaagagttcaggtctctactgcgccaacaaagagtcctgaacattttaaccgagcaagctctccggaagagccaacctcttattatatccaacctaaatcatgaaaaagctgaattactgactgccgaagacctcaaggggacagcaaagatcgaacagctatgtttgcaagttctttcaatgcacatctgtccaggaggcgcagttgttgatgtgcctctaactgacagctcatctgcaactgttgaagaaattaaccagcccaatccgaaggatggttctcctggggctgcatctgctataccagaaacagatctgccagaaattgtccaggtgataagatcatgtcgagatggtatccataaggtggtggaattactgcagcacaagtttccaaatgtttcaaagactcagctgaatcgcaaagtgagagagatatctgactttgttgacaatcattggaaggtaaagaaagaggtgcttgacaagctgggattggattcgtcaccagtgaaatccaagaagaataaaagcatagccatgtacttctcgaagagatgtttacctcctgaagaggctgtcaatgctctgtctgcttctcctgagttgcggttgaaatctagaaccattcaaaatggcaatggtggcaccgaagctcctcagatcaatctgttcccttcaaagcagtagagtttgtaacaggacaccctgaaagtcggatcaggtataaatgaggctatgcacccaggtgagcacaaagctcagaggtccatgtccctcccatggctatggaagtgcgtgcaacttggttttgcatatggatgatctggatcgattatgtttccagtgacatgttgtaattttagccagaaagtaggtttgttcatgaaggacattcagttcaaatgtttgacctattgttaaggcaaggca

SEQ ID NO: 112 - DNA, 1406 bp, Oryza sativa
ccgcgatgcagagcctcctcctccccaccttcgccgcggcctccgccgcccccccgcggagggggcgcgtgcctcccgccggtcgcgcctcggtctccgtgcgcgcgtccgcgtccgcggcggcggtggcgccgaggagggagacggatccgaggaagagggtggtgatcacggggatggggctggtgtccgtgttcgggaacgacgtcgacgcctactacgaccgcctcctcgccggggagagcgggattggccccatcgaccgcttcgacgcctccaacttccccacccgcttcgccggccagatccggggcttctcctccgagggctacatcgacggcaagaacgaccgccgcctcgacgactgcctccgctactgcatcgtcagcggcaagaaggccctcgagtccgccggcctcgccctcggctccaaatccatggacaagattgaaaagactcgggctggtgtacttgtgggcaccggtatgggtggtcttacagtgttctctgatggtgttcagaatcttattgagaaggggcacagaaagataactccattcttcattccgtatgccataacaaacatgggatctgcccttcttggaatggacattggtttcatgggtccaaactactccatctcaactgcatgtgctacctcgaactactgtttctatgctgcagcaaaccatattcgcagaggcgaagccgatgtgatgattgctggtggcactgaagccgcaattattccgattggtgtcggtgggtttgtcgcgtgtagagcactttcacagaggaacgatgaccccaaaacagcatcaagaccttgggaccaagaccgtgatggttttgtcatgggtgaaggagctggagtactggtcatggagagcctagaacatgcaatgaagcgtgacgcaccaataattgcggagtatttaggaggtgccgtgaactgtgatgcttaccatatgactgacccgagatctgatggccttggtgtttcgtcttgcattaagcaaagtcttgcagatgctggcgttgcaccggaggaggtcaactacataaatgctcatgcaacgtccaccctagctggtgatctggcagaggtgaacgccattaggcaagtcttcaaggatccatcagagattaaaataaatgcaaccaagtccatgattggacattgccttggtgcggctggtggcttggaagccattgcaactgttaaagctataaccactggatgggtccatccaagcataaaccagtttaacccggagccagctgttgaatttgacacggtacctaatgtaaaaaagcaacatgaagtgaatgttggtatctcgaattcctttggatttggtggacacaattcagttgtagtatttgcaccatttaagccttaataa

SEQ ID NO: 113 - DNA, 2827 bp, Oryza sativa
aaccctagcgagctctctctctcgcagatggcgccgccgacgccctctccccggccggggccgccgccgacgccgcaggcggccatgacgaccccgctcaagacgcccgcatccaagcaccgcctccacttcccggccatgacgcccaggaacggcggcggcgggggcgccgcggcgggcggcacggagcacccggtggaggtgatcggccgcatccggaacctcgccgcgggggcgggcggcgcgtcggcgctggagatcgcgggcgggggcacggccgtgcgcgtccgcggcgacgccggcgggtgccgcgacttcaccctcgacggggtctcggtctccgaggaggaggatctggaggggttctaccgccgcttcgtgcggtcgcggatcgagggggtgcgggtgggcgccaagtgcaccgtcatggtgtacggccccacgggctccgggaagagccacaccatgttcggctgcgccaagcagcccgggatcgtgtaccgcgctctccgggatatactggaaggaggaggaggaggaggtgtctctggtggtgggggtgaaggcgatggccgcggcgaggatgacgccgggttcgggatggggctgttcgtgcaggttgccgtgctcgagatctacaacgaggagatctacgatttgctcgtggggagcggagcgaatgctaaaggaaacgcccccaaggcgaggctagaagtaatggggaagaaagccaagaatgcaacctacatatctggaaatgaagccgggaagatatcaagagaagttgcaaaagtggaaaagaggcgtattgtcaagagcacgctttgtaatgagaggagttcccggagccactgcatgataattttggatgttccatcggtggggggacggctcatgcttgtggatatggctggttctgagaacatagaagcagcaggccaaactggatttgaagccaaaatgcagactgcaaagattaaccaagggaacacggctttgaaacgagtggttgagtctattgctaatggtgactcccatgtcccatttcgagacagcaagctcacaatgctcttgcaggattcatttgaggacgacaaatcaaaaatcttgatgattctctgtgcaagtcctgacccaaaggaattgcacaagacagtttctacattggagtatggtgctaaagcgaagtgcattatccgtgctgcccacgctgcaaccccaagggacaaaatgagctctgaagagtcatctacaatgctcaattcaagaattgttgcgatgaaccagttcatctacaatctccagaaagagaacaagctaagggagaaagagcgcaatgaggcccagagtgtgctaaggaaaaaagaagaggagcttgcacagctcagggcgaagctcaagctgattgaaggtcagggagcagctgcaaaagaggaagagatcaactcaaaggtcatggagaagacccagagtttgaggactgagctcatgaagatggaagagaaaatgcttaggcagcagcaagaactccttgctttgcaacagcgactgaaggaggttgagtgtgaaaagcctgtgcagcaggatatcatcggaggtagattgttggcacgtctgtcagagatgtcggctagggcggatcagtccatgtcaatggatatgtccattgattttgatatgggagatcagccagctgcgcaagacgtgaaggtgatcaaggaggatactcgccagcagggccagatatggagccaagcaaatactgcaggctcttgcaccagcgctgtggagcaagaagatgctgtgagactgtccgggtacccagaaaaggtggtcctgagcactgtctttgaggagggagatgaagaagaagataaagacagtggcgttgaagaggaagtgtgcaaggaagttgtcgaagagagctatgtaatgcaacagccccttgcagagcctggagaccctgccacaaggaataaccggattcagaacattttcaggctttgtgggaatcaccgagaattagccaagaaggtccagtcaccagcaaagaaggcgttcggagatgagaacagtgagcctgcgaagcaaacattcggagatgagaacaagcagcagcctgcaaagctagtatttggtgatgagaatatgcagcctgcaaagcaagtgtttggagatgagaacaagaacccttcagcatggggagcgatagaacctccaatgtgcgacgtcagagtgaccgacagtccagcatcctcgcagctttcacctatcgtctgccaagttgtggatgatgccaagttgccggcgtcggagcagctgaaatcatgcaatgctttggaggcaaatgatgagaataaggagaacaatgcttctggacaagacggcctgcttgaaatctacatcaaatgggagtccgggcatctgataaaaggtctgaaattgctgagcaactcgtgtctttctgacctgagaaagctcttggaggctcacttcgaagaagcaggcagcaagcagcaacaattcaccttcctccttctcggggatccttctggcgcaccggtgtccagagagaaggaagcaggggtgccgataagcaagctgccaagctgcaacaaccagccgaacagctacctagcctgcttgcgcgctgtcaagaagcagccggcgacggagcagatgccgttcagcccactggagagcaagctgaattcggcactgaacgacgtgcacctcgccgccctctcgccgaaggtcaacccaatgagccctaactacatccgtgagctcagagcttgagctcttccaacctgaagaagatcggtta

SEQ ID NO: 114 - DNA, 3665 bp, Oryza sativa
cgaagatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacccagccgctcttcgtctccggaggtgatgattacaagattaaggtgtggaattacaagacacaccgctgcctcttcacacttcatgggcaccttgactacattcgcaccgtgcaattccaccacgagtacccatggatagtaagtgctagtgatgaccagacaatccggatatggaactggcagtcacgcacatgtgtggctgtgctgactggacataaccactatgtcatgtgcgcatcattccatcccaaggaggatctggttgtgtccgcatcactggatcagactgtccgtgtatgggatattggtgctttgaggaagaagacggtgtcacctgcggatgacatcctgcgcctcacccagatgaacactgatctgtttggaggtgttgatgcagttgtaaaatatgtgttggaagggcatgaccgtggggtgaactgggcgtcatttcaccccacattgccgctcattgtttctggggcagatgaccggcaagtgaagctatggagaatgaatgacaccaaggcttgggaagttgatactttgcgggggcacatgaataatgtgtcctgcgtgatgttccatgcaaagcaagacatcattgtgtccaactcagaggacaaaagcattcgtgtctgggatgccaccaagcgaactggtattcaaacattcaggcgggaacatgatcgtttctggattcttgctgcccaccctgagatgaatcttcttgccgctggtcatgacaatggtatgattgtgtttaaattagagagggaacgtccagctttctctgtgagtggtgatactgtcttctatgtgaaggaccgttttcttcggttctttgaatactccacacagaaggaggttcagttggctccaataagaagacctggatcggtcagcttgaatcagtcacccaggacactgtcgtatagtccaactgaaaatgccgtcctgatttgctctgatgtggatggaggctcctatgaactctatatagttccgaaggattctgctggcaggactgattatttgcaggaggcaaagaagggagctggtgggtcagctgtttttgttgcacgcaacaggtttgcagtgctcgagaagagtagcaatcaagttctggtgaagaatcttaagaatgaaattgtaaagaaaagccctcttcctattgcgatggatgcaatttattatgctgggactggtaacttgctgtgcaaagctgaagaccgagtgaccatctttgatctgcagcaaaggttaattcttggcgagctccaggcacctgctgttaaatatgttgtttggtcgagtgatatggaatctattgcattgctgagcaagcatgcggtggttatagcaaacaagaagcttgtccatcgttgtacgctccatgaaaccatccgtgtgaaaagtggtgcctgggatgagaatggtgtgtttatttacactactttgaaccatatcaagtattgtcttcccaatggagatagtgggatcattaaaacccttgacgttcctatttacataacaagggctattgggaataatattttctgcctagatcgtgatggaaagaacaagctgatcacagttgatgcttctgaatacattttcaagctggcccttctacggaaacgatacgatcatgtgatgagtatgattaagaattcccagctgtgtgggcaggctgtgatttcttatttgcaacagaaaggctttccagaagttgccctccactttgtgaaagatgagaagacaagatttaacctagctcttgagagtggtaacatccaaattgcagttgcttctgccaaagagattgatgacaaagatcactggtaccggttgggaatcgaggccctgaggcagggaaacgttggtattgtggaatatgcgtaccaacgtacaaagaattttgagaggcttgctttcctatatcttattactggttacatggacaaggtggggttcatgtgcaaaattgctggacagaacaataacctgatgggtcaattccacaatgctctgtatcttggtgatgctatgaagagagttgagatcctagagaatgctggacagctacctcttgcttatattactgctgccacccatggactcacagaaattgctgataggcttgctgctgaattgggtgaaaatattccttctctacctgaaggaaaaactcgctctcttttgatcccccctgcacctctcacagccagtggtgattggccattgcttagggtgatgcgtggtatctttgagggtggactggatgctactgggaaggctgaacttgaggaagacgatgaagctgctggtgctgactggggtgatgaggacctggatatggttgatgcaagcgaagcgatggcgaatggtggtgatggttttgatgctgaggagggtgaagcaaatgaggaggatggtgaggaaggtggctgggacctagaagacctggaacttccgcctgaagcagagacccctaaaaacgccggtaatgcactctcagtggtctttgttgctcctcctccaggcatgcctgtcagccagatttggactcagaaatcttctcttgctggggagcacgcagcagcaggaaactttgacactgcaatgagattgcttagccgtcaattgggcatcaaaaactttgctcctctcaagcccctatttctcgatctgcacatgggcagccactcatatcttcgtgcacttgcaactgcccccattattccggttgctgttgagaaaggttggagtgagtctgcaagtcctaatgtgagaggccctcctgcacttgttttcaccttctcacaaatggaagacagactcaaggctgcctacaaggccaccacagaaggtaagttcccagaagccctgaggcagttccttaacatcttgcataccatccctcttatcgtggtagactcgaggagggaagtggatgaagtgaaagagttgatcgagattgtgagggagtatgtccttggcctgaggatggaacttaagaggaaggaattgagagatgatgtcaaccgccaacaagaattggcagcttacttcactaactgcaagcttcagagagttcatatgaggcttgtgcttggaagtgctatgggtttgtgctacaagcaaaagaactttgctactgcagagcactttgcaaggatgctgctggagaacaaccctaatgagagccaagcaaagagggcccgacaggtgcagcaacagtgcagtggaaagaaggatagctgtgagctgaactatgactacagaaatccatttgtcgtctgtggtgccacatatgttccaatttaccgtggccagaaggatgtttcctgcccgtactgtggatcccggtttgttccttccatcgaagggcagctttgtaccatatgtgagcttgctgtggttggtgcagatgcttcaggcctcctctgctcccctacgcagttgagataataa

SEQ ID NO: 115 - DNA, 1050 bp, Sorghum bicolor
gctcgatggcgttcaactaccacgaccacgcgctggcgatggaccccgccgcggttggggccgcggccgcgaaccctagctttgtctccgggggtggtggtggtggtggcgtggccggtggggggcccggctgggagagggagaaggcggccatcgcggcgcacccgctgtacgagcgcctgctcgaggcgcacgtcgcctgcctccgcgtcgccacccccgtcgaccagctcccgcgcatcgacgcccagatagcggccaggcccccgcccatggcggccgccgcagcggcggcggcggcgggcggagcgcactcgggaggcgaggagctcgacctcttcatgacgcattatgtgctgctactctgttcattcaaggagcaactccagcagcatgtgcgtgttcatgcgatggaagcagtcatggcttgctgggagcttgaacaaactttacaaagccttacaggggcatctcctggtgagggcactggggcaactatgtctgatgatgaagacaatcaggtagacagtgagagcaacatgtttgatggaaatgaggggtcagatggaatgggatttggaccattaatgttgactgagggtgagagatccttagttgagcgtgtccggcaggagctaaagcatgagcttaagcaggggtacagagacaaacttgtggatattcgggaagagatattgcggaagcgaagagctgggaaactccctggcgacactgcttctaccttaaaagcttggtggcaagctcattctaagtggccatacccaactgaggaagacaaggctcgactggtgcaggaaacagggctacaactgaagcagatcaataactggtttatcaaccagcgtaagcggaactggcacaacaatccggcgtcatcctcgtcggacaaaagcaagagaaaaaggagcactgcaggtgatggcaacgcagaacaatcctggtagtgcactgttggggaacaaattatatgtaaataataatgcttctactgtgaagagtgtcatcatatttgttgctccagaaacgacc

SEQ ID NO: 116 - DNA, 2307 bp, Sorghum bicolor
gcagtgcagagtaccacatacccattgcccagcgagtcacagtcagcgcaggccgtttccctttggcttatatactgcacaggcgcgcgagctctgccactcacccggccagagaagcggcaaaacagagagccgccgccgacgagaacgacggggaggagctttagtttggcgcgcgcgcgatggtgttcgcgtccgggtccggcgccgccggcggcccgcaggtgctgacggcgcggttcgtgcggcaggtggtgctgggccgttggttcatggtgttcgcatgcctgctcatcctgtcggcgtccggggcgacgtacatcttcagcatctactccaaggtgctcaagtcgtcgctggggtacgaccagcgcacgctcaacacgctctccttcttcaaggacctgggcgccaacgtgggcgtcatctcgggcctcatcaacgaggtcacgccgccgtgggtggtgctcgccatgggcgccgccatgaaccttgtgggctacctcatgatctacctcgccatcgacgggcgcaccgccaggccacccgtctggctcatgtgcatctacatctgcgttggggccaactcccagtctttcgccaacaccggcgcgctcgtcacctgcgtcaagaacttcccggaggaccgcggcgtcgtgctcggcatcctcaagggattcgtcggccttagcggcgctatcttcacgcagctctacctcgccatctacggcgacgacgccaagtcgctcgtgctgctcatcgcctggctccccgccgccgtctccatcctcttcgtgcacaccgtccgcatcatgccgtacccgcgcgccagccgacgccggggcgcatcggcggccaccagcaacgacgccttcttctgcttcctctacatctccatcgcgctcgcggcctacctcctcgtcatgatcgtcgtgcagaggcaggtcaacttctcgcacgccgcctactcggtctcggccgcggcgctgctcctcgtcctgttcctgccgctcgccgtcgtcgtcaagcaggagtacaagatccagaaggagctggaggagtccctccgcgagccccccacggtgaccgtggagaaaccagcctcgctgcagctggcagcagcaccacctcagagccagagcatgacgacgggaacgacagaggccgccgccgagccgtcgaggccgtcgtccagctccagcagctgcctggggtcttgccttcggcacatgttcagcccgccggcgcagggggaggactacaccatcctgcaggcgctggtgagcgtggacatgctggtgctgttcctggccaccatctgcggcgtgggcggcacgctgacggcgatcgacaacatgggtcagatcgggcagtcgctggggtacccggccaagagcatcaacaccttcgtctccctcatcagcatctggaactacgccggtcgcgtcaccgccgggttcgcgtcggaggtgttcctggcgcggtacaagttcccgcggccgctgatgctgacgctggtgctcctgctctcgtgcgtcggccacctgctgatcgccttcggcgtgccgcagtcgctctacgtgtcctccgtggtgatcggcttctgcttcggcgcgcagtggccgctgctgttcgccatcatctccgaggtgttcgggctcaagtactactccacgctctacaacttcgggtccgtggccagccccatcggcgcctacgtgctcaacgtccgcgtcgcgggggcgctctacgacgtcgaggccgccaagcagcacggcgggtccctggtgggcgccggcgacaagacctgcatcggcgtggagtgcttccgcaagtcgttcctcatcatcaccgccgccacggtcgccggcgcgctcgtgtcgctggtgctggtgtggcggacatggaacttctacaagggcgacatctacgccaagttcagggaaagcgcggacgccgccgaggcggaggcggaggatctgaagcggcccaaggagacggcggaggcggagagcgaggttaacgggaggaagcagtaggcgcatagggcaccgcgccgcgccgcacgcaggcgctggtgtccatggcggccgccggccgggggcctggcgcttgcgttgactcggtcgaggtcgaggaagccacactcacactgtcgtcacacagtgagctaacgctcggttttgacttggtatacgtgtcaagatctccgttcgttgctgttcttgctctggagctcaagttggatggcaatgggcagtgaagtgaaggccgcagcagcagtctgatgagtctctgagtgagagc

SEQ ID NO: 117 - DNA, 459 bp, Sorghum bicolor
gacgccgaaaattcgaaggggaaggggaaagcaaagcaaatggcggaggccgagggaaaagcaaagcaaatggcggagggcccgagcaagatcgaatccatgaggaagtgggtcgtcgaccacaagctccgagccgtaggttgcctctggctaggtgggatcagcagttcgatcgcctacaactggtcgcggcccaatatgaagactagcgtcaagatcatccacgcaaggttgcatgcacaaggtctaaccctagctgcattagttggttctgcatgcgtggagtactatgacaataagtatggttcttctgggccaaaggtggacaaatacacaagccaatacctggcccatgcgcataaagattaagatctccatgttggttcctgcataccggattaattttggactcaactctgggtgctcatgacccgcccgtcgatgctgggtgtttattct

SEQ ID NO: 118 - DNA, 1792 bp, Hordeum vulgare
atccagcttcggcttgccgttgccatggaggcggccgccgagctggcgctgcgcctgcgggccgccgccaacggccggctggccgggcaggagccgctcctcctcgtcgccgcgccgctgctcgcgctcctcgccgcgcgcgccgtccacgccgccgccgcccacgtcgccgaccgcggcctccgcgccgtcctcatcaccctcgccatggccgcgctcaagttggtgccgggggttggcggatacatcgccgcccagaagagcaaggttgttgagcagttgcagtcaggaagtgcatccagcaagaagaacctgcgaaccgagctgcccgccatcggggatcccgacggggtaataggcgagctccaggcgctcaaggacaaggatgtgagatggcagggcaaatgctccggcaccgtttatatcgctgggagcgagtccgaaggccatttttcacttataaacaaggcctactctatgttttcacacacaaatccactgcatcaggatgtattcaagagtgtggcacagctagaggctgaagtagtcgcaatgacagcagctttgcttggcagcaaagaaaaggcgtctggtggacaaatttgtggcaatatgacgtcaggtggaacagaaagcatattattggctgtcaaaacatcacgtgattatatgcagtcaaagagaggaatcacaaagcctgaaatgataattgctgaatcagctcattctgcctatgacaaagctgctcaatatttcaatattaaagtgcggcgtgtacctgtgaataaagaatttcttgcagatgtaaaaggattcaaacggtgcataaatggaaacaccataatgatggttggatctgcaccaggatttccccatggtttaattgatcccatcgaggaacttggggagttggcttcacagtatggtatttgcttgcatgttgatctatgccttggtggcttcgtattgcctttcgcccgtaaacttgggtaccctattcctccttttgatttttctgtcgaaggtgttacgtcgatctcaacagatgttcataagtacgggctagccccaaaaggcaccagcactgtcctatacaggaatcatgaaattagaaagcaccaatttgttgctgtgactgaatggactggtgggctctatgtttcccctaccatggctggaagcaggccaggtgggctaatcgcaggagcttgggctgcgatgatgtctcttggattgaatggttatttggaaagtacgggtcaaatcatggaagtctcaaagaagatacaaaaaggaattgatgatatctcaggtttatttgtgattgggaaaccagacatgactgtcgtggcctttgggtcggacgcggtcgacatatttgaggtgaatgacataatgtcatcaaaaggatggcacctcaatgctcttcagagacccaacagtttgcacatctgcgtgacacttcaacacacggcaatttacgaggaattcctcaaggatctcgaggattctgtaaacaccgtgaaagcgaatccagggcctatcagcggggggatggctccgatctacggggcggctgggaagatgccggatagaggcacggtcaaggagttacttgtagagttcatggacagctcttgctaaccattgactataccccattggttatctctctgtaccatgtatgtacaacccgcagtgacagtgttgtgtgatcttacatatttagtttggctgcaaaactgaaggcacacattgcctacaatatagacatgtatctatgtatcagcta

SEQ ID NO: 119 - DNA, 1514 bp, Triticum aestivum
cggcgatgaacaccaccgagggaaagccgggcgccgctgcggtggaggagatggcgcgggaggcggcggcgtggtgcgctatgcacgggctcgtcgtcggggaccgcgcggacccgagatcaggaacagttcctggggttgggttggtccacgctccaatctccctgctcccgtcgcgtctcccggagtccttctggagccaggcgtgcgagctggccccgcttttcaacgagctcgtggatcgtgttagcttggatggggatttcttgcaggattccttgtccaaaacaaggcaggttgatgatttcacttctaggctcttagatattcacaggaagatgatggatgcaaacaaggaggagaatattcgactggggctgcaccgatcagattatatgctggattcagaaaccaattctcttctccaaatagagctcaacactatttcagtatcttttcctgggctttgttctatagtgactgagcttcacaggaccttgatcaatcagtatggaaatttattatgtctagatgccaaaagggttcctggaaatgatgcaagccgtcaatttgctaaagcattggccaaagcatgggatgagtttaatgttgacagtgctgtagttatgatgattgttcagcccgaagaaagaaatatgtatgaccaatactggattgtcaaatatttgagggaatcacatggcgtaacaactattaggaaaaccttgtcagaggtggaggctgaaggccaggttctccctgatggaactcttgttgtaaatgacaggaaggtcgctgtggtgtattttagagctggctatacaccaaacgattatccttcagaagcagaatggagtgcaaggcttttgatggaacaatcatctgctgtgaagtgtccttcaatatcatatcatttagtcgggaccaagaagattcaacaagaactagcaaaacctaacgtgcttgaaaggtttcttgaaaataaggaggaaatcgccaagctccgtcaatgctttgcagggctatggagcttggatgatgaagaggttgtcaaatctgcgattgaaaaccctgacttgtttgtcttgaagcctcaacgtgaaggcggagggaacaacatatacggtcttgatgtgcgagaggctctgatcagactcaagaaggaaggaggagatgctctctcagcctacatactgatgcaaagaatctttcccaaagcatctctcgctagtctggtccgtggtggtgtttgccatgaggccctcacagtatctgagcttgggatgtatggagcctacctgcggaacaaagataaggtgatcatcaatgacaagtgtggttacttgatgcgaacaaaagtttcttcttcggatgaaggcggtgttgctgcgggatttgctgttttggacagcttatacctgaccgacaagtgatatcacctcaggaatagcagctacaaatccgaaccagcattgacctaccatggatttagcattctgttgcatcggtcgtaa

SEQ ID NO: 120 - DNA, 1339 bp, Solanum lycopersicum
atcccaattcccatttctccttatttttccttcttcaccattccccccctcttaattctctttactcataattcataaaaaaacatggctactgcagtaagtgctgcagtttctcttccttcatccaagtccacctccttttcctctagaaactccatcatctctacagacaaaatcaacttcaacaaggtgcccttgtactacagaaatgtgtctggtgctagtagattagtttctatcagagcccaagtgaccactgaggctcctgctaaagttgagaagatttcaaagaaacaggaggaaggtgtgattgtcaataaattcaggccaaaggaaccttatgttggtagatgtctgctaaacactaagatcactggtgatgatgcacctggtgaaacttggcatatggttttcagcactgagggagaggtcccatatagagaaggacaatccattggggtaattgctgatggtgttgatgccaatgggaagcctcacaagcttagattgtactcaattgctagcagtgcccttggtgacttcggtgactccaaaactgtttccctgtgtgtcaagaggcttgtgtacaccaatgacaaaggggaagaagttaaaggagtttgctcaaacttcttatgtgacttgaagcctggagcagaggtcaagattactggacctgtaggcaaagaaatgctcatgcctaaagatccaaatgccaccgttataatgcttgccactggaactggaattgctcctttccgttcattcctgtggaaaatgttctttgagaaacacgaggattacaagttcaacggtacagcatggcttttcttgggtgttcccaccagcagctcactactttacaaggaggaattcgagaaaatgaaggagaaggccccagaaaacttcagattggactttgctgtgagcagagagcaaacgaacgaaaagggtgaaaagatgtacattcaaaccagaatggctcaatatgctgaagaactatggactttgctccaaaaagacaacaccttcatctacatgtgtggactcaagggcatggagcagggaattgatgaaattatgtcttcacttgcagaaagagatggtattgtctgggcggactacaagaagcaattgaagaaggcagagcaatggaatgttgaagtttactaaatatttttacttttctttgtacaaatatgagccaacattatgcttctctccccctgcatccatgtagataggtaaatttttcctttgaaattttaatttcattttttgggacttccctttttaaatctatgtgtatcttttaatgaatcggtgtattggcatttgt

SEQ ID NO: 121 - DNA, 3111 bp, Phaseolus vulgaris
gcttgtcaccttcgacaagtttgttgtactattgttgtttgtacatctggtgagagtaagtactcatcaacaaggccaacatgccagtgaggcagatgaaagaaagctcggagcaacaccttgtgatcaaaccccatttgcagaatcctatgaatccagccaagaagacaaccaaagctgcccaaaatggcaaaggtccaccgccactagaaaacgatagccaagctttccctcacgcaaagaacaagggaagaagaaggggaagaggtggcagaaaacccgatcaaggagatgttatgatgaggcctagatgcagaccatgcacagcaacacttacaagtagtgcaaatgggaatgttgaaaatgatttcgtctctgatatgggttttcccacttcaagcaagtctttgagctttgctcgtaggcctggatatggacaagttgggacaaaatgcattgtgaaggctaaccacttctttgcagagttaccagacaaggacttgaaccaatatgatgttactattaccccagaagtgtcttctaaaacagtaaacaggtctatcatagcagagctggtgaggctctataaagagtctgacttggggatgagacttccagcatatgatggcagaaaaagtctgtacacagcagggcagcttccctttgcttggagagagtttaagattaagcttgtagatgaagaggaaggagttaatggccccaaaagggaaagagagtacagggtggcgatcaaatttgttgctcgggcaaacttgcatcacttgggccagttcctagctggtaagcgtgctgatgcaccccaagaggcacttcaaatcctggacattgtactaagagagctggcaactaagaggtattgcccaattggaaggtccttcttttcacctgatattagaacaccacaacggcttggagaaggattagagtcatggtgtggattttaccagagcataaggcctactcaaatgggcctttccctcaatattgatatggcatcggctgcatttattgagccacttccagtagtggaatttgttgggcagctattagggaaagatgtgatgtcaaggccattgtcagatgctgatcgcattaagattaagaaagcccttagaggagttaaagttgaagtaacacatagagggagtgtgagaagaaaatatcgtgtttcagggttgacttctcaaccaacaagggaactggtgttccctgttgatgagaactcaactatgaaatcagtagttgaatactttcaagagatgtatggcttcactattcaatatactcaccttccttgccttcaagtgggaaaccaaaagaaggccaactatttacctatggaggcctgcaaaattgttgaggggcaacgttatacaaaaagattgaatgagaagcaaatcactgctctattgaaagttacttgccagagacctcgtgatcgtgaaaatgacattttacggaccattcaacaaaatgcttatgatcaagatccgtatgcaaaggaatttggaattaaaatcagtgaaaaactagcttctgttgaagcacgaattcttccagccccttggcttaaatatcacgaaagtgggaaagaaaagaactgcttaccccaagttggtcaatggaatatgatgaacaagaaaatgattaatggaatgactgttaaccggtgggcatgcataaatttttcacggagtgtgcaagatagtgttgctcgcaccttttgtaacgagcttgctcaaatgtgtcaagtatctggcatggaatttaatccagagcctgttatccccatatacaatgccaagcctgaacaggtggagaaagctttgaaacatgtgtaccatgtgtcagcgagcaaaactaaaggaaaggaattggagcttttgttagcaatattgccagacaataacgggtctctctatggtgatctaaagcgaatttgtgaaactgaccttggcttaatttcacaatgctgtctgacaaagcatgtcttcaaaatcactaaacagtacttagctaacgtgtctctgaagatcaatgtgaagatgggaggtagaaatactgtacttcttgatgctgtgagctgcagaataccgttggtcagtgacataccaaccataattttcggagcagatgtaacccaccctgaaaacggcgaagactcgagcccctcaattgcagctgtagtagcatctcaggactggcctgaagtaacaaaatacgccggtttagtgtgcgctcaagctcatcggcaggaacttatacaagacttgtacaaaacttggcacgaccctgttcgtggcacagtcagtggaggcatgatccgagatttactggtttccttcagaaaggcaacaggacaaaagccgctacgaattatattttacagggatggtgtcagcgaagggcaattttaccaagttttactttatgagttggatgcgattcggaaggcatgtgcttccttagaaccaaattaccagcctccagtaactttcatagtcgtgcaaaaaagacatcatactcggctattcgcaaacaaccacagggatagaagcagtacagataggagtgggaatatattgcctgggactgttgttgattccaaaatctgccatccaacagaatttgatttttatctctgcagtcatgctggcatccagggtactagtaggccagctcattatcatgttctgtgggatgaaaacaacttcacagcagatggaattcagtctttgacaaacaatctttgttatacatatgcaaggtgtacacgctcagtatctgttgttcccccagcatattatgcacatttagcagcctttcgagcccgtttctacatggaaccagatatgcaagagaatgggtctacaggtgagggtaatggtcatagttcgaaaggaacacgagcagctggagattatagtgtgaagccattgccagacttgaaagaaaatgtgaagagagtgatgttttactgttagatgcttagtggcctggccttggtagaaggatataggcaagtgaatattcatggaaagcaatgattagtttgtacattagtcgtgtaggtatccatgattacagttc

SEQ ID NO: 122 - DNA, 972 bp, Arabidopsis thaliana
tggctcatggcgtcatcatctgatcacacggcgaagataatcgacggcaaggcgattgctcataccatcagatcagagatcgccgaggaagttcgcggtctatctgagaaacacggcaaggtcccaggactagctgtagttattgttgggagccgaaaggattcacagacctatgtgaatacgaagaggaaagcgtgcgctgaggttgggattaagtcatttgacgtgggcctaccagaggaagtttctgaagctgatcttattagcaaagttcatgaactaaattcaaatccggatgtccatggcatattagttcaactcccattgccgaaacatattaatgaggagcatatattgggtgcaatcagcattgataaagatgtcgatggcttccatcctttgaatattggtaagctagccatgaaaggcagagaacccctcttccttccttgcaccccaaagggatgtttggaactcctagctagaagcggcgtaaagataaaggggcaacgagcagttgttgtaggtcggagtaacattgttggtttgcccgtttcacttcttttgctcaaggctgatgctactgtcacaactgtacattctcacaccaaggatcctgaggctatcatacgggaagctgacattgttattgctgcatgcggacaagcccacatgattaagggcaactggataaagccaggggctgcagtaattgatgttggaactaatgcagtcagcgacccgagcaagaaatcaggataccggttggttggagatgttgatttcgcagaagcttcaaaagttgcaggtttcataactccggtccctggtggtgtaggcccaatgacagtggcaatgcttctcaggaacaccgtagacggtgccaagcgtgtctttggcgagtaaaacaatctactgtatgtaataaagaaaccaagagtttctccattctgtaattgtgtacttggctag

SEQ ID NO: 123 - DNA, 1401 bp, Brassica juncea
gcggagctttcagtctcaagtatgtcagtatctacacattgtttcacttcaccttgtcacgaccgtacgagattcttctcaggcgatgatggtaataaacttctaagaaagagaatcaaaggcactttcttggtcaagatcttaccttcttcccaaaacgcttatctaagagtaactgcgaaatcctcacgacccttatctggattcaggtcaggaatctctaagggagtatttgatattgtggcattgacctcaaagaatgcactcaaagagctgagtactccactgatgctaaagctcgtgggtgttgtagcttgcgcgtttctcatagttccatctgcagatgctgttgatgcgctaaagacttgtgcatgcttacttaaggggtgcaggatagaactcgcaaagtgcattgccaacccttcctgtgcagccaatgtcgcttgcctccagacctgtaacaaccgtccagatgaaaccgagtgccagataaaatgcggagatctgttcgagaacagtgtagtcgacgagttcaacgaatgcgccgtgtcaagaaaaaaatgcgttcctagaaaatctgacctcggagagtttccagcccctgacccttctgttctcgtcaagaacttcaacgtcaaggactttgacggcaagtggtacattacaagtggcttgaatccaacctttgacgcctttgactgtcagctccatgagttccacacggaagacggcaagcttgttggaaacatctcgtggagaataaaaaccccagacagtggcttcttcactagatcaaccgtacagaagttcgtgcaagatcctaaccagcctgctgttttctacaatcatgacaacgagtaccttcactatcaagacgactggtatatactgtcatcaaagatagagaacaaacctgaggactatatctttgtgtactaccgtgggcgtaacgatgcttgggatggatatggaggtgcggttgtgtacacgagaagcgcttctttacccaacaccattgtaccggagcttgaaaaggcagctaaaagcataggcagagagttcagcacgttcattaaaacggataacacttgcggtcctgagcctccgctggtggagaggcttgagaagacggtggaagaaggggagaagattatagtcaaagaggttgaggagatagaagaggaggtagagaaggaagtggagaaagtcggcaagactgagatgactttgttccagagattagctgaagggtttgaagaactaaagcaagacgaagagaatttcttgagagggttgagtaaagaggagatggagttgttggatgagcttaaaatggaagctaatgaggttgagaaattattcggaaaagctctaccaatcagaaagttcaggtagagatga

SEQ ID NO: 124 - DNA, 1046 bp, Phaseolus vulgaris
agaagatgcatgccaaaacagattctgaggtaacaagccttgccgcgtcttctcccacgcgctcccctcctcgccgccctctctactacgttcagagtccttccagggactcccacgacggcgagaagactgccacgacatcgtttcattccacccctgttttgagccctgttgcttcccctccccactcgcgccactcctcctccacgcgcttctccaagaaggaccacagccacaatctgaagccctggaagcaaatcgatatcattgaagaggaaggccttctcagaggtgatgatcgccgcaatgggctccctcgtcgctgctactttctcgcctttgttgttgggttcctgcttctcttctccctcttctcgctcatcctctggggggctagtagacccatgaagcccaagatctccgtcaagagcataaagtttgatgatgttagagtacaagctggttcagatccaactggtgtggccaccgatatgatcacaatgaattccactttgaaattcacataccgcaacacaggcacatttttcggggtccatgtcacagccacacccgtggaactctcctactcagacatcgtaattgcttctggcaatatgaagaagttttatcaatctaggaggagccaaaggttggtgagtgtagcagtgatgggtaacaggattcctttatatggaagtggtgctagccttagtagcacaacgggtatgcccacagtgcctgtgccattgaacctaaagtttgtcctacgatctagggcttatgtgcttgggaaattggtgaagcctaagtactacaaaaccattcaatgttccatcactttggatcccaaaaagctcagttctccagtttctctcaaaaaatcttgcagacatgattgatacatacacatgtggtagagattatgtggaatgcacatgcaaaagaattatttgaaaagataaaataaaaataagaacattattattctatgttcaatggattcttctgatgtttgggaagaaatggaggtaacagctcagacaagg

SEQ ID NO: 125 - DNA, 697 bp, Phaseolus vulgaris
actcttctccaacttcaggcacaaaccatggcaaaggacagaacgatcggtgtggctatggatttctccaagagcagcaagaatgctctcaaatgggcacttgagaacttagctgataagggtgacaccatttatgtcattcacatcagccccaattctctagacgagtctcgaaaccagctatgggctaaatctggttctcctcttattcctctgcaagagttcagagagcctgagattatgagcaagtatggtgttcaaattgatatcgaggttcttgatacgcttgacactgcttccagacaaaaggaggtgcacattgttacaaaaatttactggggcgatgcaagagagaaacttctggatgcaattgaggatctgaagctggattctctggttatgggaagcaggggtctgaccacaatcaaaaggatcattttgggaagtgtaagcaactttgtgatggcccatgcttcttgccctgtgactatcgtgaaggaacctatcagcaagtaaagataaatcaattgggagagaacatttaaatttcatatgatattttctttgcaatgttcttgatctagttgagtcatatttcctttcctaaactattttggtgtctaataagaatgagtcatattatagatatatgatgctttctgtattttagctctcactctttgactttattgaagga

SEQ ID NO: 126 - DNA, 736 bp, Phaseolus vulgaris
ggcatagggttcataaatcttggagatgctaaactttgtatatcatattttgtgatacagtggtggttgatggagcaaacgatatggggccatttgccggtgctgatgagggcaaattccaaagaatctatagaatacattcttcaagccctttggagaactcgaaagagtggtcttgccacttctgatcgatgcatcatccaagacatgcttcaactacacaatgaatctgatctcgacccacttctggtttgcctccgaatgttaatccggaggtgtgtttatgagaatacttccaaggaggatattcccatgctgtttcccggtgaagttctgcctgaattgcaaaagctgttgacacttttgttgcagaagtttcagcgagagtggcaagaagatgtgatgaaagatcagaatattgtgcctagattaaaggcgatgacatggaatatggcaaatctggagaaaggatcagcagaccctgcagcggttattgatttgaagcttcaaaatgatactccatttcactcgggagtgcaagatgtgaagttccagttggctacagattctatggatatgatgctgaaagccatgcactgtattagagaccagttttctaccatggatgaggcagtaaatgggcattagcacctgtaaaccaaaggagattcttagaagttgttttacaaggaatgaggtttaaattgattccatggaggagctcaactggaaactt

SEQ ID NO: 127 - DNA, 532 bp, Phaseolus vulgaris
cagcagcagaagaaatgagtacctaaaatattgagttagtggttagaacttgagactaactatggacggtctagttcagctgcagaagcaacttgttgattacactgcttccctatttcatgagggttttctagatgaacaatttaaccagcttcagcaacttcaagatgaaagtaacccagattttgtggttgaagtggtcactctcttttttgaagacgcggagaggcttcttaatgagctcacaaaaacactaggccagcccagcactgattttaaaaagttggatgctcttgttcaccagttgaagggtagcagctccagcattggagcacatagagttcacagagtctgcatttccttccgaaactcttgcgaggagcaaaacgttgaagggtgtcttaaaaacttgcaacaagtgacacaagagtactacttggtgaaaagcaggcttgaagctctgttcaagatggagcaacagattttggctgctggtggatagttttgtaggtagtgtgataggaggcagaga

SEQ ID NO: 128 - DNA, 1467 bp, Brassica napus
aaaaccactgaaccaatctcgagatggagtcacgcgtgctgctacgcgccaccgcaacggtcaccggcgtcccgcagctgaggcgaccgatcagagcgatcaaccgccacttcagcactgcgtcttcgtcgttcacggctttcgctaagccgataggatcaatcggagagggagggaacctgatctccggtcgtcagctccgtccggtgctccttctcgatagctcgccggagaaaagagagattctcaagccggttcgagccgccgctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtccgtgggtctacctaaacgggctccaattaactcggacatcctcaaggtattgataccagttgcagtgtgtcacgccataggccatgttactagcaacgtgtccttcgcagccgtcgctgtctccttcactcacaccatcaaagcactggagccattcttcaatgcgtctgcttctcaattccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctcttttcgtctgccttcctcctgctatcatcgtcgaagggcctcaactgttgaagcacggtttcaatgacgcgattgctaaagtgggaatgactaagttcatctctgatctcttctgggttggaatgttttaccatctctacaatcagttggctactaacacgttggagagagtagcaccgttgactcacgctgttggaaacgttctgaaacgtgtcttcgtgatcggtttctccatcgttatcttcggaaacaagatatcgacgcagacaggtgtcggaactggaatagccattgctggagttgcactctactctgtcattaaggccaagatcgaagaagagaaacggcaaggtaagacggcgtagagagctacggccgagggcggtcaacggttgcgtaaacaaatcctccgatgaatatctatataataaaataaccaaaaatgcaatagtattttgtatcgtataaatcaaacattgtttttgagtttctcttctcgttgttcttctttataaagcttatatattatttttttattctgcgtcttttcttccagtggacaacattgttgccatttcttatgca

SEQ ID NO: 129 - DNA, 1451 bp, Medicago truncatula
aatcaacgatgtacaaggtagcaaaagcatcacaataccttgtgataactggaatcggaatcaaagacataaaactcgcaaagaaagcatggattctacccggtcaatcctactccgtcttcgacctctcacctgtaaattacacctttgaagttcaagcaatgagcgcagagaaacttccttttgttctccccgctgtcttcactatcggtcctcgtgtggatgataaggaaagccttctcaaatacgccaaacttatttcaccgcacgataaactctccaatcatgttaaggaactcgttcaaggaatcatcgaaggcgagacacgtgtcctcgctgcatcaatgaccatggaagaggttttcagaggaacaaaagagtttaaacaagaagtatttggaaaagttcaactcgaactaaaccaattcggtttattgatttacaatgctaatgttaaacagttagttgatgtgccaggtcatgagtatttctcatatttgggtcaaaagacacaaatggaagcagcaaatcaagcaagggttgatgtatcagaagctaagatgaaaggtgagattggttcgaaactgagggaaggacaaacactacagaatgcagcgaagattgatgcagagacaaaagttattgcactgcagaggaccggagagggtgacaaggagggaattaaagtgaggactgaagtgaaggtttttgagaatcagagagaggctgaggtggctgaggctaattctgaattggctaagaagaaagcggcttggactaaggcggctcaagtggccgaagttgaggctgctaaagccgtcgccctaagggatgctgagttacaaggtgaagttgagaggatgaatgctttgactacaactgagaagcttaaagctgagttccttagcaaagctagtgttcaatatgaaaccaaggtacaagaagcaaactgggagctgtacaagaaacaaaaggaggcagaagcaattctgtatgagaagaaggcagaggcagaagcacagaaagcattagcagacgcaacattttatgctcgcacgcaagccgctgaagcagagctatatgcaaagaaaaaggaggcagagggaattgtgacacttgggaatgctcaaggggtgtatctaagtgcacttctcaatgcacttggaaacaactacactgctgtaagggatttcttgatgataaatggtggcatgtttcaagagatcgctaagattaatgctgaggcagtacgcggacttgagcctaagattagtatttggactaatggtggtgataatagtggtggtgaaggtgcgataaaagaagttgctggtgtctacaagatgttgccacctttgtttaagactgttcatgagcaaacgggaatgttaccacctgcttggatgggagtcttgcctgacaaaaacttgaattaggatgatgcaacttaa

SEQ ID NO: 130 - DNA, 1519 bp, Medicago truncatula
gagagagagctcaatttcatctcaaaaaatggcttgcacctctgcaaattcattactccaattaaagggttcttcattccagaggccaattttgaatttgagaacaaacatttctgctccttactcacccggcttatttaacctaaaaggtgatgggttaatccataaagggttcaggcatcaaagtcaaaaacatttgacacctagaaataaagttacagttatacgagctgtggcaattccggtagaaccagctccagtggaaagtgcggagtacagaaaacaactagcagaacgctatggttttgagcaaattggagagccgcttccagacaatgttacattaaaagatgtcattacttctcttcctaagaaggtttttgagattgatgatgttaaagcatggaaatctgttttgatatctgccacttcctatgcgctggggcttcttatgatttctaaagcaccctggtatctacttcctctggcttgggcttggacagggactgctgtaactgggttctttgttataggacacgattgcgctcacaaatcattttcaacaaacaaattggtagaagacattgttggaactctggcctttttgccactaatttatccatatgagccatggcgatttaagcacgacaaacatcatgcaaaaacaaacatgttgaaggaagatactgcttggcagcctgtttggcaggatgagtttgagtcaagtccatttttgaggaaagcaataatatatggatatggtccatttcgttgctggatgtctatagctcactggttggtctctcactttgatttgaagacgttcagaccaaatgaaataaagagggtgaagataagtttggcttgtgttttcgcctttatagcaattggatggccattaattatttacaagactggaatcatgggatggataaaattctggttgatgccatggttgggctatcacttctggatgagcactttcaccatggtgcatcatactgcaccacacataccattcaaaaactcagaagaatggaatgctgcacaagcacagcttaatggaaccgttcattgtgcttaccctcaatggatcgagatcctatgccatgatattaatgtccatattccacaccatatatccccgaaaataccgagctataatttacgagcagcccataaatccatccaagaaaattggggaaagtatctgaacgaggctagttggaattggcgattgatgaagacaatcatgacagtgtgtcatgtgtacgataagcagcaaaattatgtctcctttgatgaagttgctcctaaagaatctcgtccaattagatttttgaagaaagtaatgcctgattatgcctaattaggtccaagttggcttattttcatgcaatttttttatgtatcagagtaggtaggtataccattcattttcttttttacgtgttcaatagtattgtttaatatggttccatttttcatatcacataacaaggggaaattacttggagct

SEQ ID NO: 131 - DNA, 1391 bp, Medicago truncatula
atagaatgtatatggcaacattgggtgcaaattcaaatattataattaaaaatgatataagatttcgccgaacaacaacaacaaggttggcagtgttcaaagtattgcctacacgattgcatttcttaagacatgatcgtaattctcgtggtttggtggtatgccaatgtcaacaccaccaccacaaagggaaaccagattcttcttcaaacatatcacggatattagaaaatggggtgaataggatgcttgttgttcttgaagattggagaaattcacgcataatccaattagttgccatactggtttctattttaatgattgttccatcagctgatgctgttgatgcactcaaaacttgtgcttgtttgctcaaggaatgcagggtagaattggctaagtgtcttgcaaacccatcatgtgctgccaacattgcttgtctccaaacttgcaacaatagaccggatgagactgaatgccaaattaaatgtggggacgtatttgaaaacaaagtggttgatgaattcaatgagtgcgctgtatcgaggaagaaatgtgtacctaagaaatctgatgtgggagaatttcctgttccaaacccggatgtccttgtgaagagctttaatattgcagattttagtggcaagtggttcatcactagtggcttaaatcctacatttgatgcctttgactgccaattacatgaatttcacacagaatcaaataaacttgttggtaatataacatggaggataccaactccagatggtggatttcttacaaggtcagcggtgcagagatttgttcaagatccttcaaatccaggaatcctctataatcatgataatgagtaccttaactatcaagatgactggtatgtcgtgtcatctcaaattgagaataaaccagatgactatatatttatatactaccgaggtagaaacgatgcatgggatggctatggtggtgccgttgtgtacacaaggagtgcagttttacctgaatctattattcctgaacttgatagagcggcaaagagtgtaggaagagactttagcaagttcatcagaacagataacacatgtggaccagagccttccattgtggaaaggctggagaaaaaggttgaggaaggagagaaaaccattgtgagggaagttgaagagttagaagaggaggtggagaaggatttggagaaggttggcaaaacagaaatgaccttgttacaaaggctggcagaagggtttaaagtgtttcaagaagatgaggaaaatttcttaagagggttatctaaagaagaaatggagatactggacagtctcaaattggaagctgaggaagtagaagagctctttggacgtgccttgccactaaggaaactaagataatga

SEQ ID NO: 132 - DNA, 1178 bp, Medicago truncatula
tccatcttacaggaagaagaacacaggatgaactgcagtcagtttgcgactacaatgcgctctgccttttcccttcatcacttcaactctccgcgcttgtctcgccacgtatccaatgtctctgcttctctacagccccaaggacaagggactgacactcctccacggattggctttttgggccttggaatcatgggcaccccaatggctctaaatctcatcaaagctggagttgatctcacagtttggaataggactaagagcaagtgtgatcctctaatcagcttgggagccaaatataaaccatctcctgaggaagtagcggcatcttgtgatctcacatttgccatgcttgctgatcctcaaagtgcggtggatgttgcttgtggaaagcatggagttgctaatggaataggtccaggaaaaggatacgtggatgtatcaactgttgatgtggacacttctaaattgattaatggacacataaaatccactggagcattatttttggaggctccagtttcaggttccaaaaagccagcagaagatggacaattgatatttcttacagcaggggacagaaatctttatgaaacggttgctcctttcttggacatcatggggaagtctaaattttaccttggtgatgttggaaatggtgctgcgatgaaacttgttgtcaatatgatcatgggaagtatgatggcatccttttcggaaggtttacttttgagtgaaaaagttgggctagatccaaaagtactagtggaggtaatttcacaaggtgccattaatgctccaatgtactcgatgaaaggcccatccatgatacagtcaaattatccaactgcatttcccctaaaacatcagcagaaggatctaagacttgccctggggttagcagagtctgtttcccaacctattccgattgcagcggctgctaacgaattatataaagttgcaaaatcacacggctatagtgatgaggacttttcagctgtcattgaagcattaaaatccaaatttcagcactcagaaaaccagtgaggctcttatgagacacagtttcaacttcaagttgacttgaaatcaagtatagacagattgtaagactagtcaatttaaatgcaattcccaaaatgtagaatttatacttgcaactcccagaatgtgtagaa

SEQ ID NO: 133 - DNA, 2804 bp, Glycine max
cctaaattcttagtgtgccgacccataagaaaaaaaaagtaaaataaaaagaaaaaggaaaaaaagaagaagcataatttggaatcaagtatatgtgagtagttatggtgatggcatgacaatggtaatgcccctgtgtcttgtgagagtctgagatcgcttttctctctttcgatcttccttttccgcatttctcaacaatcgtttccaatcccacgctaatggcaaatagtgagacttgttgttcaactcagcttattgatggagatggtacattcaatgtttttggggttgaaaatttcatgaaggaggtgaagttggctgaatgtgggctttcatatgccgtagtttctataatgggtcctcaaagtagtggcaagagcacactgttaaatcatttgtttggtaccaacttcagagagatggatgcttttaagggaaggtctcaaacaaccaaaggaatctggatggctagatgtgctggcatagagccttgtacacttgtgatggatttggagggtacagatggaagagaacgcggagaggatgacactgcttttgaaaagcagagtgctctatttgctcttgctgtctcagatatagtgctaataaacatgtggtgccatgacattggccgtgagcaagctgcaaataagccacttttgaaaactgtctttcaggtcatgatgagattgtttagtccacgaaaaacaacattgttgtttgtcatacgcgataaaacaaggacaccacttgaaaatttagaacctgttttgcgagaagatattcagaagatatgggactctgttcctaaaccacaggcccacaaggaaaccccattaagtgaatttttcaatgttgaagttgttgctctttctagttatgaagaaaaggaagagcaatttaaagatcaggttgctagcttgcggcaacggttccatcattctatcgctcctggtgggcttgcaggggatcggcgtggagtagttcctgcttctggcttttcttttagttctgagcatatatggaaagtcattaaggagaacaaagatctcgatcttcctgcacataaggttatggttgctactgtacgatgtgaagaaatagccaacgagaaatatgtttcttttgttgcaaatgaggattggtgtcaattggaagaggctgtgcaatctggccctattcctggatttgggaaaaagctcagttcacttcttgatatttgtttttcagagtatgatgctgaagccacctattttgacgaaggtgtgagatcttccaaacaaaagcaactacaagaaaaattgttccaacttgtccaaccagcattccaatctgcgctgggacatataagatctggaactttggataaattcaaggaggcatttgacaagactttgaaaggaggggaaggattttctgtggctgctaataattgcattgggtcttgtatggttcaatttgatgaagcatgcacagatgttgttattgaacaaacaaactgggatacatctaaagtacgagagaaactgctgcgtgatattgatgcacatgttgcaactgtacgtgcaaccaagatttctgaacttacttcatcatatgaggaaaaacttaaacaagctttgtctggacctgttgaagctcttttggacggagctaatagtgatacttggccatcaataaggaatctttttaggcgtgagactgaatcagctgtttcagggttctctgctgcacttactgggtttgatatggatgaagaaacaaggcagaaaataattttgagtttagaggattatgcaaggggtctggtagaaggaaaggctcgggaagaagctggaagagttctaatccgcatgaaagacaggtttacgatgttgtttagccatgattctgattcaatgcctcgtgtttggacgggtaaagaagatatacgagccatcaccaagactgctcgctcttcttctttgaagttgctatctgttatggctgcaattcgtttggatgatgatgacactgacaatattgagaaggtgttagcagttgcattggtggattcatcaccaaatagtaatgctacaaggagcatgacaatggttgatccactagcttctagcagctgggaacaggtttcatcctctaaaacattgattacacctgtccagtgcaagtctttgtggaggcaattcaagacagagacagagtacagtgtctctcaggccatttctgcacaggaggccaacaagcgcaacaacaactggttacctcccccatgggcaatagttgctttggttatcctgggatttaatgaatttatgacacttctaagaaatcccttgtatttgggtgtcatctttgttggttttcttctcattaaagccctatgggtgcagcttgatgtttcgggtgaatttcgcaatggagctcttccaggaatcatatccttgtctagcaagtttattccaactatcatgaaccttatgaaaaaactagcagaggagggacagaaccctgcagctaacaatcctcagagaaccccatcaaaaagcagttacaatgagggtcatgccgtgtcatctagcgcctcatctaacttgactagattggacaacggaaccgagtatgcgagtccattaaaagatgattaggtgaagacactcatcttactgaaaaccaatttattctgttgggagatggtggtttgtctggtggctgcatgcttgtccacaaaattcatgacttgtgagcattcaagacattcaaaggcattggttttttttgtgcaagtgccatatacagggtag

SEQ ID NO: 134 - DNA, 203 bp, Glycine max
caaccatgtcgaccaagcaaggtggaaaagctaagcctttgaagaaacccaagtctgataagaaggattacgacgaggttgacatggctaacattcagaagaaaaaggaagaggagaaggcgctaaaggagttgaaagccaaggcgcaacagaagggaagctttggaggttctgggctcaagaaaagtggaaagaaataataa

SEQ ID NO: 135 - DNA, 1616 bp, Glycine max
cgaaaatggcgttggctttcgacgagttcggaaggcctttcataatcctgaaggaacaggagcagaagagcagacttcgaggtttggacgctcagaaagccaacatctccgccggcaaagccgtcgctcgcatcctccgaacctccctcggccccaaaggcatggacaagatgctccagagccccgacggcgacgtcactatcacgaacgacggtgccacgatccttgaccagatggacgtggacaaccaaatcgcgaagctgatggtggagctctcgcggagtcaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtccaatttggagcccctcattcaaacttgcatgaccaccctctcctccaaaattgtgaatcggtgtaagcgtagcttggctgagattgctgttaaggctgttcttgctgttgctgatctggcgaggaaggatgttaatttggatctaattaaagtggaagggaaagttgggggtaaattggaggataccgagttgatctatgggattgttgtggacaaggatatgagtcatcctcaaatgcctaagcaaattgaggatgctaaaattgctatcctcacatgcccctttgagcctcccaagccaaagactaagcataaggttgacattgatacagtggagaagttccagacgttgaggttgcaggaacagaagtattttgatgacatggttcagaaatgcaaggatgtgggtgcaacccttgtcatttgccaatggggttttgacgatgaagcaaatcatctcttaatgcacaggaacttgccagctgttagatgggttggtggtgtagagttggaattgatagctatagcaactggtggaagaattgttcctaggtttcaggagttatctccagaaaagttgggaaaggctggtatggttcgagaaaagtcctttggtacaacaaaagaccgaatgctgtacattgaacattgtgcaaactcaagggctgtaactatattcattcgtggaggtaacaaaatgatcattgaggagacaaagcgcagccttcatgatgccttgtgcgtggctaggaatcttatccggaacaactctattgtctatggtggtggttcagctgagatttcttgctctatagctgtggaggcagctgctgatagataccctggagtagaacagtatgcaattagagcatttggggatgctttggaggccatcccaatggcccttgctgaaaatagtggcctgcaaccaattgaaacattatctgctgttaagtctcagcaaataaaggataataaccctcactttggcattgattgtaatgatgttggcactaatgacatgcgtgagcaaaatgtctttgaaactttgatcggaaagcagcaacagctcctactcgctactcaagttgtcaagatgatactgaaaattgatgatgtcatctccccatctgagtactgatga

SEQ ID NO: 136 - DNA, 1977 bp, Glycine max
gtttggagaagaggggctgagggagaggggatggaggacattgaggatttgctgattggaagtgcaactccaccgggctttcgtttgccattagcagcggctgttggcgtggggacaaagcggaatcaactctcttcttcttcgctttcgccttcacctgcaatccctggcactcagactatcttcataaagacctttggctgctctcataaccagagtgacagtgaatatatggctggtcagctttctgcctttggctattcattgagcgatgatcctgaccatgcagatctctggctcatcaacacttgcacggtcaaatccccaagtcaatctgctatggataccatcatatcgaaaggaaaatcttcaaataaaccactagttgttgctggttgtgtccctcaaggaagtcgggatttgaaagagctcgaaggaatcagcatagttggagtccagcaaatcgatcgtgttgttgaaattgtagaggagactttaaaaggtcatgaagtgcgtcttttgacccgtaagaaattgccagcacttgaccttccaaaggtaaggaagaacaagtttgttgagattcttcctattaatgttggttgtttaggtgcttgcacttattgcaagacaaagcatgctcggggtcacctaggaagttacacaattgatagccttgttgggcgtgtaaaatctgtcatatctgaaggggttaaagagatatggcttagcagtgaagacactggagcatatggtcgtgacattggtgtcaatcttccaacattattgaatgccttagtagcagaactaccagctgatgcaagcacaatgttgcgtattggaatgactaatccaccatatatacttgaacacttgaaggagattgctgagattttgcgccatccatgtgtttactcttttctgcatgtaccggttcaatctggaagtgataccattttgagtgcaatgaatcgagaatatactgtgagcgagttcaggactgttgtagatactctaactgagcttgtgccagagatgcagattgccactgatataatatgtggatttcctggtgaaactgatgaagattttttgcaaactatcaaccttattaaagagtacaagttacctcaagttcatatttcacaattttatcctcgaccagggacacctgctgcaaggatgaaaaaggttccaagtaatgtggttaagagaagaagccgtgaactgacaaatgtctttgaatccttcacaccatactctgggatggaaggcaaagtggaaagaatttggattactgatattgcatctgatggagttcacttggttggtcatacaaaaggatatatacaagttcttgtacttgctccagacaatatgctgggaacttcagctatggttaagataacatccgtgggaaggtggtcagtttttggggatgtaattgagacagtgaaccctgtaagtgacaataaagctctaaacaagctggttcctaatcaggattgcggtaactcagccaagactggtggattttcagaagagccagaatattgtgcctgtggaaatgacatctgttgtggtcagggtactctcgaaaataatgataattcaagaggcagtgcagtgccacagaaccaaagcaaaagaaatttcattggatggatgctgaggaagcgggagcatctgcacaaaacggttgagagtgagcttgcctcgggatctgttaaaaagcaagaaggaatcatgaggaagtgggacttcgttgataaggttcttttgggtggaatatctatcagcatcttgacgattatggctctagtagtagctgttatgtttagagttatttggtcccaataaaaggttttagtttttccgaatcaatctgtcgttccaaaattttgacttgtacaaattgctcggattttattaagtgttttcacatgtatccgcatcttgctttaggttttacggcag

SEQ ID NO: 137 - DNA, 938 bp, Glycine max
aaaagatggctcagcaggaagtggtagaagggttcaagttcgaacagaggcacgggaaagagcgcgtgagagtggcgcgcgtgtggaagacgaggcaggggcagcacttcgttgtggagtggcgcgtgggcatcactctcttctcagactgcgtcaactcgtatctccgcgatgacaactctgacatcgttgctactgataccatgaaaaacacagtgtatgcaaaagcaaaggaatgctcagacatactctctgctgaggactttgctattttgcttgctaagcactttgtatcattttacaagaaggttactggtgctattgtgaatattgtggaaaaaccatgggagcgtgtcattgtggatggtcaacctcatgaacatggtttcaaacttgggtctgagaagcatacaacagaggcaatagtacaaaagtctggttcacttcagttgacttctggtattgaaggattgtcagtgttgaagacaacccagtctggttttgtgaatttcataagagacaagtacacagcacttcctgatacccgtgaaaggattctggcaacagaagtaaccgcactgtggaggtattcgtatgaatcacagtatagcctccctcagaagccattttactttacagaaaagtatcaggaagtgaaaaaagttctggctgacactttttttggcccaccaaatgggggagtctatagcccatctgttcaaaacacactctacctgatggcaaaggccacactgaacagatttcctgacatagcttatgtcagtctaaagatgccaaatcttcatttcttacctgtcaatatctcaaacaaggatggtcctattgtgaagtttgaggatgatgtgtacttgccaacggatgagcctcatgggtcaattcaagctagcttgagccgcctttggtcaaagctgtagtag

SEQ ID NO: 138 - DNA, 862 bp, Solanum lycopersicum
cctactctcctccatatttccaacaatttactccagttgagaagaagaaaaaacttatccaaattcagaaaaaaaatggcgtccactcagctaacagcatcctctatctctggcaatggttttgcatcctttgaagggctcaggtccacttgcattgtaaagaccgtatcttttgctcctttgaagcacaacaacagcaggtcttttagtcgtcttgttgtcaaggcggctaccaccgtagctcctaagtacactacacttaagcctttgggcgacagagtcttggtgaagattaagactgcagaggagaagactgttggtggtatcctacttccagtatcagttcagtcgaaacctaatggaggtgaggtggttgctgttggggagggtcattcagctggcaaaaccaaagtggacattagtgtgaagactggtgcccaagtcatctactcgaagtacgcaggaactgaggtggagtttgatggatcaaagcacctcattctgaaagaggatgatattgttggtattcttgagacagatgatgtcaaggatctgcagccattaaatgacagagtcctaatcaaggttgcagaagctgaagaaaaaaccgctggaggtttactgttgactgaggcagccaaggagaagccttcaattggcacgattatagctgttgggcctggtcctcttgatgaagaagggaacaggaaaccactttcagtatccccaggaaatacagttctctattccaaatatgccggcagtgaattcaaaggtgctgatggatctgattatattacactcagggtgtctgatgtaatggctgtgctatcttagtgggactattgagttattccgtgcc

SEQ ID NO: 139 - DNA, 664 bp, Solanum lycopersicum
agcatggtgtgccaattactcaattttttaattctttctcttcttctccggcgccaccacctccgccacccgccgtgaaacataaatttatttttggtcatttttcaaaattaaacaatgcttgtctctgtttttctcgctctgtttcttccctgtgttggaatgagcgctgttttcttagtctacatctgtttactctggtacgccgctgcttaccaatctgccggccctggcgctgaaaattaccatagtcagaaaacgaatcaggaattgggtctttctgctgctcaattggacaaactaccgaaaattacagggaatgaattgttaatgggtaacgattgtgcggtgtgtttggatgaaattgagaatgagcaaattgctcgagttgttccgggttgtaaccatggatttcaccttgaatgtgctgatacttggctttcaaaaaatccgatttgtccagtttgtagaactaaactggagccggagttcttcaatccacctgaaagtaacccatgttgaagatattcctaattacaattatttcaaactttatttttattaatgttcgatagattataggagtagtttgatatgattggtgttgaattttttttttcttcgtttaattctgaatctggggtggtggatgttgttatgagaa

SEQ ID NO: 140 - DNA, 1649 bp, Sorghum bicolor
attaaatgggcccttttcacatccccagtacaagtggtcctcgcaagttttatcaccttgtgctcttccatgtgcacccgttctggatccaactcttgtacttcctttccatctccgtcttgggtttcttgatgctgagagctctgcccatgaagtccatctccgtccctaggccctcggctctcgacctagtcttcacgtccgtgtcagcgacgacagtctccagcatggtcgccgtcgagatggaatccttctccaactcccagctcctcctcatgaccctcctgatgctcctcggcggcgaggtgttcacaagcatgcttggtctccacttcaccttcaccaagttcatcaagaagagagaaatacctcatagtaataataatagtctccatggtaatatcaatggaccggcaccggcggcacctagtagcttagagcacggtcaccgtcgccgtcccatggagatggaagcccaggccgccgccgtccaaatggagctagcagggttcaacaacgacgaccaacgtgattttgcatccatagctaggctgctaatgttcatcgtgcttggctacctctcggtggtgcacctcgccggctacacgctcattctaatctacctcagcgtggtcggcagcgcgagagaagtgctggtcggcaagaggatcagcctgagcaccttctccgtcttcacggtcgtctcgacgttcgcgaactgtggcttcgtgccaacgaacgaggggatggcgtccttcaagtccttcccgggcatgctcctcctcgtcatgccacacatcctcctcgggaacacgctcttccccgtcttcctcaggctctccattacagcgctcgagagggtcaccaggaggggagacctccgcgagctgctgagggacggaggacccggcggcggcggcggcggcggcggcggaccagctgctgctgctataggctacgaccacctgctgcccggaggccgcacatggtgcctggctctcaccgtggcggtgttcctggcggggcagctgctgctctactgcgccatggagtggggctccgatgggcttcgagggctcaccgcgttccagaagctcgttgccgcgctcttcatgtccgtcaactccaggcactccggcgagatggttgtcgacctcgccaccgtgtcgtccgccatcgtcgtgctctatgtgctcatgatgtatctaccgccttacaccacatttttacccatagcgatggaagaccaccagcagcagcaaaatgaggcacaatccgacgacaagagcaagagcagcagcagtattagcatctggcagaagctgctcatgtccccgctctcgtgcctaaccatcttcatcgtcgtcatctgcatcaccgagcgccggcagatcgctgacgacccaatcaacttcagcgtcctcaacatcgtcgtcgaagtcatcagtgcgtatggcaatgtgggattcagcaccgggtacagctgcagcaggcaggtgacgcccgacggcagctgcagggacgcgtgggttggcttctccggcaagtggagcagggaagggaagctcacgctcatggccgtcatgttctacggcaggctcaagaagttcagcatgcatgggggtcaggcatggaagctaggctaataa

SEQ ID NO: 141 - DNA, 669 bp, Zea mays
caagacttcaaccttcctttccggccggagatccgcttcgcatctccgcgacagatccgggcaaacgggccgatgcagttcttcggcggctcgtcgctgacgtcggtcgcgccggaggcgaccccagccccggcggcgccccctggtacgggcacgggcgccagcgcgcaggtcctctacgtcttcaaccgcaacggcgtctgcctgctctaccgcgagtggcaccgccccctccgcacgctcgaccccacccaggatcacaagctcatgttcgggctcctcttctcccttcgctccttcaccgccaagatcgacccaaccacggcagaaaagggaaatcttggtgtgccactactgccaggccaaggttgttcgttttatagcttcaagacaaacacatacaaactgaactttacggagagcccttctggtataaagcttatactaattacacatccaaggactggtgatcagcgagactcgctaaagcatatctacaacctatatgtggaatacgttgtaaaaaatcctctgtatgctcctggaacaccaatcaagtgcgaacttttcaacaaacatctcgatcaatacgtgagaacaataatttgatgtcattgagacaatgggttggtgaggcaaaaaaaggtccatttcatgttctttagcgtg

SEQ ID NO: 142 - DNA, 952 bp, Zea mays
cagcacatcttcctcgcagcgccggcgctccatcttcggctccctcccccaccttcgatcggcacgcaggctcggcgtcgtcgtcagcggttcctcctcacgcctctcgccagtagcctcgcgccctcgccgactggcgatcctgccttgaaggggctggcaagatgatcggcgtagggaaggcgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgctgttggtgcaagggtgcttgaactactctgtcacagggagaagggaaatagacgagagacacgacttctgggcattttatcattcatccacagtactgtttggaaagtgttgtttggaaaggtggctgactcacttgaaaagggaacagaacacgaggatgaatacatgatcagtgaaaaggagcttcttgttaaccgtttcatttctgtgccaaaagacatgggagcattcaactgtggagcttttgttgcgggcattgtaaagggtgtattagataatgctggctttcctgccgtagttactgcacattttgtgccaattgaaggccagcaaaggccaagaacgacaatcctgataaagtttgctgaagaggtattacacagagaagcaagactgggctgagtttttatgtatgtacacaaaacctttgactagcctatctgtaaggtgaatcgttactggggactagtttgatgatttcttgtatttgagtagttcggtgatttcttgtatttgggttatgtaatagcagtgtgactgagaataaaagttatgtaggtgagatcgcaggtgattcatcagtcttattgaaatccgaccgaaac

SEQ ID NO: 143 - DNA, 1226 bp, Zea mays
ctcccttcaaaccttcatcaaacacccgttgcgcttgcgccagcgggcagcccctctcccgcagccgcagtcccagtcccacgcgcattccgccccgcggctcccgagagagagagatggccaggcacgccaagacggactccgacgtgacgagcctggcggcgtccacgccgccgcggtccccgcgcggccgcccggcctactacgtgctcagccccgccgcctcccacccggacgtccacctgggcgcctccggcggcgtggcggggaccaccccggcggagtcgccgctccactaccacttccaccaccaccgccaccactcgagcggcggcgccggtgtcggcgtgggcggcacgcaccactcccgggagtcctcgacggggcggctgctcttctccgaccagctccgctccggcggcgacgtcgccgcggtggtgagcgtcccctggcgccggctcgggaacggcagcggcgcgggcagcgtcggggacgaggacgacgacggcgcgtccctgcgcggcgggtcgttcgcggagtcgccgtggcggtgctacgcgctcggcgcggtcgcgttcgtcgccgtgttcgccttcttcctgatcgtgctgtggggcgccagcaggtcgtacaagccccacgtcgtcgtcaagagcgtggtgttcgagtcgtaccacatccagggcggcacggaccggacgggcgtccctacgaagatgatgtcggtcaacgcgacggtgcggctgcgcttccgcaaccgcggcaccttcttcagcctgcacgtcacggccacgccgttcctcctcttctacggcgacctcaccgtcgcctccggagagatggcggagttctaccagccgcggaagagcgggcggacggtgacggtgtccgtggtggggaagcaggtgccgctctacggcgcgggcgccagcctgcacagcaagcccaacaacgggcgcctcggccctgcggtggtgcccgtcaggctcggcttcgtgctgcgcgcgcgcgcccacatcctcggcctcctcgtcaagtccaagttctaccgccgcgtgcgctgcggcctcgacatccgcgaggcgcacctcggcaggcccgcccgcggcgtcgcctccggctgcgagtaccacgacgggatgcgatgatcgttcctgccgccgttgtgtcgcctcgggcggggtttgctgcgttgtggttgcggacgaactgtgtaatcgattcct

SEQ ID NO: 144 - DNA, 1301 bp, Zea mays
gcccgatggccgcaccgtcctccgccgccacagcctgcttcgtctccccgctcccgccgcctcgccgcccgcgtcatttcctcaggcacctcgcgcgcgccgccgccgccgagcccacgcccgcctccgcctcctcgttcgccctcccgtcgccatggccgtgggcgcggcggctccgcgacctggtccccgccgaggccgcgggccggctgctgtcgtcggccgcgggctccctcatcgtcgcgctcgcctccgcgtcgctcgtcctcggcgacgccggcgcggcctccgcgttcgtcgtatccacgccgcggaagctgcaggcggacgagctcgccaccgtgcgcctcttccaggagaacacaccctccgtcgtctacatcaccaacctcgccgtcaggcaggacgcgttcacgctcgacgtgctcgaggtgccgcaggggtccgggtccggctttgtctgggataagagcggccacatcgtcaccaatttccatgtcatccgtggcgcgtcagaccttagggtcacacttgctgatcagtcagtgtatgaagcacaagttgttggatttgaccaggacaaggatgttgctgttttgcgtatcgaagcaccaaaggataaactaagacctatacctgttggtgtgtcagcagacctactggttggtcagaaagtatatgccattggaaacccatttggccttgaccacactcttacaacaggtgttatcagtggattgcgccgagaaatcagttcagctgccacaggacgtcctatacaagatgtgatacagactgatgctgctatcaaccctggtaacagtggtggtccactccttgatagttctggaaacttgataggtgtaaacacagctatatactcgccctcgggagcatcatctggtgttgggttttccattccggtcgatacagttgggggcattgtggaccaacttataaggtttggcaaggtgacaaggcctattttgggagtaaaatttgcccccgatcaatctgtggagcagcttggattaagtggagtgcttgtcctggatgctcctccaaacggaccagccggcaaagcgggtctgcagccaaccaaacgagatccctatggtcggcttatcctgggtgacataattacctctgtgaatggcacaaaggtgacaaacggaagcgacctgtaccggatactggatcagtgtaaagtcggggaaacggtgaccgtggaagtcctgcgtggcgatcataaggagaagatccccgtggtcctcgagccgaaggccgacgaatcatagtag

SEQ ID NO: 145 - DNA, 1697 bp, Zea mays
ccgaaatggccgctagtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcctcacgctcgcgctcgctaccgtgtcgtacctctggtccacgccaggcgtcgcgccggggttcttcgacatgttcgtcctcgccttcgccgaacgcctcttccgccctaccttccgcaaggatgacttggtatttgggaagaagctcggggagggcgcattcggggtcgtgtgtaaggcttcactggcgaaccccgaagcggcgaagaagcaaggggatttggtcgtgaagaaggcaacagagtatggtgcagtggagatttggatgaatgaacgtgtcaggagggcatgcgctagtagctgtgcggattttatttatggcttttgcgagaccaaagcaaaaggtaagggagctgaagaatattggcttatttggcgttttgaaggtgaggatacactttatgatctcatgcaaagcaaggaattcccttacaatgtggagacaaaaattcttggcggtatccaagacttgccaaagggaatagcgagagagaataagatcattcaaacggtgatgagacaactcttatttgctcttgacggacttcattcgacaggaattgttcacagagatataaaacctcaaaatgtgatattttcagagggatcacgaaccttcaaaattattgatcttggagcagcagctgacttacgtgtaggaattaactatattcctaaagagttccttttggatccaaggtatgctgctccagaacaatatattatgagcacacaaaccccgtctgctccttctgttccagttgcaacaactttgtctccagtcctgtggcagctgaatcttcctgacagattcgacatatatagcttgggtctcatattcttacagatggcattcccttcactacgaactgatagcaacctcatacaatttaatcgccaactgaaaagatgtgattatgacttacaagcttggaggaatctggtggagccacgagcgagtgctgagctccggaggggctttgacatcatggatttagacggtggtatcggatgggaactcctcacctcgatggtccggtacaaagcacggcagaggaccagtgctaaggccgcattggcacacccgtacttcaaccgtgaagggctccttggcctctccgtcatgcaaaacgtacggctgcaactgttccgcgcaacccagaaggactacagtgaagcagcgcggtgggttatcggcctcatggcaaggtcaggaactgaagatgtgggaggctttacagaagcacagcttcaagagcttagggaaataaaaccaaagaaaagcagcacccagcggaacgcgcttgcctccgtgctgcgcctgcagaggaagatcatgagaacgatcaaggagagcatggacgagctcaacagccagcgcaaaagcatctggtggagccggtggatacccagggaggagtagtag

SEQ ID NO: 146 - DNA, 1061 bp, Oryza sativa
acatcatggccacgtcactatccttggcgcccaaacccgccgccgtcgccgtcgccgccgccgccatcccgaggcttgttccgccgccgtctatcgacatgtcggcgctgtcgccgccgccgccgctcgtcagcgtcagcaggagcatggtagcgaagcacaaggccgtggttgtgatgggcgcgacggggacggggaagacgcggctcgccgtcgacctcgcgctccagttcggcggcgaggtgatcaacgccgacaagctgcagctgcaccgggggctcgacgtggccaccaacaaggccaccgccgacgagcgcgccggcgtgccgcaccacctgatcggggtggcgcacccggacgaggagttcacggccgcggacttccgccgcgccgcgtcgcgcgccgccgccgcggtcgccgcgcgcggcgcgctgcccatcatcgccggcggctccaactcctacatcgaggagctcgtcgacggcgaccgccgcgcgttccgcgaccggtacgactgctgcttcctgtgggtggacgtgcagctccccgtgctccacggcttcgtcggccgccgcgtcgacgacatgtgcggccgcgggatggtcgccgagatcgaggcggcgttcgacccggaccgcaccgactactcccgcggcgtctggcgcgccatcggcgtgccggagctcgacgcgtacctccgctcgtgcgccgccgccggcggcgaggaggaacgcgcgcggctgctggccaatgccatcgaggacatcaaggcgaacacccgctggctgtcgtgccggcagcgcgccaagatcgtgaggctagaccgcctatggcgaatccgccgcgtggacgccacggaggcgttccggcggcgcggcggcgccgccaacgaggcgtgggagcggcacgtcgccgcgccgagcattgacaccgtgcgatccttcctccacggcgaattcaccaccgccgccgaaactacggcggcgccggtgccgccaccgccgttcctccccatgtttgctctcgccgcggcgggcgccggcgtctaagctcagctctga

SEQ ID NO: 147 - DNA, 2164 bp, Sorghum bicolor
aaaccactcatcgttctctgcctccgtccactcccgacgccgtgcctccatggccaccgccacggcgaccccgccgcaatgctggcgagggctccccgcctcggcgcgggcacctccacctctctcctctcccctccggccgcgccccgtagccgctcacttctatcccctcaggcgccgcatcgccactgctacagccagaggaaggcgagccccactggcctgctcccccaggtgtacgctggagacggccggcccgggcttcgaccctctggggctgtacgaggaggggtctgattctccgtcgcggtctcccctgtctaacttcttcggtatcctggcgccggtgtttgggagctccagcggcgggggtgccaggagggagaaggcgtcctatggccgaggagcagcagctgcaattgaggatagctccattgacattggtgacttcttcaagggccctctacctgggaagttcctgaagctccttggttttttggccttgtctaggcttggtgtgtatataccactgggtggggtcaaccgagaagcttttgctgggaaccttgaccagaacagcctgctgggcactttagattctttctctggtggaggtatcggccggcttggaatttgctcccttggcattgtaccatttatcaatgcacagattgtgtttcaactccttgcgcaactctacccaaaattgcaagaccttcaacggaaagaaggggaagcaggaagaaagaaggttcttcagtacacaagatatgcttctgttggatttgcaatttttcaggccattggacaagttctttatctccgtccttatgtaaatgacttcagcacagaatgggttctaacatctgtgacattattgacacttggatcggtctttactactttcattggtgaaagaatatctgatctgaaacttggaaatggaacatcccttcttatatttacaagtataatatcatatttgcctgcgtcattcgggaggacagttgcacaggcatttcaagatgggaattatgttggacttctcacaattatattgtcattctttctattagtccttgggattgtctatgtccaagaagctgagcgcaaaatacccctcaactatgcttctcgttacagcagtcgaactgggggacttcagcgatctgcatatctgccatttaaggtcaacagttctggtgtcatgcctatcatattttctacatcttcactggctttgcctggtactttggcacggttcgctggcttagactttcttaagaaggctgcgatagcccttaatccaggaggtgctctctatcttccaactaatgtattacttatagccttcttcaactattattacacgtttctccaattggatcctgatgatcttagtgagcaattgaagcggcaaggtgcttcgataccgcttgtgaggccaggaaaaagtacagctgcttatattaaaacagttcttagtcgcatatctgtcctgggatctgcatttctggctgtgctagctgctggaccatctgtagttgaacagataagtcacttgacagcattccggggatttgctgggacttcagtgcttatccttgttggatgtgcaacagacacagctcggaaagttcaagcagaaataatttcccagaaatataagaatattgagttctatgatgtcaaccgttttgaccaataattgatctcactggtcattcttttcaacctgtacttagttttttaattgtgtaattgaatattggatccgtaaggctgtaactaagcattttcttatttttcacttgggtcttaattttttgtactgtgtatagcacttaaatctatacttaaagtacataaatcattcatctgtacactaacatgtcagagcactcaagtcttaaagctatgaatgctcattgttattcacaattcttgttgctgatgatgtaacatgtattttgtccttaacaaaaaggagcttaaattacggatcccatccatatttattatgtttaactttattagatcaactgaagaactggctgaatggtcatgatttctatgaggcaaggtgagatgtactgattaaatagggctggggagttgaactcagctgtttcattttgtacaccactatgaacatgcacacctc

SEQ ID NO: 148 - DNA, 635 bp, Sorghum bicolor
cctgttcggtgctcgaagcaacagctgccgccatgtctgccgccaaccagctcgccgcgctcatccacaacatgttcgccacgggtttgcttgacgaccagttccagcagctccagatgctgcaggaccccagcgctcctaacttcgtcgccgaggtcgtcacgctcttctgccaggacggagagcggatcatcggagagctggccaagctgctggacaagcccgtcgtggattttgacagggtcgacgcctttgtgcatcagctcaaaggcagcagcgctagcgttggtgcactgaaggttaagaacacttgtgttcagttccgcgagttctgtcagcagaggagcaaagatgggtgcctgaagacactggagatggtgaggattaacttctatgagctgcgtggcaagtttcagaccatgcttcagctggagtgtcaggtcaacggcttccctcccaacaactaaaccaaatggcagcgctgagcttcatgtcaggattatgcatgcacctttcaaatctcaagacattctgaatgagctcctcaattggcttgtgggaagcctgtaatagcttagcagcagtagtagtgttaacaccaccgtagtagtatcattgttgtcgctcccaataat

SEQ ID NO: 149 - DNA, 2607 bp, Oryza sativa
cccaataaaccccccatggcgtcctccctctccctcgacgacatcaacgacgactccgtcgacctgtcgaaggcgccggtggcggaggtgttccagaagctgaaatgcgaccggaaggggctcaccggagcggagggagagagccggctgcggctgtacgggccgaacaagctggaggagaagaaggagagcaagcttctcaagttcttgggcttcatgtggaacccgctgtcgtgggtcatggagatcgccgccatcatggccatcgtcctcgccaacggcggcggccgcccgcccgactggcaggacttcgtcgggatcgtctccctgctcatcatcaactccaccatctcctacatcgaggaggccaacgccggcgacgccgccgccgcgctcatggccggcctggctcccaagaccaagctgctcagggatggcaggtgggaggagcaggaggcggcgatcttggtccccggcgacatcatcagcatcaagctcggcgacatcatccccgccgacgcgaggctgctcgagggcgacccgctcaagatcgaccagtcggcgctcaccggcgagtcgttgccggtgaacaagcacccggggcaggaggtgttctcgggctccacggtgaagcagggcgagatcgaggccgtcgtcatcgccaccggcgtgcgcaccttcttcggcaaggcggcgcacctcgtcgacagcaccaacaacgtcggccacttccagcaggtgctcaccgccatcggcaacttctgcatcatctccatcggcgccggcatggcggtcgaggtgctcgtcatgtacccgatccagcaccgcgcctaccgcgacggcatcgacaacctcctcgtcctcctcatcggcggcatccccatcgccatgcccaccgtgctctccgtcaccatggccatcggctcccaccggctgtcgcagcagggcgccatcaccaagcgcatgacggccatcgaggagatggccggcatggacgtgctctgcagcgacaagaccggcacgctcacgctcaacaagctcaccgtcgacaagaccctcatcgaggtgtgctccaagggcgtcgacaaggacatggtcctcctctacgccgccagggcgtcgcgcgtcgagaaccaggacgccattgacacctgcatcgtgaacatgctcgacgaccccaaggaggcacgcgcggggatccaggaggtgcacttcctccccttcaaccccgtcgacaagcgcaccgccatcacctacatcgacggcaatggcgactggcacagggtgagcaagggcgcgccggagcagatcatcgagctctgcaacatggccgccgacgccgagaagaaggtccacgccctgatcgacagctacgccgaccgggggctccggtcgctcggcgtgtcgtaccagcaggtgccggagaagagcaaggacagcggcggcgacccgtggcagttcatcgggctgctgccgctgttcgacccgccgaggcacgacagcgcggagaccatccgccgcgcgctccacctcggcgtcaacgtcaagatgatcaccggcgaccagctcgccatcgccaaggagacggggcggcggctcgggatgggcaccaacatgtacccgtcgaccaccctcctcggcgacaagaacagccaggtgaacggcctccccatcgacgagctgatcgagcgcgccgacgggttcgccggcgtgttcccggagcacaagtacgagatcgtgaagcggctgcaggagatgagccacatctgcggcatgaccggcgacggcgtgaacgacgcgccggcgctgaagaaggcggacatcgggatcgccgtggacgacgccacggacgccgcccggagcgcgtcggacatcgtgctgacggagcccgggctgagcgtgatcgtcagcgcggtgctcacctcccgcgccatcttccagcggatgaagaactacaccatctacgcggtgtccatcaccatccgcatcgtcctcggcttcctcctcatcgccatcatctggaagttcgacttcgccccgttcatggtgctcatcatcgccatcctcaacgacggcaccatcatgaccatctccaaggatcgcgtcaagccgtcgccgacgcccgattgttggaagctcaacgagatcttcctcacgggggtggtgctcggcacctacatggcattggtcaccgtgctcttcttctacctcgcgcacgacacgaacttcttcacggatgtgttcggggtgacgtcgatcagggagagcgagagggagctcatggcggcgctgtacctgcaggtgagcatcatcagccaggcgctcatcttcgtgacgaggtcgaggagctggtcgttcgtcgagaggcccgggttcttgctgctcttcgccttcttcgctgcgcagatggtggcgacggcgatcgccgtgtacgcgcgctgggatttctgccggatccagggcatcgggtggcggtggggcggcgccgtgtggcagttcagcgtcgtcacctacctcccgctcgacgtcctcaagttcatcatccgctacgccctcaccggcggcaaggccggggacagcgcccagaaaaagtgagggaatccttga

SEQ ID NO: 150 - DNA, 1204 bp, Zea mays
tctctaaccctacagcgacgacgagagcgaggccatgaaggggaagaagccggtcaaggagctcaagctcaccgtgccggcgcaggagaccccggtagacaagttcctgacggcaagtggcacgttcaaggatggtgagctgaggctcaatcagagcggcttgcggcttatctctgaggaaaacggggatgaagatgaatctacaaagctgaaggtggaagatgtgcagttatcaatggatgatcttgagatgattcaagtcattggcaaaggaagcggtggtgttgtccagctagtgaggcacaaatgggtgggcacattatttgccttaaagggtattcaaatgaacattcaggagtcagttcgtaaacaaatagtacaggagctcaaaataaaccaagcaacacagagccctcatatagttatgtgccatcaatctttttaccacaatggtgtaatatatcttgttcttgagtacatggaccgtggatcgcttgcagacattgttaagcaagtgaagactattctggagccataccttgcagtactttgtaagcaggtcttggagggtttattgtatcttcatcatcaaaggcacgtgattcacagggacataaaaccatctaacttgttggtcaaccgtaaaggtgaagtcaagattaccgacttcggagtgagtgctgtgctagcaagctcaataggtcagcgagatacatttgttggaacctacaactatatggcgcctgagcggattagtggtagcacttatgactacaaaagtgacatatggagtttgggcttagttatacttgagtgtgccattggccggttcccttatataccttcggaaggtgaaggttggttaagcttttatgaacttctggaggccattgtcgatcagccaccaccttctgcacctgcagatcagttctctccagaattctgctcatttatctcctcttgcatacagaaagatccggctcagaggatgtctgcttcagaactcttgaatcacccttttttgaagaagttcgaggataaggacttaaacctggggattcttgtggagaacctggaacctccaatgaatatacccgaatagcctgtcgtttttagtgatgaagcctttgttgtgccttcagggtttggcctcgaagcctcttggcatctgctcctcaactgcagcctccctacctgaatatgc

SEQ ID NO: 151 - DNA, 1202 bp, Sorghum bicolor
cgcacgagtcttcttcttcttctagagatcgactgatcgacgacgacgacgaacgcaatataatgggtcccaactcgtcggcgctgggcaagcagcagcaggcggcggcggccatggcgccgaagcgggcgtacgtgaccttccttgcgggcgacggcgactactggaagggcgtggtgggccttgccaagggcctgcgccgtgtcggcgccgcctacccgctggtggttgccgtgctccccgacgtgcccgaggagcaccgccgcaagctccgcgaccagggctgcgtcgtccgcgagattgagcccgtgtacccgcccgacagccagacgcagttcgccatggcctactacgtcatcaactactccaagctccgcatctgggagttggtggagtacgagcgcatggtgtaccttgacgcggacatccaggtgtactccaacatcgaccacctgttcgacctggagaaaggcaagttccacgccgtcatggactgcttctgcgagaagacgtggagccacacgccgcagtacaagatcggctactgccagcagtgccctgagcgcgtggcgtggccggagcaggagcaggagcaggagcttggcccgccgccgccgctctacttcaacgccggcatgttcgtgcacgagcccagcctgcgcaccgcgaaagacctgctggacgcgctggtggtgacgccgccgacgccgttcgcggagcaggacttcctcaacctcttcttccgcgacgtctactcgcccatcccgccggtgtacaacctggtgctcgccatgctgtggaggcatcccgacaagcttaaggtggtgcggctcgacgaggtcaaggtggtgcactactgcgccgccgggtcaaagccgtggaggtacacggggaaggagcccaacatggaccgcgacgacatcaaggcgctggtggccaagtggtggcacatcttcgacgaccagaccctcgactacaacggcggcgaggcggcggcggaccaggcgagtctgccgctgcgccaggccctggctcaggccggcgccgtcaagtacttccccgcgccgtcggctgcctaggcgacgccggttgcatgcaggccggccgggacgacgacgtgccaagcagctgggcgaatcggtcggccggctggtggctccggtcctctactactggcgctcaacgaggcgcttaattattag

SEQ ID NO: 152 - DNA, 1982 bp, Zea mays
agggtttagagcccaacttctctcttcacatcgccgcgaagccagctccccgatgcgatctggccgagggaagatggcgactccgccgccgccaatccgccccgccgccgcgctcctcctcctcgtcctcgctggcgtcctcgcctccgccgcgagcgccgatctcgtcatctccaaggcagatcggagggttgatctgacctcgcatatcgttcgcgtcctcgcttccctcaaggctgaaaatgttggaccagaccctgtctctcaagttttactgccttttcccaatattcaagccaagaacttggcagctattagagcattcggcagtgaagggaaagtgaagggtcaaagtactgttctgccaattgaagttgttcaaccttctggagctcccccggagctgacattcttttcagcattgttgcccaaacctttggaaaaaggaaagactctgtacttggatgttctgactgtgttcacacactctcttcaaccattcccagaagaaatcactcaagccgaagcacaacttgttgtctatcaggatagtgctcactatctgtcaccttaccctgttaaggctcagacacttgctatcagattgcctggtggaagggttgaatcatacacaaggcatccaaacgcaaaacttgtggattcagaactgaaatatggaccatttcatgaccttcccccgttctcctacttacctgtgattgtgcattttgagaacaacaatccttttgcagttgcaaaggaagttataagggagattgagatatctcactggggaaatgtacagattacggaacactacaacattgctcatggtggtgccagactcaagggtgaattttccaggattgattatcaatctagaccttacgtaaggggtgtttcatcttttagacatcttattgcaaaactgcctccaagggcacactctatttattaccgagatgagattggtaatatttccacatcacatttgtggagtgattctatgaagacccaactggaaatagaaccaaggtttccattgtttggtgggtggcaaacaaccttcactgttggttatggtttaccacttgaagactttgttttctattctgatggaaagagatttctcaatatcacatttggttctccattggaggaaattctcattgaaaagcttatcgtaaaggttgttctacctgaagggtcaaaggatatcgaagtttcagctccctttccaacacagcagcagcaagaggttaagtattcacaccttgacattgtcggaagaccagttgttgtcttggagaaacctgatgttattccagagcataatttgtatttccaggtttactacagattcaacaacatatccttgctcagagagccgttgatgctgattactggtttcttcctcctgtttgtggcctgtattgtttacatgcgtactgatatgtcaatatccaagagctctccttcctacttggccaagctgcaatgggatgaggtgcaagcaactgttcagaaaatccagggtatctttgagcaatgcttagcagttcatgataaactggaggcctcgttgcgggatttgtctaggacaggagacattcagtcttgcaaggcagctcgtaaagctgctgacacgcagtttaaggagctatcgaaagatctgaagccactgttggcgactctacagtcatctccccagtcttatcagatatggccaaaggtagaggacttgatcgtaaaggagagagatatgcaggagaagctcatgacaaggcattccaccgttgtcgacagctttgagaagaagctgcgcgggcaagatgtagagaacaggattgctttgcagcagcagaaaattgctgccctgaggcaggaggttgaatctcttttagagtacattagtgagatttgagcatttgagtgctgctgtggcgtgatacatctttagcgattagactgcctttgtttgg

SEQ ID NO: 153 - DNA, 1660 bp, Sorghum bicolor
cgaccgtaccactttattcagccccgactgattgcaatggctgcagctccggccaatggtgattcacagagtggtcctcagaggaactatcaagttgttgttgctgccactcgtgacatgggcattgggaaggatggggttttgccatggaagcttcttggtgatcttaaattcttcaaagagcttacactaactacatctgatcctgccaagaagaatgcagttataatgggaaggaaaacatgggagagcattcctgttaagtcaaggccattgcctggtcgtttgaatgtcatacttactcgatctggtagctttgattttgcaacagtagagaatgttgttatatgtggaagtatgaagtctgccttagaactgctagcatcaactccatactgcttatcaattgagagagtttttgttgtaggaggtgggcaggtactgagagaatatcttaatggacccgcatgtgaggctatccatctaactgacattcagtcgagcattgagtgtgacactttcatccctccagttgacttctcagtgttccagccatggtattcatctttcccagtggtagagagcaacattaggcattcttttgtgacttttgttcgtgttagaaagtcagtggcagaaactcatgagtcaaatggcaaggaatcaactgaggttgataccaagaatgacaaatttgaaatagagaatttctcttttctccccgagatggtatatgaccgccatgaggagtatcaatatctcaatcttgttgaagatattataaggtctggtgctcagaaaaatgacaggacaggaactggaacattgtcaaaatttggatgtcagatgcggttcaacttaaggaaaaattttcctctgctgacaacaaagagggtattttggcgtggtgttgtcgaagaactcctttggttcatcaatggctcaacaaatgcaaaggttttgcaagagaagggtattcacatctgggatggcaatgcttcaagagagtatcttgacagtgttggcttggcacacagggaggaaggtgatctaggtccagtttatggatttcaatggcgtcactttggtgctgaatacactgacatgcatgctgactatactggaaaaggttttgatcagctaatggatgtgattgacaagatcaagaataatcctgatgaccgccgaataattatgtctgcgtggaatccttcagatctcaagaagatggctcttcctccttgccacatgtttgcacaattttatgttgaaaatggggagctatcctgccagatgtatcaacgctctgcagacatggggcttggtgttccattcaacatcgcatcatattctcttctgacatacatgatcgctcaagtttgtgatctttctcctggagattttgtccatgttataggggatgctcatgtctatagaactcatgttcgagctctggaggagcaaattcagaagatgcctaaaccatttccaattttgaagataaatccttcaaaaaaggatatagattctttcatggcatcagatttcaagctggttggctatgatcctcaccagaagatagagatgaaaatggcagtgtaatggtggcttagctgtggagccccagcctttgaacttggtgggtgaaatcagtcagact

SEQ ID NO: 154 - DNA, 1692 bp, Zea mays
gtttccgaattcaccaactcctgcacgccgcgtcgagatcgttcacgccttagcttcgggaactccaccaataagcccaccggctggagcaatggggagcacggggcgcgagccggaggtgacccgcgccaacttccccgacggcttcgtcttcggcgtcgccacctccgcgtaccagatcgagggagcgagaagagagggaggcaaaggagacaacatatgggatgtatttacagatgacaaagaacgtgtcttagacagaagcaatgcagaaattgcagttgaccactaccatcgatacaaggaagacattgagctcatggcaagtctaggttttagcgcatacagattttctatatcttgggcacgtatatttcctgatggcttgggggaaaaggtcaatgagcaaggagtcgccttctataatgacctcatcaactttatgatttcgaaaggtattgagccttacgcaacactgtatcattgggatcttccaaacaatcttcaaaaaactctggggggctggatttctgacaagattgtggagtactttgcattgtatgcagaagcttgctttgcaaatttcggagatagagtaaagcgttggataacaatcaatgaacctctccaaaccgcaatcaacggttatgggattggaatttttgcgcctggaggatgccaaggtgaaactgcaagatgttacttggccgcccatcaccaaatcttggctcatgctgctgctgttgatgtttatagaagaaaattcaaggctgcacaaagtggtgaagtaggcttggttgttgactgtgaatgggcagagccattttctgaaaaactcgaagaccaaattgctgcgcaacggaggattgactttcaacttggatggtacctagatccaatatattttggtgattacccagaaagcatgcgtcagcgactgggcagtgatcttccaaccttctcagagaaagataaaaaattcatcaagaacaaaattgattttattggactaaatcattatacttcgaggctcattgctcatcaccaaaatcctgatgatgtttatttctacaaagtgcaacaaatggagagagtagaaaaatggagtagtggtgaaagcattggtgaaagggctgcatctgaatggcttgtcatagttccttggggccttcataaattacttaactatatagtgaagaaatacaacagtccagtaatttatgttactgagaatggcatggatgatgaagacgatcagtccgcaacgattgaccaggtcctaaacgacacgaagagagtcggctacttcaacggatacctcaattcggttgcgcaggcgatcaaggacggggctgatgtccgtgggtacttcgcgtggtcattcctggacaacttcgagtgggctatgggctacaccaagaggttcggcatagtctacgtcgattacaaggacgggctctccaggcaccccaaggcatcggccctctggttctcgcgcctcctcaagggcgaggctgccgaaaacagctatagctagagctgccatagactgagggaacagtccgcggcaagtacagaacattacatacacacatttctcctgtctgttgttgtgttgtgtcttacggtgagtgcacccgtgtatgtatgtatgtatgtatgtaatctcaggatgtgctagtctgtcgttga

SEQ ID NO: 155 - DNA, 440 bp, Zea mays
tgactatggcactagcggctatctataaccttttcatcattaacaaatcaggcggccttatatactacaaggactatggttcagcagggaggatggataccaatgacagtctaagattagcaagtctgtggcattcgatgcatgctatctcccagcaactctcccctacccctggctgtactggcattgatctcttacaagctcataactttgatctccattgctttcaatccctcacagggacaaaatttttcgttgtatgcgaaactggagctccaaacatggaaatgctgctgaaagtgatttatgagctgtacacggacttcgttttgaagaatccgttctatgagatggagatgccgatccggtgtgagctgtttgatcacaacctggctcagatgatccagaaggaccgtgttgcgcttctgggtcggtgatga

SEQ ID NO: 156 - DNA, 2208 bp, Oryza sativa
ctcccatggcgaagaagggcgcgccgcgcaggcagccgccgccgccgccgcctcggcaactggccgcggggaagaaggggaaggcctccccgaaggcggcgaagagggcggcgcccaagaagcagaggctgctcgagtcgtcctccgacgactccgagctggagcagcagcaggggcagcttcaggaggtggagtccgggtcagacctcgacgtcccctctgattccggcgccgaggagctctccgactcggacgacgcctcctttgagggaggagacagcggcgacgaggaggaggaggaagacgatgaggatggcgacgacgaccccctcgctgacgacttcctcgccggcagtgacgacgaaagtgacggaggagacgactctggtgtggactcagatgagtctgatgacttagaggcgaagtcgcgagcgattgatgaagagaaagagaaggcagaagaagaggctgaggaggagctcaagctcaatattagatcagaatctgatgagttccgattgcccacaaaggaggagttggaggaagaggcacttcgaccaccaaacctgccgaatcttaaaaggaggatatcagaaattgtccgggtactctcaaactttagtaagctgaggcaaaaagatgtgccgcgaaaggattatgtcaatcagctgaagacagatataatgtcatactatggatacaatgattttctcgttgaagcatttattgagatgttcccagctgtggagcttgttgaactactggaatcttttgagaaaagaccgcctgaatgcttacgaacaaatacattgaagacccggagaagggatcttgctgctgctcttataccaagaggatttaatctggatccgatagggaagtggtcaaaggtaggccttgttgtatacgactccaccatttcagctggtgccactgttgaatatatggctgggcattacatgaaacaaggtgcaagttctttcttacctgtgatggctcttgctcctcaggagaaagagcgaattgttgatatggcggctgccccaggtggcaagactacatatattggagctcttatgaagaatactggaataatttatgcaaatgagttcaatgagaaaaggctgcatggacttttgggcaacatacatcgcatgggtgttaccaataccatagtttgtaattatgatggtaaagagctacctaaagttcttgggatgaattcggttgacagagttcttttggatgcaccctgcacaggcacagggaccatttggaaggatccacaaattaaaacgtcgaagggcattgaggacatcagagactgtgcttttgtacaaaagcaattgctattagctgctattgatttggttgatgccaactccaaaactggaggttacattgtttactcaacatgttcattgatgattccagagaatgaagcggttgttgactatgcccttaaaaagagaaacgtaaagcttgtaccttgtggattagattttgggcgtccaggattcatccggttccgagagcatcgattccatacttctttagataaaacaaggagattttatccccatgtaaacaacatggatggtttttttgttgcgaagcttaaaaaattgagcaatacgatcccagtggcatctgagtcatctaatgtgcctgaagaagcaattgagaaggctgatcctagcagtgacgatcctcaaaaacagcccattcagtcaaaaaaacataaagatgtgaagacgacgaatgaagagacaagcatccttgatggggtgactaaggacaaaaggcagacacatgagacactcaagaaccacaagaagggtaagaaacgcaatggccctgagagtactaaaataaagggagaccagaaagaaacacacaacgaagaagagcctacaagtgaaaaaaagcagcctgtgtctgctaaaataaaaaaatctgttcccaagagaatatcaggtaacaaaggaaagaagctggatacgggcaaaggagagaagaggaaaagaaactggatggtgaggcgagactgggaagcttataagaagtcgaggagtaaacaagtatgaaaggcacggatgaaggagctctagccgtagacaaattgcagttaaatttgaaaacccacatacggggaagatgttagaaggagcgagaatacacaattttggcgttggttcaagttcgagg

SEQ ID NO: 157 - DNA, 2067 bp, Sorghum bicolor
agcctctgctctctactccacacgcgcgcctctgtgtgtctcactgtctcccctgtcccgcgtggtgggcatccatgggatgagagcgccttcctcgccatggccgcctccctcctgccccccgcagccaccctcgtcaagaagtacccagctctcctccacccgtccggcgccaagccgcacgcccagaggctgatcttcaggtgcggcgccaccagtgcggacgatggctgggcgtccttagtggacgagctcaagaggtcgctgcagcaggcggacacgtccgacacggtgaccagcaacgcgggagcgggtgtcacaccgaacgacctcgtgaccgcgctgccactggaaccttccaccaccaccggaccggcggtgggagacgcgactagtgccgccgccggcgcggtgaacgagctcctgggcgtggacgcggccagcagcgacggtggcggcgcggccgccatccccgacgggctcctgagcgcgctgctgcacctggacgcgtcgtccaacccggtggcgcgcgcggcgggcggcgcgctgtctggcctggacgcgctcacgtcggggctgtcggacgcgcagcggtgggcgctgttcgggttcctggccgcgacgtggctgtacctgacggcgcggcccggggtgctgagcggcgccgtggacacgtacgtgctggcgccgctgcagctggcgctggacagcgtgctgggccggcggagcctcaagatgagcgacttcgtcgtcggcgagcgcatcggggagggatccttcggggtggtgtacgccggcgccgtggtgcccaaggacggcaccgtcgtggaggagcggtccggcagggccaggacgaccctccagaacgacgacaggtacaaggagaaggtcatactcaagaagatcaagatgctgacggtgggggcgaaggagtgtggggactatgaggagtggttcaactaccgcgtggccagggcggcgccggagtcgtgcgccgacttcctcgggagcttcgtcgccgacaagaacaaggcagagttcgtcaagggtggcaagtggctcgtctggaagtttgagggggacagaacgttggccaattatatgagtgaccgcgggttcccgtcgaacctggagcggctcatgttcggacgcgtgctgcagggtctgcgcacccaggagcgcgacgcgctggtggtgaagcaggtgatgcggcagctgatcacgtcgctgaagcgcatccacgcgacgggcatcgtgcaccgcgacatcaagccgtccaacctcgtcgtcacccgccgcggccaggtgaagctcatcgacttcggagccgccaccgacctccgcatcggcaagaactacgtgcccgaccgcgccctgctcgacccggactactgcccgcccgagctctacgtgctccccgaggagacgccggagcccccgccggagcccatcgccgccatcctctccccgatcctctggcagctgaacagcccggacctgttcgacatgtactcggcggggatagtgctgatgcagatggccataccgacgctgcggacacagtcggggctcaagaacttcaacgccgagctcaggtccgccggctacgacctcaacaggtggcggcagagcgcgcggcggagacccgacctgcagatcctggacctcgactctggtcgaggctgggacctcgccaccaagctcatctcggagaggggccccaacggcgggggccgcctgtctgccgcggccgcattgcggcacccttattttctcctgggtggcgaccaggccgcggcggtgctgtccaagttctcgctcagcaaatagcatccatccatggctcatgcctgggcagtgccgcagtggacacctacagtatataatatatatacacattggattactggaatcctcccaacaattcatcatcggtgatggtgtacattgcgcattgttgaatccttagcataccagtggggcagtggtcagcaatggcactgtcatttttcgctgtaaagccaatcgtgagaggcatcaagagggagtcatctggcaactgatgtt

SEQ ID NO: 158 - DNA, 2066 bp, Oryza sativa
gccgcatgggtgactcgacggtggccggcgcgctggtgccatcggtgccgaagcaggagcaggcgccgtcgggggacgcgtccacggcggcgttggcggtggcgggggagggggaggaggatgcgggggcgcgcgcctccgcggggggcaacggggaggccgcggccgacagggacctcctctgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtcttgaagaaaatgtcagctcgccaaattgcgaagacagcatcaccgatagaccaatttcgatatgcactgcaacagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgagattcaaactgacctacagtacatcaaagaagatataagtgctgtggagagacataggttagaattatatcgaacaaaagaaaggtactcaatgaagctccgcatgcttttggatgaacctgctgcatcaaagatgtggccctcacctatggataaacctagtggtctctttcctcccaactctcggggaccacttagtacatcaaatccagggggtttacagaataagaagcttgacttgaaaggtcaaattagtcatcaaggatttcaaaggagagatgttctcacttgctcggatcctcctagtgcccctattcaatcaggcaacgttattgctcggaagaggcgagttcaagctcagtttaacgagcttcaagaatactatcttcaaagacggcgtaccggagcacaatcacgtaggctggaggaaagagacatagtaacaataaataaagaaggttatcatgcaggacttgaggatttccagtctgtgctaacaacattcacacgatatagtcgcttgcgtgtaattgcggagctaagacatggagatctgtttcactctgcaaatatcgtatcaagtatcgaatttgaccgtgatgatgagctatttgctactgctggagtctcaaagcgcatcaaagtcttcgagttttctacagttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccagagtgtgatggagtatgaagaacatgaaaagagagcatggagtgttgatttttctcgaacagaaccctcgatgctagtatctgggagtgatgattgcaaggtcaaagtgtggtgcacaaagcaagaagcaagtgccatcaatattgatatgaaggccaatatttgctctgtcaaatataatcctgggtcgagccactatgttgcagtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtaaggacattcagagggcacaagaatgaaaagaactttgttgggctgtctgtaaataacgagtacattgcctgcgggagtgaaacgaatgaggtttttgtttaccacaaggctatctcaaaacctgctgccaaccacagatttgtatcatctgatctcgatgatgcagatgatgatcctggctcttattttattagcgcagtctgctggaagagcgatagccctaccatgttaactgctaacagtcagggcaccattaaagttcttgtacttgctccttgatga

SEQ ID NO: 159 - DNA, 2255 bp, Hordeum vulgare
gtttctgcttgcttggaactcgggatctcgtcgggagaggcggcggcggatttgggatttgggggccatggcgtggcggcgcgtcctctcccaggctgcaaggaaccaatcagcatatgcaatctataatgagttggcagcctcctctcctctgaggttacttagaagtgacatcagtgcaggtggtgcactcaggaacttacatgagaggtatcattcgagctattttggtggcctttcacgcagcatgcgagacctgggctcccaaagtgaagcttctatgctaaaagagatatacagaagtgacccagagcgtgtgataaaaatatttgaaagccagcctttgttgcgttcgaatccttcagcactatctgaatatgtaaaagctcttgtaaaggttgataggttggatgatagcaccttgctaaaaacattgcaaagaggtcttgctgcttcagaaagggcagaaggaagccttggtagcgtgccggcattaaagagtgctggtcaagtgacaaaagatggaattattggcactgcgaatgcgcctattcacatggttacagcagaaacaggtcaatttaaggatcagctttggcgcaccttccgaagcattgcactgactttccttttaatttcgggcatcggggctctcattgaggatagaggaatcagcaaaggccttggtctaaacgaagaggttcaaccaagcatggaatctagtacgaaatttagtgatgtaaaaggtgttgatgaagccaaagctgagctcgaggaaatagttcactaccttcgagatccaaagcgttttacacgtcttgggggaaaactgccaaaaggtgttctgcttgttggccctcctggcactggcaagaccatgttagcgagggctattgctggggaagccagcgtcccttttttctcgtgcagtggtagtgagtttgaggagatgtttgtaggcgtgggagctagaagagtgagggatctttttgctgcagcaaaaaaacgatcgccttgtatcatatttattgatgaaatcgacgcaattggtgggagtagaaatccaaaggatcagcagtatatgaagatgaccttgaatcagttgcttgttgagctggatggctttaagcagaatgaggggataatcgtcatcgctgcaactaacttccctgagtcattagataaagcactagtcagacctgggcgctttgatcgtcatattgttgttcccaatccagatgttgagggcagacgtcaaatcttagaggcccacatgtcaaaggttttaaagggtgatgatgtggatttgatgatcatcgccaggggaacaccgggattttcaggtgccgaccttgctaacttggtgaatgtggctgctcttagggctgccatggatggtgcaaaatccgttagcatgaatgatcttgagtatgccaaggaccggatcatgatgggtagtgagcgcaagtcagcagttatctctgatgagtgcaggaaactgacagcataccatgaaggagggcatgcccttgttgccatgcacactgatggtgcgcaccctgtccacaaagctaccatcgtgcccagggggatggcccttgggatggtggctcaactccctgacaaagacgagactagtgtgtcaaggaaacagatgctagcaagattggatgtgtgcatgggaggacgggtggcagaggagcttatatttggggatagcgaggtgacatctggtgcttcatccgactttgagcaagcaactttgatggcaagggcaatggttacccagtatggtatgagcaagcaggtgggtcttgtttcgtacaactatgaagatgacggaaagactatgagctcagaaacgaggcttctaattgaggaggaggtgaagaatttcttggagagagcatacaacaatgcaaaggctatcctcaccaaacacaacaaggaactccatgctctagccaatgcacttcttgagcatgagaccatgagcggaacccaaataaagaacttgttggcccaagtagataacaaacagccgcagcagggtcatgctgttgaagccccacagaaggcgccagcttcacccccatctccagcggcagcggcggcagcggctgccgccgcggcagcacaacaagcggcagcgcaagccaagggagttgctggtatcgggtcttagcatccacatgtttgcattgtgtatattaattcaccaaattagcaggttgttccgtcaaactgtcaactga

SEQ ID NO: 160 - DNA, 684 bp, Hordeum vulgare
gaagaaccagtcgaggaggaggaaggagaagccatggccgagctgctgttcgcccctgccatggccggcctcgtccacctgccggaggtgctcgaccgcctcgccgccgcggacgccgaccaccgcgaccacgcccaccaccacgccgcccacgggcacgggcacgctcacccccgcgcgcacatcggggccggcggcggcgcgcccgtggacatcgtggagacccccggcgagtactccttcctgctcgacgtccccggcctctccaagtccgacatccaggtgactctggaggaggacaacgtgctggtgatgaagagcgccagcagcagcaacggcggcggcgccaacgggaagcggaagcgggaggaggaggaggcggactgccgctacatccggctggagcgccgcgcgtcgccgcggtcgttcgtgcgcaagttccggctgccggaggacgcggacgcgggcgccgtggccgcgcgctgcgagaacggcgtgctcaccgtcaccgtcaagaagcagccgccgcccgagaagaagaccaagtccgtccaggtcgccatcgcctgatctgtacctcagtcgcgccagctttcggtacctcatcggcgtttgtcatcagtgatcagtgtagcagtagtcggtagactagtgtggcgagtcaggtagatttgggtggtgttc

SEQ ID NO: 161 - DNA, 1278 bp, Hordeum vulgare
gagctcacaccactcacctccgactccggccatggcgaccatctccgcagctctctctgtctccatcctcccgtccctggcccggcgcgccgtctccaccgccacctcctccccgccgcgcttcaagagagccgcgcggttccggtgctgcgccgagcctccttccccggagcagcagaagacctccgcgcctccgccccctcctccggcgccgccttcgtccctgtggggcgtctccacgagcgcctggaccgcgggcgtcgcggggctggggctcctggagaccggctacctcagctacctcaagctcacgggctccgaggccttctgccccgtcgccgggggaggctgcggcgacgtgctcgacagcgactactccgtcgtattcgggatccctcttccattagttggtatggtgacatatggtatggtgaccgcactttctctgcaagaaaatggagatgagttgctccctgggctcgatgacttggatatccgcctgaccttgcttctgcttgctacttcattggcgactgcgagtgcttattttctcttcatcctgaacaccaaatttgtcgggacgtcttgcttatactgcctatcgtcagcatttatctccttcacattatttttcatcagactgaaggaattgttgcaggacattggcttggcacgtatccagaagttcgttggtcttcagttagctgtagctgtcattgttgctcttgctttaacaaactcatatagttcggctactactcaattaaagggtacaggcgatttcgtattagaaccatacaaaacagaggtaacatcagaatcaaccccttttgctatttcactggcaagacatctacattccataggtgctaagatgtatggagcattctggtgtactcactgcaatgaccaaaaacaattgtttggccgtgaagccatggaaattctggattacgtggaatgcttccctaatggagccggtaaggggaagaaaatggccgaggaatgtgtagccactggtctggaaggttttccaacatgggtcatcaacgggaagctcttgagcggcgaccaggaactctcagtcctcgcagaagaatccggttttgtctccgagagcccagagcaatcctgaggccatggagcttgacgagcagaagcaccccgccgaatcgaggagcagaaatagagagctctctagaggcaagaacctgaagcctgtggcagttaacagcaacaccacaaaactcccaaccgagcttcagatgaggtgcattc

SEQ ID NO: 162 - DNA, 1313 bp, Gossypium hirsutum
tgctttctctcctaagctctagtcactccccaaatctctccctcccttccctgtaaattcacagttatgccatcctctcccaagttcttccacgcgcgcacttcgccgccggcaacacctcacaccagatctactctcctcatcttcgcctccctcctcaccttcgccattgtctctttcctctttgccctctcttctttcctttcctccggtggatccggttaccgttgccggaactccgaccctagatccgtccgtgtcatttgggacaaaactggtcatggcaacaacggtctttccgctgctggtgatgatgatgggactaagaggcataaaataatgggcttcgttgggatccaaaccgggtttggctccactggtcggagacagtctttgagaaagacgtggatgccttctgatcgtcaaggccttcaacgattggaagaagcaactggattagcttttaggtttgtaattggtagaacaaatgataaatcaaagatggcagagctgaaaaaagaagtagcagaatatgatgatttccttttgttagatattgaggaggagtacagtaagctcccgtacaaaacgttagcattttttaaagccgcgtatgcactctttgattcagagttttacgtcaaagctgatgatgatatatatttgaggccagatcggctatcacttttactagtaaaagaacgttctcactctcagacttaccttggttgcatgaaaaagggtccggtattcaccgatcctaagctaaaatggtatgagccattatcctttctcctaggcaaggagtactttcttcacgcctacggtccaatatatgctctttcagctgatgttgttgcaagtttggttgctctaagaaacaacagttttcggatgttcagtaatgaggatgtgaccattggtgcatggatgcttgcaatgaatgtcaaccatgaggataatcgagcattatgtgagccagagtgtacgcaatcatctgttgctgtctgggatatccccaaatgttcagggctatgcaatccggagaaaaaaatgttggaacttcatcagatagatgcctgctctaaaagtccaactttgccatcggacgatgattagcttaattggcaaaacacagattttattaacatggaaaggtgtcagaattgtttgttctggtaagttgatcttattgccctcagacatatctcaattaccccgttcgatcatcgcaagccatttttgtcttccgccatcgttttagtctgtaatatattaagcttttttttcactgacgatgcaagttaccaaga

SEQ ID NO: 163 - DNA, 919 bp, Zea mays
ttatttcatccacgctgctcgtgctcgctgcctgcttcttgcgcgatcgtctcggcctctcgggactctagagtggcggccggctctccgcctgttcttgtcgtcgctgctcctttccctgtgagcttaaaatatacacaggatgtcggaacgttctgagagtgcaactgaaaagattatgagcagcatcatggataccattgctgacaaccttcctaagcagaagtctgggaaatttgatccaggttcagtctctgacaaagtgaagaacaagctgtttggtcgtcagaagaccttgcatggagttctgggtggtggaaaacctgctgatgtgctgttatggaggaacaaaaaaatatcatcgagtgttctggctcttgcaacagctatttgggttttctttgagtggctcgactaccactttctgacaattgtttcatttgcccttgttcttggaatggttgtccagtttgtttggtccaacttctcaaacatgctaagcagcggatcccgttctcaggtgccccgagttgaattgcctgatgagttatttgtgaacattgccgttgcaatcggtgcccaagtaaacaagttcctgtgcttccttcaggatgtttcttgtgaaagaaacttgaagcattttgtagtggcgatcgcaggactgtgggctgctgcggtgattggaagttggtgcaatttcctgactgtcatatatgtcgggtttgtttgtgttcacacgcttccggtgctctatgagaagtacgaagaccaagtggacgatttcctctacagccttcttggtctgctgcgagatcaatatcagaagctcgaccacggcgtcttgagcaagattcccaaggggaacatgaaggctaagaagaacgagtagtttagcagatggtttctcgtgaatgagtag

SEQ ID NO: 164 - DNA, 1896 bp, Zea mays
ccctattaaaccaccgagctgggcgcctccccgtggcgctcgcggccgcattagcgcggagatcgagagacaagagagggaaggcggcggcttgccggcttaagccttctctccctccgtcgtcgcctcctccttacgtccgcttcttcctcctggtacgcctgaaaaccttgatgactcgcccgcgttagatttggattttctgcggtttccaatctgaaccacgattttagagatccagaagttcttggctgagatcctggcatttgggactttctgacagcagtctctattgttttcagaatggagacgtcagcgccgcccaatgcccccgctccgccggcgcagccacggaggcggttgccggacttccagcagtcagtgcggctcaagtatgtgaagctggggtaccactacctcatatcccacgggatgtacctgctgctgtcgccgctgatggcgctcgtcgccgtgcagctctccaccgtctccccgcatgacctcgccgacctgtgggagcagctccgcttcaacctcctctccgtcgtcgcctgctccacgctgctcgtcttcctctccaccgtttacttcctcacccgcccgcgccccgtgtacctgctcgacttcgcctgctacaagccggagtcggagcgcaagtgcacgcgcgagaccttcatgcactgctccaagctcaccggatccttcacggacgagaacctcgagttccagcgcaagatcctcgagcgctccggcctcggcgaggacacgtaccttccccccgccgtgctccgggtgccccctaacccgtgcatggacgaggcgcgtaaggaggcgcgcgccgtcatgttcggcgccatcgaccagctgctcgagaagaccggtgtcaggcccaaggacattggtgtcctagtggtcaactgcagcctgttcaacccgacgccgtcgctgtcagccatggtggtgaaccattacaagctgagggggaatattgtgagctacaacctcggcgggatgggctgcagcgccgggcttctgtccatcgacctcgccaaggatctgctgcaggtgcaccccaactcttacgccctggtgatcagcatggagaacatcacactgaattggtactttgggaacaaccggtccatgcttgtgtcgaattgcctgttccggatgggtggcgcggccatcctgctctcgaacaggcggtctgacaggcggaggtccaagtatgagctggtgcacacggtgcgcacgcacaagggcgccaacgacaagtgcttcggctgcgtgacacaggaggaagatgagattggcaagattggcgtgtcactgtccaaggacctcatggcagtggccggagacgcacttaagaccaacatcaccacgctggggccgttggtgctcccattatcagagcaacttctcttcatgggcacattgattgccaagaaggtgctcaagatgaaaatcaagccatacatccctgacttcaagctggctttcgagcacttctgcatccacgcaggcggccgcgctgtgctggatgagctggagaagaacctggagctcactgactggcacatggagccatcgaggatgaccctgtacaggtttggcaacacatcaagcagctcactctggtacgagctggcgtacactgaggcaaagggtaggatcaggaagcgcgacaggatctggcagatcgcatttggttctggattcaagtgcaacagcgccgtctggaaggcactccggacggtgaacccggccaaggagaagagcccctggatggatgagattgacaacttcccggtggatgttccaaagatttcaaaggttggtggcgcttgaagaaccattcttcttattattaggtggcaagtggagttgggttag

SEQ ID NO: 165 - DNA, 1120 bp, Zea mays
ttcagcctctctatagcataggaccaagatcatagtgccgtccctgccggcagagagcaagatggtctcacactcactctcagcatggctcatgtcctcggcgccgccgccggcgtggttcgccgccctggtcgccgtgggcatgtacacggcgctgcggtccgccgccaccttcctggcgtggctccaccgcgcgttcctgcggccaggccgggacctggcggggcggtacgggacgtgggcggtggtgaccggggccacggacggcatcgggcgcgcggtggcgctggagctggcgcgcgcggggctccacctcgtgctggtggggcggagccccgacaagctggcgcgggtggcgaaggagctcgcggccgccgcgccggcgtgcaaggtgcggagcgtggcgttcgacctcgccgtgaccggggacgccgcgcggcgcggggtggcgcgggtggcggccgccgtggagggccgcgacgtgggcgtgctcgtcaacaacgccggcgccacgtacccgtgcgccgcctacttccacgaggtggagggccccgtgtgggaggccgtgctgcgggtcaacgtcgaggccgccacgcggatcacgcgcgccctgctgccggcgatggcggccaggggcaggggcgccgtcgtcaacgtgggctccggctccagcgtcgtcgtcccggccttcccgctctacgccgtctacgcggccagcaaagcgtacgtcgaccagttttctcgaagcctgagtgtggaatacaaacaatacggcgtagacgtgcagtgccagatacccctgtacgtcgctaccaagatgtcgcccgtgaagggcgcgtctccgttcataccgtcgcccgaggagtacgccagggccgcccttcgctgcgttggatacgaggcgaggtgcgtcccgtactggcgccactcggtccagtggttcttggcgtccctagcgccggacgctgctctcaaccactggcgcctccaaactggcctccagaagaggaacgagacgaaggctctgctcgggggaaaagactgcagttagattaataatagtagtaataattgttgtatagattggattattatagccttccagacagtactcgcgtag

SEQ ID NO: 166 - DNA, 2621 bp, Zea mays
cagccatggatatcactcaggttctgatagctgctcaatctccagatgctaaccttcggaccgtggcagaaggcaacctcacacagttccaggagcagaattttcctaactttctcctctccttatcaatagagctctcgaacgatgaaaaacctccagagtctagaaggcttgctggtattatccttaagaattctttggatgcaaaggattctgcgaaaaaggagctactgactcagcaatgggtaagtgtggatccatctatcaaattgaaaatcaaggagttgttgctggtgacactaggatcttctgtgcatgatgcaagacatacctcttcacaagtcattgccaaggttgcatcaattgagatagcacgtcgagaatggcaagatctcgttgccaaattactggggaacatgacttctgcaggtgcacctgctcctttgaaacaagcaacactagaggcattggggtatgtgtgtgaggagatttctccacaggacttggagcaggaccaagtgaatgctgttctgactgctgttgtccagggaatgaaccagacagagctcagccctgaagttcgtcttgctgcagttaaagccctatataatgctcttgactttgcggagagtaactttgcaaatgaaatggagaggaattatataatgaaggtggtttgtgatactgctgtgtctaaagaagtggagatcagacaggctgcatttgaatgccttgttgcaatagcatccacctattattcacacttagagccttttatggaaaccatattctacctgacagctaatgcagttaaaggtgatgaggaaccggttgcacttcaagctgttgagttctggagcgctatctgtgacgaagagattgcactccaagatgaatatgagggatctgaggatggtaactctgctatacacttccgctttattgaaaaggccctccctttacttgttccgttgctgctagaaactttgttgaagcaagaggaagatcaagatcaagatgataatgcttggaatatttctatgagtggtggaacatgccttggactcatttctagaactgttggtgatgcagttgtccctcttgtgatgccatttgtcgagaccaacatcacaaagcctgattggcattgtcgtgaggcagctacctttgcatttggttctatccttgaaggcccctctgttgggaaacttgctccacttgtccaggctggtcttgatttcttgctcaacacgatgaatgatgcaaatagccaggtaaaagatactactgcttggactcttgggagagtatttgagctcttgcattctccagctggtataaactcaatcataaatggttcaaaccttccccgtatcatgtctgtattgcttgagagtactaaagatgctccaaatgtagccgagaaagtctgtggagctatttattttctcgcccaaggttatgaagatgcagagtcaacgtcttctgtcctcacaccttatctatctaatacgattgctgctcttctttctgccgcagaccgtgctgagaccacccatttcaggcttcgtgcttctgcttatgaagcactgaatgagatcgtgagggtcagcaacatacctgaaacttcaggcatcatagcacaattattgcaggagatcatgagaagattaaaccttacatttgatctccatatactttcttctggtgataaggagaaacaaagcgatctgcaggctttgctatgtggtgttctacaggtcatcatccagaaactgagcagcacagatgcaaagtctataatttctcagaccactgatcagctgatggtgctttttctgcgtgtctttgcctgccacaattctactgttcatgaagaagcaatgcttgcaattggtgctcttgcatatgctactggtccagattttgtgaaatacatgcctaacttctttacatacctggaggctggtttgcagaattatgaagagtaccaagtgtgttccatctctgttggagtggttggtgatatttgtcgtgccttagaagataaaagtttgcctttctgtgatcgcattatgacggttcttcttaaggacctatcaagctctatgctcaatcgatctgtgaagcctctgattttctcgtgctttggagacattgctcttgctattggtgagaattttgagaaatacctaccttatgccgtgccgatgcttcaaggagctgcaggactccttggtacacttgacctgagtgatgatgatatggttgattatggcaaccagctcagacgtggcatttttgaggcatactctggtatactccagggcatcaagggcccaaaagctcagctgatgatcccatatgcaacccatctactacagttcactgaagctgtctccaaagataggagcagggatgacagtgtgacaaaggctgcagttgctgtccttggggatctcgcggacacgcttggccaaagctcaaaggatctgttcaagacccacctattccatgttgagttcttgagggaatgtcaagctcaagagttggatgatgaagttcgggagactgcacaatgggcccaggggatgataaaccaggcggtggtctcttaataa

SEQ ID NO: 167 - DNA, 614 bp, Zea mays
cggcgatgggtcaccgccgccacgaggggtcgtgccgctgcgagctctgcggcgcgcccgcggccgtgcactgcgcggcggacgaggctttcctctgcgccgcctgcgacgccaaggtgcacggcgccaacttcctcgcgtcgcggcaccgccgcacgcgcctccgcctcgcggccgcgggacccccgccgccggacgacgaggccgggtacgggtccgccgcgagctcctgcgtgtccacggccgactcggcgccgcggccgaggcgtggggcccgcgcgccggccgggagcgtgcgccccgaggccgtgctcgaggcctgggccaagcggatggggctcggggcgggggcgcgccggcgcgtcccgccgcgcgtcgccgtggccgccgctctctggtgggaggcggcggggcggggcggggtcgggggccacgcccaggcgctgcggcggctggaggcgtgcgcgcacgtgccggcgaggctcgtgctggccgtcgccgcgtccctcgcgcgcgcgcgcgcgctcttgcggagggccgccacggacgccgtggagggctgggacgagtgcgcgtgggcggggcccaagtccagcccgtcacgctcttgatga

SEQ ID NO: 168 - DNA, 2228 bp, Oryza sativa
gccgcttacaacatccatccccaaacccgcattcaaaacaagcaaccctcctcccgaatcgaacaaggaaacagatatcgcctctaaaacccccatcgtctcgtctcgtctcgttcccctctccatcttccgcggctttccgcgcgatccaccgatccggtttccccgcgccgtgcccggagtcggcgctccattcccgcgccgggttttggggtggtgtgttgatgcggcgggattcgagccctggcctgtgagttgggcgtcggctcggcggctgcggggtcggcgcgggcgcggacgcggcggatgtctgctatgaggcggcggccggtgctgccgactcaccaggacgacatggagaaggtgggcgggaagccgccgcagtcgcgcctctgcttcctcgccacgctctgcgccatgttctgggtcctcatcttctacttccacttcttcgtcatcgccaacgagcctggctccgcgggggcggacaccgccgccggcgccgcggcgagcattgcccgcgcagaacttccgctccccgaacccgagcgcgtctccgatcccgcggttcccctccctccgcctgccctcgtctcggagccgccacctaccaccgctactgtcgccaaagtggaagatgaggagaagcccacggccgtcgcccaccaggaggcggcgcccagggattacgcgttccagcgagcgctcaagaccgcggagaacaagagcgacccgtgcggcggccggtacatctacgtgcacgagctgccgccgcggttcaacgacgacatgctccgggagtgcgagaggctcagcctctggaccaatatgtgcaagttcatgagcaacgaagggcttggtccgccgttgggcaacgaggaaggggtgttctccaacaccggctggtacgcgacgaaccagtttatggtggatgtcatcttcaggaaccggatgaagcagtacgagtgcctgaccaaggactcgtccatcgctgccgcggtgtttgtgccgttctacgccgggtttgatgtggcgaggtatctttgggggcacaacatttcgacgagggatgccgcgtcgctggatttgatagattggctgaggaagaggcctgaatggaatgtgatgggcgggcgtgaccatttcttagttggcggcaggattgcgtgggatttcaggcgcttgacggacgaagagtcggattggggcaacaagctgcttttcatgccggctgcgaagaatatgtcgatgttggtggtggagtcaagcccatggaatgccaatgattttgcgataccatatcctacttacttccaccctgccaaggatgctgatgttttgctttggcaggatagaatgaggagcctggaacgaccatggttgttctcgtttgctggggctcctcgtcctgatgatcccaagtctatcagaagtcagcttattgatcaatgcaggacatcaagtgtctgtaaattgctggagtgtgatcttggggagagcaagtgccattcccctagcgcaatcatgaatatgttccagaactctttgttctgcttgcagccccaaggtgattcgtatacgagaagatctgccttcgactcgatgctggctggttgcattcctgttttctttcatcctggttcagcgtatgtccaatatacgtggcatcttccgaagaactatacacggtactctgtcttcatccctgaagatggcgtccgtaagggaaatgtcagcattgaggacaggcttaaaagtatccatccagatatggtcaagaagatgagggaagaggtcattagtctcatcccaagggtgatatatgctgatccaaggtcaaagctggagaccctgaaggatgcattcgatgtttctgtagaggcaataattaacaaggtgacacagttgagaagagatatcatcgaagatcatgaagataaagattttgttgaagagaatagctggaagtatgatctgttggaagaagggcagaggacaattgggcctcatgaatgggacccgttcttctctaagcccaaggacaagggtggagattctactaatccatctactaatgctgccaagaactcctggaaaaacgaacaaagaggtcagaactaaaatacaggtagttagatatgtgatcgaggaaaggaactagatatcctctctagagaagctccttgcaaataccttgcccatatgtcaaagatcctccaacgcagtag

SEQ ID NO: 169 - DNA, 1695 bp, Oryza sativa
tgcagagatgggggagaacggtgtggtggcgagcaagctgtgctacccggcggcggccatggaggtggtcgccgccgagctcggccacacggccggctccaagctgtacgacgacgacggccgcctcaagcgcaccgggacgatgtggacggcgagcgcgcacatcatcacggcggtgatcggctccggcgtgctgtcgctggggtgggcgatcgcgcagctgggttgggtggccggccccgccgtcatgctgctcttctcgttcgtcacctactacacctccgcgctgctcgccgactgctaccgctccggcgacgagagcaccggcaagcgcaactacacctacatggacgccgtgaacgccaacctgagtggcatcaaggtccaggtctgcgggttcctgcagtacgccaacatcgtcggcgtcgccatcggctacaccattgccgcctccattagcatgctggcgatcaagcgggcgaactgcttccacgtcgaggggcacggcgacccgtgcaacatctcgagcacgccgtacatgatcatcttcggcgtggcggagatcttcttctcgcagatcccggacttcgaccagatctcgtggctgtccatcctcgccgccgtcatgtcgttcacctactccaccatcgggctcggcctcggcgtcgtgcaggtggtggccaacggcggcgtcaaggggagcctcaccgggatcagcatcggcgtggtgacgcccatggacaaggtgtggcggagcctgcaggcgttcggcgacatcgccttcgcctactcctactccctcatcctcatcgagatccaggacaccatccgggcgccgccgccgtcggagtcgagggtgatgcggcgcgccaccgtggtgagcgtcgccgtcaccacgctcttctacatgctctgcggctgcacggggtacgcggcgttcggcgacgccgcgccgggcaacctcctcaccgggttcggcttctacgagcccttctggctcctcgacgttgccaacgccgccatcgtcgtccacctcgtcggcgcctaccaggtctactgccagccgctgttcgccttcgtcgagaagtgggcgcagcagcggtggccgaaatcatggtacatcaccaaggatatcgacgtgccgctctccctctccggcggcggcggcggcggcggaaggtgctacaagctgaacctgttcaggctgacatggaggtcggcgttcgtggtggcgacgacggtggtgtcgatgctgctgccgttcttcaacgacgtggtggggttcctcggcgcggtggggttctggccgctcaccgtctacttcccggtggagatgtacatcgtgcagaagaggataccgaggtggagcacgcggtgggtgtgcctgcagctgctcagcctcgcctgcctcgccatcaccgtcgcctccgccgccggctccatcgccggaatcctctccgacctcaaggtctacaagccgttcgccaccacctactaattcatcgagcacctcgcgtgcatgcacataccgtacgttattacgcgtggtcgagatgaagtacagatgattgtatcctaattaatcaattaatcaaccaaaattaattaactaattactatttagttattattgtcacacgtgtggtgaaaaaaaaagtgaaaagaggaatttgagacaggttgcatagagtgttg

SEQ ID NO: 170 - DNA, 671 bp, Oryza sativa
ccgggatggacgccatggccgtgctcgcgaggacctcccgccccgccccgaccctcctcgccgcgacctcccccgcggtgtcccggcgcccggcggccgtctccttcgccgccgccgcctccccggggtcccgcggccgcgtcgcgctgagcgccgcgtggggcgggagggcggccagggggcgcgtctccgccgccggccgcatcgtcgcgtcgtcggttgagcaatcctatattatgatcaagcctgatggtgttcagcgaggcctggttggcgagattatttcccgtttcgagaagaaaggctttgtgttgaagggcttaaagctttttcagtgccccaaggacttggcacaggagcactacaaggatttgaaggaaaaacctttctttcccggtctgatcgagtacataacttctggccctgttgtttgcatggcttgggaggggaatggtgttgttgcatcagctcgcaagttaataggagctactaatccccttcaagctgaaccagggaccatacggggcgatcttgcagttcaaacaggaaggaatgttgtccatggaagtgacagtcctgataacggcaagcgtgaaatcgctctatggttcaaagaaggcgaactctgcgaatgggaatctgttctgacaccatggcttgtagagtaataa

SEQ ID NO: 171 - DNA, 2457 bp, Oryza sativa
tcctcctgtaatgtttggaagggtttagggtaataggaaagaggagtttgtaagatagactcgggaaaagattgaattttacgttgtaaagaaggttaaaagcaagtgaaataataaatttctgagctagctagtaagaggcagcagaattcctgtggggcttattgtagacctgtctctatggcgaagagtaacaatggtaatggctacctcggtgtgactgagccaatctcattgagtggtccaactgagaaggatgttgtccgtacgcaggaggttgagaagtgtcttgctgacgctggcctgtatgaaagccaagaggaagctgtctcacgagaagaggttttaggcaaactggaccagattgtcaaggcttggattaagaaggcaactcgagctagtggttttggcgaccaatttgtgcaagaagcaaacgcaaagatttttacttttggctcataccgactaggggttcatggccccggtgcagatattgatacgctttgtgtgggtccaaggcatgcaactcgaactgaatactttttccaggctctttatgatatgctagttgatatgccagaggtcacagagttacatccagtgccagatgctcatgttcctgttttgaaattcaaacttaatggggtttctattgatcttttatatgctaatcttacacatgttgttattcctgaggacctggatctttcgcatgactctatattgcacaacgttgacgaacaaactgtccgaagtcttaatggatgccgagttactgataaaattctacgattggttccaaatattctgactttccggacaaccttgagattcatgagattttgggcaaaacgccgtggagtctactcaaatgttatagggtttcttggtggtataaactgggcacttcttgttgctcgtatatgtcaactgtacccaaatgcatcaccaagcatgttgatatctcgttttttcaaagtctacagcaagtggaagtggcctaatcctgttatgctttgccatattgaagagggttctcttggtcttcttgtgtgggacccaaggagaaattttagagacaggggtcatcatatgcctataattacacctgcttatcctagtatgaattctagctataatgtatctatcagtactaggcatgtgatggtccaagaattcacacgagcttctgatatctgtcaggcaatagacgaaaggaaagcagactgggatgctttgtttgagccatatccattttttgaatcgtatagaaattatctaaagattgagatcacagcaagaaatgaagatgacctcaggaattggaaaggttgggtagaatcccggcttcgtacgcttgtattaaagattgaacgatttacacgtgagatgctcctctcacatcctaatcctagagatttcatcgacagctccaggccattgcattgtttttactttatgggtctctggaaaaaacaaatcagccaagctcaagaagctgagcagtatgacattagagcaattgtgaatgaatttaaaagcaatatccatgcatatcaacactggagagaaggaatggaaattgaagtttcccatgtaaaaagaaaagatatcccatcatttgtttttcctggtggaatccgtccttctcgcccatcaagaacagttggcaaggaagctcgggctgtttcaagaagtaatatttcagctaatgttcaagaaagaaatgttccaagcatggcccagcctatgccatataagagtagtgaagtaaacaaaattccgtcagatcctcatggtggctatcagtcgcaagaaagaaataatgcagtggtctctagtttgccctgtgaagaaactggccatatgttcaatgggtatgcaaatctccatacagaatctgttgagctggaacacttgagaagctacaagggaagtacatctgttcctgagaaccatgttgtgcatgatttagtcaagccaccagagagcatgccacctaactcaatccatgtttatccaagtccaacaaatggattgggccatcttttagatagttcttgtaaaaaaccagcagacatcattgtaaataaaaccacaaatttctcttcagctgtcctagcagtacctgatgaacttgatgagctggattctcatcaagtgaaggtaaatcagaaagatttaactgcagtagatcaaggattatctttggagcataaagttggaagtaatgggggcaaagcaggaaccacaggttcacctgataacaatcatctgaagcgtaaagctgaggaagagcttgagccacttgagcttgctgccccactagttcgccctcctgcaccaacgtccatgacccagaggaggcccttgagactgagattgtcaactgtggtgcaacccaaacctgctgaaggaacttcatgaatcgagttgcttggagacatggagatttag

SEQ ID NO: 172 - DNA, 1499 bp, Sorghum bicolor
gccagaagccaaaaccctcccccgccccctgcaggctgcaaccgcaatgtcggcggccgggacgctctccggcggcgccgccggtctatccggcctcctccgcctccgccgccgggccgcccccgcccccgcgatcgccgcgccgtcgctccaccccgctgggaccatcaagtgcaccgccgtgcccgatgccgccccgattgtctggggccgccagctccgaccggcgctcctcctccccgcggcactgctcccgtcgtcgcagcccgccaagaagcacaatctgcgcccggccgccgcagccgccgagtccgcaggggaggccaagggtttcctggagaaatacccggccctggtcaccggttttttcttcttcatgtggtacttcctcaacgtcatattcaacatcctcaacaagaagatctacaactacttcccctatccatactttgtgtccttgatccatctagtagtgggtgtcgcatactgcctcgtcggctggagtgtcggtctccccaagcgagcgcctatcaatgccaatctcctgaagctgctctttccagtggcattgtgccatggtattggtcacgtcactagcaatgtgtccttcgctgctgttgcagtctcatttgcccacactatcaaagctctggagcccttcttcagcgcagctgctactcagtttatccttgggcagcaagttcccctctctctgtggatgtctcttgcccctgttgtcattggtgtttcaatggcatcccttactgagctttcgttcaactggactggcttcatcaatgccatgatatcaaacatctcattcacttacaggagcatttattccaagaaagctatgactgacatggatagcaccaacgtgtatgcttacatctcaataattgctctcattgtttgcattccacctgcaataatttttgaagggccccagctaatgtcgcatggatttagtgatgccattgcaaaagtaggtttgacaaagtttgttagtgacctagtcttggttggactgttctaccatctgtataaccagattgctacaaacaccttggagcgagtggctcctctgacacatgctgtcggcaatgtgttgaaacgtgtttttgtcattggtttctcaatcgttgtttttggcaacaaaatttccacacaaactggaattggcacgtccattgccatagcgggtgttgctttgtactcttacattaaggctaagattgaagaggagaaaaggaaaaagagcgcatgatgaggtgactgctgtgaatattatcgggtggctgagttatacctcctcggacacaacatcgtcgacaatctcgacctacttctatgccttgttttgttttcatcttgagtcagttggtccattgtttgttcccaatctggtgattaactctgcaaattctgtttgtggaattggcagtgatacaaatttcggttcttaagtaaaactggttgctggtactggtagacagtgg

SEQ ID NO: 173 - DNA, 1880 bp, Sorghum bicolor
tctgcgatctgttgagagtgagtgagcgaactaggccgtgcttgagctgatactgccgtgccgctctagctcgccggccgggatgggcgccgccgccgcggggcctgctgcggctccgccggcgacgacgcattgccgctgcatccagctactgctgctggcgctggccgtcgtgccgctcggcagccgcgggcttcgcgtccgagccgtcggggcggacacgggagggctgagccgggacgcgttccccaaggggttcatcttcgggacggcgacgtccgcgttccaggtcgagggcgcggccacgtccggcggccgcgggccctgcatctgggatcccttcgtccacacccccggaaagattgctgaagacgggaacgcagatgttacaacagatgaatatcatcgctacaaggaagatgttgatctcatgaaaagcctaaattttgatgcataccggttttcaatctcctggtccaggatcttcccagatggcgaagggaaagttaatgaagaaggagtgcagtattacaacgatcttatagactacatgattaagcaaggtcttactccttacgccaaccttaaccactatgatcttccacttgcgcttcagaaaaagtaccaaggctggttaggcccaaaaattgtggatatattcgctgactatgccgatttttgtttcaagacttttggcgatcgagtcaagaactggttcacattaaatgagccaaggatagtatcattccttggttatgataaagggattgacccccctaatcggtgcacacaatgcaccgccggtgggaactcatcgacagaaccttacattgttgttcataacatcctcttatctcatgctactgctgttgcaagataccgcaataaataccaggcaactcagaaaggcaaggttgggatagttctagacttcaactggtatgaacctcttaccaactcaaccgaagatcaagcagcagcgcaaagggccagggatttccatattggttggtttcttgatccattaataaatggacaatatccaaagacaatgcaggacattgtgaaagatcggctaccaagtttcacacctgaacaggctaagctagtcaagggctcatcagactatttcgggatcaatcaatatacaacaaactacatttcaaatcaacaaactactcagcaaggaccaccaagctactcgtctgactggggtgttcaatataactttgaaagaaatggcgtgcagattggacagctggcacactcagtctggctttacatcgtcccaacgggcatgtatggagtcgtcacctacctaaaggaaaagtaccagaatccaaccatcatcatatcggaaaacgggatggatcaacctggagacctgacacgcgaggagtaccttcacgacacggttcggatcgacttctacaagaactacctgacggagctgaagaaagggatcgacgacggcgcaaacgtggtgggctacttcgcgtggtccctcctggacaacttcgagtggctgtcgggctacacgtccaagttcggcatcgtctacgtcgacttcacgacgctgaagcggtaccccaaggactcggcgtactggttcagggacatgctctcagggacgggctcgaaggccgccgccgccccgcagaccggttcaggcacccgtccggctgtctcggcttcggccacctcgaatggcgctgcccttctggtctctctgttcgtctccttgtgtgtcctgcttccatccgtcttcatggtttcctcagtttaattaggagtatattttttcttctagtgtgaaattttgtagtggatggcagcgtgttgcttttaagacatgttgcatcaaggagggacctgttgta

SEQ ID NO: 174 - DNA, 1040 bp, Sorghum bicolor
gcgagatggaccacgcggcggacgcgcaccggacggacctgatgaccatcacgcggcacgtgctgaacgagcagagccggaacccagagtcccgcggcgacttcaccatcctgctctcccacatcgtcctcggctgcaagttcgtcgcctccgccgtcaacaaggccgggctcgcccagctcattgggctcgccggcgagaccaacgtgcagggagaagagcagaagaagctggatgtcctgtccaacgaggtgttcgtcaaggccctcgtcagcagcggtcgcacctgcgtccttgtgtccgaggaggacgaggaagcaacgttcgtggaccctaagctacgtggaaagtattgtgtttgctttgatcccctcgacggctcctccaacatcgactgtggcgtctccatcggaacgatctttgggatttatatgatcaaggacaaggacaatgtcactctggccgacgtactgcaaccaggcaaggacatgcttgccgctggatactgcatgtatggcagttcctgcacgcttgttctgagcactggaagtggtgtcaatggcttcacacttgatccttcacttggcgagttcatactaactcacccagacatcaagatacctaagaaggggaagatttattcagtcaatgaagggaacgccaaaaattgggacgtgcctgttgcaaagtttgtggagaagtgcaaataccccgaagatggtacgccaccaaaatctttgaggtacattggaagtatggttgctgatgtgcaccgtaccttgctatatggaggtgtatttttgtaccctgctgaccagaagagcccaaatggaaagctccgcgtcctgtatgaagttttccccatgtcattcctaatggagcaggctggaggtcagtccttcacaggcaaagaacgggctcttgatctagtcccaaccaagatccacgacagatccccgatattcctcggcagctacgacgatgtggaggaaatcaaagccttgtatgccgagcaggcaaagtcaagctcggcttgatga

SEQ ID NO: 175 - DNA, 1147 bp, Sorghum bicolor
ccagccatctctcctctgcggcgtccgagcgggggcggcgcccgagatgggggactccggcggctccgtcgtgtcggtcgacgtcgagcgcatctccttcggtggcaaggaacaccatatacaaacgagtcatggacctgtatctgttgcagtgtatggtgaccatgacaagcctgcccttgttacttatcctgatattgctttaaaccatatgtcctgcttccaaggactattgttctgtcctgaagctgcttcactgctgcttcataatttttgcatttaccatattagccccccaggacatgagttaggagctgctccaatttcgccaaatgctcctataccttctgttgatgacttggcagatcaggttgcagatgtcctcgatttctttggattaggctctgttatgtgctttggtgtcactgcaggtgcctacattctaactctgtttgcgacaaagtatagggagcgggtactaggtcttatccttgtttcacccctatgtaaaggccccacttggactgagtggttatacagtaaggtgacatccaatctgctgtattactatgggatgtgtgggttggtgaaggagtgcctacttcagcggtacttcagcaaggaagtgcgaggattctctgaattacccgaatcagacatagtgcaggcttgtaaaagcttgctcgatcagcggcagagcatgaatgtatggcgctttgttcagactatgaatgagagatatgacttgactgaacagctaaagcaacttcagtgtagaaccctgatttttgtcggtgagaattctcagtttcacaccgaggctgttcacatgacatcaaagctcgacaagagatattgtgctctagttgaggtccaagcatgtggatcactcgtaactgaggagcaaccacatgcaatgcttataccaatggagtacttcttcatgggatatggcttgtacaggcctagccagctggactgcagcccgcgcagccccctgagcccattctgtatatcgccggatctcctgtcacctgagagcatgggggtgaagctaaagccgatcaaaacgcgagtcaggcttgaagtgtagcagaagtgagtaatgggatggggcgcttaggggctgacatggtgagaggttagg

SEQ ID NO: 176 - DNA, 931 bp, Sorghum bicolor
cttgcagaaagagcagtgtgtctggctcttgctctgtttgtttctttcctcgcctgagtcctacgtacgtacttcaggagaaatgaggaaggagatgatcatacgggtgcagacgacgggctccgagaagggccacagcaaagctatcaaggtggctgctgcaatctcaggggtggagtccgtgacgatcgccggcgaggacaagaacctgctgctggtgatcggcgtcggcatcgactccgaccgcatcaccaagaagctgcgccgcaaggtgggccacgccgaggtggtggagctgcggaccgtcgacgccgccgccctcgcggacgacctcgtcggcggcggccgcgccatcgccgccgccgaccacgcgtaccgctaccacgcgagcccgagcccctacaggcatcaccaccactcgggtgcgcgcgaccactactacggcggcatggaccactactacgccggtggcggatccgcgtacgcgccgccggcgccgccgccgctctactacggcggcggcggcgggggatacccggcgcaggcgcagtacgagcagcacgactacttgtaccacccggcgggcgccaagacgcacacggtggtgcaccacgagtacgccagcgaccccaacggctgctcgatcatgtgatggcgccgttggtgtttcgatcctgtgatctgggaggtaggtgaccctgcatggcatggccacctggtgtcgacgtgtgttcgtgtcacacgtcggtgcggtgcagtgacttggcgggtcactcacatgcagacactacgcgcgctacttcctgcttctggttctgttctgtgtgaccagtgtacagcataagcagtgcatccgtggatgcgtcaatctgtgtagtgtgtacgtacggtgccaagtgcaagcttttactgcttgattgggacgaactaa

SEQ ID NO: 177 - DNA, 1382 bp, Solanum lycopersicum
cgccgatatgttttttccataggtggggagcgtatctataaatggaaagacatttttcatgcaaggtctctgacaccgactattgcatttcttattgagcaaatacctcgttgctttttgatacttgtgttttaggatgggaagggtaaggctaagcgtgaagcgattggagagtcatagtaacaggcaatccacttattgcaaacgaagatgtggaatcctgaagaaagcccaggagatatctgtgctatgtgatatagacattatccttcttttgttttccccaactggaaaaccaacgctatttcaaggcggacaaagcaattttgatgagataattgcaaaatttgctcaattgactcctcaagaaagggcaaaaaggaagttggagagccttgaagtaagtctgatattcatcaccactatgtgttctcctcttgctatgctttgttgttacttcataatccaagtgaaagtaataacaatgctaatggttacactccagacattgaggaagacttttaagaagcttgacaacgatataggcgtgccagagtttctagatgctagtgatccatcagttgaagaattgcatagtcaagtgaaacttttgcaatctcggcttactgatgtagaaatgagactcaactggtggagcaatcctgataatataaataaagtggaagatttcgcgctaatggagtgtgcactaagggagtcacttaatgcagttcatgttcggaagctccagaagacgacgcatttgcatcttttgatgaacagtgaactagatgggaatactcatcagtggcatccagaaaataaaatcctgcgcatgccattccctcagactccaaacattctaccccaggaaaatatgggatactttggagataattcagttgctgaatcttctcatgttcagggctctggagaagttgatcaagcaagacaggacacaactgcaatgctagataacggtgtcttgaatgatctaactagtatagcatgcttgagacagcaactaagtgagcagtactcatacaaccccaatgaggatcttgatctgcttgaaaggaacatgttggatcctcagagtgatgccaatttgaaaggatatttgatggattatgcatttcaaagaaactttaacctaacaaggtctgtggattcagtcaattatagtgcagtcgatgccgttgctgttccagattttgatgaaaaatcatatgcgcagccagcaacttccagtgattagacactcgagataagtcacactactcgagtagaataatctgtgatcgtgggtgaggtttacaggtgcagtggttgttgatagataattatgtttgaatatgtatagttgttttgctttgcgaacc

SEQ ID NO: 178 - DNA, 1248 bp, Triticum aestivum
accttcggaaccccaatggcgagctttaacgccgccggcgccggcgccgccaaccccaaccctaacaaatccctcgaggtgaatccgccgcccggggactcggtttccagcctcagcttcagccccaaggcgaaccacctgattgccacctcctgggacaaccaggttcggtgctgggaggttcagcctggcggccaatgccaggcgaaggcgtctatttcgcacgatcagccagtcctgtgctctgcctggaaggatgacgggactactgttttttcgggaggttgtgacaaagtggtgaagatgtggccgctgctgtctggcggccaggccacggccttctcagggcacgaggcgccggtcaaagaactcgcctggataccacagatgagccttcttgtcagtgggtcttgggataagactctgaggtactgggacattcgacaacctaatccagcgcacgttcagcaacttccggagcgctgctatgcactctcacttagttatcctctaatggcggtcggcactgctgatcgcaacgtagttatcttcaatctgcagaacccacaggctgaattcaagaggatcgtgtcacctttgaaattccagacaaggtgtatcgccgccttccctgatcaacaaggattcttggttggatcaatagagggacgcgttggtgttcatcatgtggatgattctaatcaaagcaagaatttcacattcaaatgtcaccgtgagggcagtgatatattctctgttaactcgctgaactttcatcctgtgcaccatacatttgctactgcaggctctgatggaggtttcaacttttgggacaaggacagtaaacaaagactgaaggcttttagtaagtgcccatcacccatcacatgcagcacattcaatcaggatggctcaatctttgcttatgcggtatgctatgattggagcaagggcgccgagaagcataatccttctactgcaaagacaaatatctttctgcatagcgtgcaggaatctgatgtcaaaggaaagccccgtactggaaaaaagtagagacttggtaatgacaagctgcagatctgtgctccgaacctgatgagttcaccatcgcctgatgataattacctgcacgagtgttttagatgttgactctgtagggcattccttcatctctgagaccgcaagcatatcttctataaaaagcagttgcatttcttcccatgtaaatggcaggtcgtaatttgttgc

SEQ ID NO: 179 - DNA, 1532 bp, Sorghum bicolor
cgacgatgggcctgcgcgtggccgccaccgcgccagctgcggccggcgtgcgcgtgctcggtggcggcgccgcgagcgtgaagccgcgaccgtgggtggcgctcggaggcaggagacgcctctccgtgcggatgtccgtcgccactaccgagaccaccacctccgccgccgccgccgtgggcgcctcggaggaccaggcgctggaggctaggaactccaggacggtggtagcggtcatcctcggcggtggcgccgggaccaggctgttcccgctgaccaagcgcagggccaagcccgcggtgccaattggcggcgcgtacaggctgatcgacgtgccgatgagcaactgcataaacagtgggatcaacaaggtgtacatcctcacgcagttcaactcgcaatccctcaaccgccacctctccagggcctacgattgcaccaatggcgtggccttcggagacggattcgtcgaggttctagcagcaacccagaggcctggatcggagggaaagaggtggtttcagggtactgctgatgcagttcggcagttcgactggcttttcgatgatgcaaaatctaaagacattgatgatgtgttgattctttctggtgaccatctctaccgaatggactacatggactttgttcagagtcatcggcaaagaggtgcaggcatcagcatctgttgtttgccaattgatgacagccgggcatctgattttggcctaatgaagatagacgacactgcaagagttatttcattcagtgagaagccaaaaggagacgaattaaaggcaatgcaagttgacactacagtgctaggcttatcaaaggaggaagcagaaaagaaaccttacatagcttcaatgggggtctatatttttaagaaagacatacttctaaaccttttaagatggcgttttcccactgcaaatgattttggttctgaaataattcctgctgcagcaaaagaaatcaatgtaaaggcttatcttttcaatgattactgggaagatattggaactattaagtccttctttgaggcaaaccttgctcttgctgaacagcctccaaggttcagtttctatgacgctgacaaaccaatgtacacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgacgcggaaagaagagaattgcttgcagaaggaaatgttcctattgggatcggagagaatacaacgattcaaaagtgtatcatagacaagaatgcgaggatagggaagaatgtgataatctccaattctgaaggtgtagtggaagctgatagaacctccgaaggcttctacatccgaaccggcgtcactgtcgtactgaagaactcgataattgctgatggattggtcatatgatga

SEQ ID NO: 180 - DNA, 1325 bp, Sorghum bicolor
tcgagatggcgccgccgtcgagcatgtcgacggagaaggaggagaaggccatcgacgactggctgcccatcacctcgtccaggaatgccaagtggtggtactccgccttccacaacgtcacggccatggtcggcgccggcgtgctcagcctgccctacgccatgtccgagctcggatggggccccggcgttgtggccatgctcctgtcgtgggtgatcaccctgtacacgctgtggcagatggtcgagatgcacgagtgcgtcccggggaagcgcttcgaccgctaccacgagctgggccagcacgccttcggcgacaagctgggcctctggatcgtcgtcccgcagcagctcatcgtggaggtcggcgtctgcatcgtctacatggtcaccggcggcaagtccttcgagaagtgctacgccgtctcctgcccggactgcaagcccctcaacaccagctcctggatcatgatcttcgccgccatccacctgctcctctcgcagctcccaaacttcaactccatcacgctcgtctccctcgccgccgcagtcatgtcgctcagctactctacgatcgcatgggcggcgtcggcgcacaaggggcggcacgccgccgtggattacagcatgaaggcgtccacggcgacggggcagacgttcaattttctgagcgcgctgggggacgtggcgttcgcgtacgcggggcacaacgtggtgctggagatccaggccaccatcccgtccacgcccgacaagccgtccaagaagcccatgtggcagggcgtcgtcctcgcctacatcgtcgtcgccatctgctacctccccgtggcgttcgtcggctactacgtcttcggcaatgccgtcgacgacaacatcctcatcacactcgagaagccacgctggctcatcgccatggctaacatcttcgtcgtcgtccacgtcatcggcagctaccagatctacgccatgcccgtgtttgacatgctcgagacgttcctggtgaagaaactccggttcaggccaggcctgcctctccgtttgatagcgcgctcactctatgttgtgttcacagctctggttggcatcgccgtgccgttcttcggggggttgctagggttctttggtggctttgcatttgcgccgacaacctactatcttccctgcatcctatggctcaagattaagaagccaaagacgtttagcctctcatggttcatcaactggttttgcatcatagttggcgtgctcctgacggtgtttgcacccattggtggcctccggtcgatcatcgtcaacgcctccacctacaagttcttctcgtgatga

SEQ ID NO: 181 - DNA, 869 bp, Oryza sativa
aggtgtgaccgaacgatggcgtaccgggcggacgacgactacgactacctcttcaaggtggtgctcatcggggactccggggtcgggaagtcgaacctgctgtcccgcttcacgcgcaacgagttcagcctcgagtccaagtccaccatcggcgtcgagttcgccacccgcagcatccacgtcgacgacaaggtcgtcaaggcccagatctgggacaccgccgggcaagaaagatatcgagctattacaagcgcatactatcgcggagcagtaggggcactcgttgtctatgatgtcacgcgacatgtcacctttgagaatgtggagaggtggatgagggagctcaaggatcacacggacgccaacatcgtgatcatgcttgtggggaacaaggcagatttgcgccaccttagggctgtctcgactgaggatgcgaaagcatttgctgagaaagagaacactttcttcatggagacgtcggccctggagtcaatgaatgtggagaatgccttcactgaagtgctcacccagatatatcatgtagtgagcaagaaggctcttgacatcggcgatgacccagctgcaccaccaaaggggcagaccatcaatgttggtggcaaagatgatgtctctgcagtgaaaaagtctgcttgttgttcatcagcgtagatcgaaaggacttgacaaacatggagatacccgaggtggttgatactatgcagtaggacacaggatgttattgcattcatagacctcatctgtattcatgtgttactaagtgtctccttcgttttgccatttgaaacattaattcattcaggacataatcttgccggtatagtttagggatatgaaattgtgaggccgtc

SEQ ID NO: 182 - protein, 731 aa, Hordeum vulgare
RAASRWADRLFADFHLLPAAAPEPPAAAPAGVSASPFVPLFPDAADRSFPLQVDLYKVLGAEPHFLGDGVRRAFEARTAKPPQYGYSTDALVGRRQMLQIAHDTLTNQSSRTEYDRALSEDRDAALTLDVAWDKVPGVLCTLQEAGEAQAVLAIGEHLLEDRPPKRFKQDVVLTMALAYVDISRDAMAASPPDVICCCEVLERALKLLQEDGAINLAPDLLSQIDETLEEITPRCVLEFLALPLDEKHQSKRQEGLRGVRNILWSVGRGGIATVGGGFSREAYMNEAFLQMTSAEQMDFFSKTPNSIPPEWFEIYSVALANVAQAIVSKRPELIMVADDLFEQLQKFNIGSQYAYGNEMDLALERALCSLLVGDISNCRTWLAIDNESSPHRDPKIVEFIVNNSSIDHQENDLLPGLCKLLETWLVSEVFPRSRDTRGMQFTLGDYYDDPKVLSYLEMMEGGGASHLAAAAAIAKLGAQATAALGTVKSSAIQAFNKIFPLIEQLDRSAMENPNDGLEESVNKFDQKNIMGFDILDSKNAFLKIVSASALFALLTVIGMKYLPRKKALLPAIRSEHESVAVANVVDSVDDDEPDEPIQIPKMDAKLAEDIVRKWQSIKSKALGSDHSVASLQEVLDGNMLKVWTDRAAEIERKGWFWDYTLFNVAIDSITVSLDGRRATVEATIEEAGQLTDATDPRNDDLYDTKYTTRYEMAFTGPGGWKITEGAVLKSS

SEQ ID NO: 183 - protein, 464 aa, Hordeum vulgare
MATQLPCFTQLTPPSPGWRNEAGSLGATSGRALVRSTPFPGHSHFRCRASPRSANSFQKKDSFLDLHPEVSLLRGEQNDESINPRKASSDGSTLEGLGVPPSQDDYNAAKIKVVGVGGGGSNAVNRMIEYSMNGVEFWIVNTDVQAIRMSPVHSQNRLQIGQELTRGLGAGGNPDIGMNAAKESCESIEEALHGADMVFVTAGMGGGTGTGGAPVIAGIAKSMGILTVGIVTTPFSFEGRRRAVQAQEGIAALRNSVDTLIVIPNDKLLSAVSPNTPVMEAFNLADDILWQGIRGISDIITVPGLVNVDFADVRAIMQNAGSSLMGIGTATGKSRARDAALNAIQSPLLDIGIERATGIVWNITGGTDLTLFEVNAAAEVIYDLVDPNANLIFGSVIDPSLNGQVSITLIATGFKRQDEAEGRTAKGGQQMQGDNGRDPSSTGGSKVEIPEFLRKRGPSRFLRI

SEQ ID NO: 184 - protein, 234 aa, Gossypium hirsutum
MEFPNLDPESSSQKKMGRGKIEIKRIENTTNRQVTFCKRRNGLLKKAYELSVLCDAEVALIVFSSRGRLYEYANNSVRATIERYKKACSDATTPGSVAEANIQFYQQEATKLRRQIRDVQNMNRHILGEALSSLTFKELKNLEGRLEKGICRIRSKKNELLFAEIGFMQKREVELQNDNMYLRAKIAENERAQQQSNQLIQAASSYNRNFLPVNLLEPSNNDYSNQDQTPLQLV

SEQ ID NO: 185 - protein, 143 aa, Gossypium raimondii
MFSRGTNASSGMGVADHSKSTYLELQRKKVFRYVIFKIDEKKKEVVVEKTGGPSENYDDFTASLPENDCRYAVYDFDFVTSENCQKSKIFFIAWSPSVSRIRAKMLYATSKERFIRELEGIHYEIQATDPTEMDLEVIRERAS

SEQ ID NO: 186 - protein, 831 aa, Sorghum bicolor
MEAFSGFYVDEKAARVENIFLEFLKRFKESDGAGEPFYEVEMEAMRSRESTTMYVDFEHVMRFNDVLQKAISEEYLRFEPCLRNACKRFVLEHRAGENRAPIISDDSPNKDINIAFYNIPMLKKLRELGTAEIGKLTAVMGVVTRTSEVRPELLQGTFKCLDCGNVVKNVEQQFKYTEPIICVNATCQNRTKWALLRQESKFTDWQRVRMQETSKEIPAGSLPRSLDVILRHEIVEKARAGDTVIFTGTVVAVPDVMALTSPGERAECRREGPQRKNGGVQEGVKGLKSLGVRDLSYRLAFVANSVQVADGRREVDIRDRDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALAPAFSTAQLKRYISFAKSLKPQLSSEAKKVLVESYVTLRRGDSTPGTRVAYRMTVRQLEALIRLSEAIARSHLERVVLPAHVRLAVKLLKTSIISVESSEVDLSDFQDAEDGTNVPSENDAGQPAEEDTAPQQQGAENDQAADSGKKKLVITEEHFQRVTQALVMRLRQHEESVKKDGDGLAGMKQGDLIIWYVEQQNAKGAYSSTAEVKEEVKCIKAIIERLIQREGHLIVIDEGTAAPAEDGSGVRRTSESRILAVNPNYVVD

SEQ ID NO: 187 - protein, 769 aa, Oryza sativa
MEGFHNLLARPNSAPFAFSLPRPRPRPRRRPPPHPSAACRAASRWAERLFADFHLLPTAAPSDPPSPAPAPAAAPSASPFVPLFPDAAERSLPLQVDFYKVLGAEPHFLGDGIRRAFEARIAKPPQYGYSTDALVGRRQMLQIAHDTLMNQNSRTQYDRALSENREEALTMDIAWDKVPGVLCALQEAGEALAVLVTGEQLLLDRPPKRFKQDVVLAMALAYVDLSRDAMAASPPDVIGCCEVLERALKLLQEDGASNLAPDLLSQIDETLEEITPRCVLELLSLPIDTEHHKKRQEGLQGARNILWSVGRGGIATVGGGFSREAFMNEAFLRMTSIEQMDFFSKTPNSIPPEWFEIYNVALAHVAQAIISKRPQFIMMADDLFEQLQKFNIGSHYAYDNEMDLALERAFCSLLVGDVSKCRMWLGIDNESSPYRDPKILEFIVTNSSISEENDLLPGLCKLLETWLIFEVFPRSRDTRGMQFRLGDYYDDPEVLSYLERMEGGGASHLAAAAAIAKLGAQATAALGTVKSNAIQAFNKVFPLIEQLDRSAMENTKDGPGGYLENFDQENAPAHDSRNAALKIISAGALFALLAVIGAKYLPRKRPLSAIRSEHGSVAVANSVDSTDDPALDEDPVHIPRMDAKLAEDIVRKWQSIKSKALGPEHSVASLQEVLDGNMLKVWTDRAAEIERHGWFWEYTLSDVTIDSITISLDGRRATVEATIDEAGQLTDVTEPRNNDSYDTKYTTRYEMAFSKLGGWKITEGAVLKS

SEQ ID NO: 188 - protein, 523 aa, Gossypium hirsutum
MKRTATKKNRRPRATKTPAVNDSSRHALSQRDQRREGEGEDDEEQKRLLGSLMEAFGSISLEEATSAYNQADGDLDKAAEILSNLIDNGNNSEDPDPSTSSISSGSSSSGSSGFGFSETSCLQNLNSGRGRSRWGKQQKRVVASTGTVSTVLGKDYVRSSPWRDPAAVAPAKSVLATEEAEQFLCSMLGEECELSMAVVRDVLCQCGYNVEKALDALLDLSASSYEKSKSFNDNLNSRQDTGFVIECADNLTDRTSDCISKLLESELQDSIWSAGYGHRNYSKVLASSEAMQPPCPRNNVSNLPQEVLDSLFKIPKSSEHEPSTMSWRNVVKKMQLLGPPIDFCPSTDAEPQQDIYAKGDEYHKFRECAKEHWDSMRSYYQKAATAYSKGELEYAAYLSDQGKIQTKLAREADERASQNIFKARNKAFENVITIDLHGQHVKQAMKLLKLHLLFGIHVPSVQTLRVITGCGTHGMGKSKLKQSVTKLLEKEGIQWREENRGTVLIKLGGYREFSFLESNSDTE

SEQ ID NO: 189 - protein, 310 aa, Setaria italica
MKVTVVSRSGREVVKGGIDLKDSAKVADLQEAIHARTKKYYPARQRLTLPLQPGKGGKPVVLNPKASLSEYCEKGSGSLTVVFKDLGPQVYYSTLFFFEYLGPLIIYPMFYYLPVYKFFGYEGERVIHPVQTYAMYYWCFHYFKRIMETFFVHRFSHATSPLSNVFRNCAYYWTFGAYIAYYCNHPLYTPVSELQMKIGFGFGIICQIANFYCHILLRNLRSPSGSGGYQIPRGFLFNIVTCANYTTEIYQWVGFNIATQTVAGYIFLVVAASIMTNWALGKHSRLKKLFDGKDGRPKYPRRWVILPPFL

SEQ ID NO: 190 - protein, 232 aa, Setaria italica
MSGHNHTTGSCRGRRAEAGGAMATTLSLSSPLFLAAPARARDVALCGVPSASTSWSTANALSKGYMVRVHERGKQRRMAIVSVIGRKSTTRETVVPDPDYRLPIAILGIAGAFAYADNLLAAAPVGLLGLLLLFQTTRVRFVFDNEALEVKVGDQLQESGENVFVGGKNRWKYSTFINWELWWPQFPILVYFKESQTKPEGQIHFFPVIFNGRQLYDVMVERAGPSKTSGPK

SEQ ID NO: 191 - protein, 334 aa, Setaria italica
MALLAADAEARWPTSPTPAPAWFTLLLALGLLVLVRSAATFLAWLHRAFLRPGRDLARRYGTWAVVTGATDGIGRAVALDLARRGLHLVLVGRSPDKLARVGKEVLAAAPSCKVRSVAFDLASTGDDARHGVARVAAAVEGRDVGVLVNNAGATYPCAAYFHEVGDPVWEAVVRVNVEAATRITRAVVPLMAARGRGAVVNVGSGSSVVVPAFPLYAVYAASKAYVDQFSRSLSVEYKQYGVDVQCQIPLYVATKMSPVKGDSPFIPSPEEYAKAALRCIGYEARCVPYWRHSVQWFLASLVPDAALNQWRLQIGIRKRNETNKALAGVKKVLG

SEQ ID NO: 192 - protein, 1656 aa, Zea mays
MEPAVATAGEGQRFKRIPRQAWSGNLELGPLLNESLDQWPHLNELVQCYKADFVKDDCKYGHYESVASPSFQNQIFEGPDTDIETELQLCNARHSKSEDATEDDTPSTSGRQIYETESSGSSSKVHCSLSPLPAYEAAFDWENERSLIFGQRVPESIPAISNSGLKITVKVLSLSFQAGLVEPFSGTICLYNRDRRERLSEDFYFHMLPTDMQVDQGSLDRRGVFSLDAPSPSVCLLIQLEKAATEEGGVTPSVYSRKEPVHLAEKEKQKLQVWSRIMPYKESFAWAMIPLFESNHAGGLSDAASPSSPLAPSLSGSSSQDSIVDPISKLALDGKVNHYSSGSSVIVEISNLNKVKESYIEDSLQDPKRKVHKPVKGVLRLEVEKLHDDHNDVDNASEGGSMANDLNDAGDINNGRSNRSSFDGIHSSVNSIAIAKKDAHHNGHTSNAENVDNFQAFDFRVLTRSEPFSQLFHCLYVYPLTVSLSRKRNLFVRVELRKDDSDIRKPPLEVIIGYSVLPLSTHIQLLSDVSLPILRELVPHYLQESGKERMDYLEDGKTVFRLRLRLCSSLFPINERIRDFFVEYDRHTLHTSPPWGSELLEVAAFRAMVNILTRVQQESSDGAERNRFLINYVDFAFDDFGDRQAPVYPGLTTVWGSLARSKAKGEDVPPLQLKEGVFRCIMQLFDCLLTEVHERCKKGLSLAKRLNSTLAFFCYDLLSIIEPRQVFELVSLYMDKFAGVCQSVLHDCKLTFLQIICDHDLFVEMPGRDPSDRNYLSSVLIQEIFLTLDHDDLSQRAKAARILVVLICKHEFDARYQKSEDKLYIAQLYFPLIGQILDEMPVFYNLNAIEKREVLVVILQIVRNLDDATLIKAWQQSIARTRLFFKLLEECIIHFEHNKTGDNMLLGASSRSPDVEHPASPKYSERLSPSVNTYLSEASRHEIRGTPENGYMWNRVSPQLSSPNQPYSLREALAQAQSSRIGSTARALRESLHPVLRQKMELWEENLSTAVSLEVLGITEKFSVAAGARSITTDYAKLDCVTSILMGLLSRNQSLAFWKAFLPVVYNIFNVHGATLMARENDRFLKQIAFHLLRLAVFRNDSIRKRAVVGLQILVRNSFNYFKNTTRLRVMLTITLSELMSDVQVTQMKFDGSLEESGEARRLRKSLEEMADVRSKDLLKDCGLPVTALEAAPEGSSDNRWSWVEVKHLSKCLVQALDAGLEHALLEMQSWAEAAQCAVAVAGVIMQALVGRNDAVWSKEHVASLRKICPIVNTDVSAEASAAEVEGYGASKLTVDSAVKYLQLANKLFTQAELYHFCASIQELIIPVYKSRRAYGQLAKCHTSLTNIYESILEQEASPIPFIDATYYRVGFYGERFGKLNKKEYVFREPRDVRLGDIMEKLSHIYEAKIDGSHTLHIIPDSRQVNADELQPGFCYLQITAVDPVMEDEDLGSRRERIFSLSTGTVRARVFDRFLFDTPFTKNGKTQGGLEDQWKRRTVLQTEGSFPALVNRLPVIKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 193 - protein, 948 aa, Zea mays
MKSGVMVLGVGSPEEAPDRNDAEPRRDMGQSQMQVGGPVVLNRSAELGSGDFMAIDDAPVQAPSGQPAAAKHQSPAALTDTIMEVQKQLKRKRASNNPVIAAADKDALAAGCRQELEGLFQFYKEVSDRKVQLDGGNLSVNGMVGCLLEESSLGLTKLVDGIYEKLKGLDGVSVASVRGSVLLVGQRMMYGKSSLDADVLEDDTESALWCWETRDLKLMPVKARSVLSTRRSVRKKIHERITAIYSTLSVLENPGVYVQVNDLKKASLRLNKSLNLEGIRSMVERVAQKNLERGVKVAGSAIKELKQETEKNDQNLRRLEDTSVSELQNGNSPDNEKEVQKAQKQVEKEIKRQEKEEARMKKLQKKQQEDVLREQKRREKEEAEAKKQQKKQEEEALKEQKRREKEEAEMKKQHKKQQEEAEKEQKRLEKEAAQLKKQLAVQKQASMMQRFFKSKKDNGKLQKSGENNSADGPCNDNKETVPSTTSKIDYSLSQQESWVLEDLWRLQITGWKKLSSHNRSSRWGVRCKPKTKAFNELKLQKSSDDMVDEILSTPNKDGCHTSSQENEHATLESDIDMLQAIEVQCHDTNNPKPLQTRLIRRKLLQFDKSNRPAYYGSWRKKSVVIGPRCPLKMDPNLDYEVDSDDEWEEEDPGESLSDCEKDNDEFMEEDSKITDEEDEDSFVVPDGYLSDNEGIQIESLLDDKDEEASSSPTGQCAEVEEFRSLLRQQRVLNILTEQALRKSQPLIISNLNHEKAELLTAEDLKGTAKIEQLCLQVLSMHICPGGAVVDVPLTDSSSATVEEINQPNPKDGSPGAASAIPETDLPEIVQVIRSCRDGIHKVVELLQHKFPNVSKTQLNRKVREISDFVDNHWKVKKEVLDKLGLDSSPVKSKKNKSIAMYFSKRCLPPEEAVNALSASPELRLKSRTIQNGNGGTEAPQINLFPSKQ

SEQ ID NO: 194 - protein, 465 aa, Oryza sativa
MQSLLLPTFAAASAAPPRRGRVPPAGRASVSVRASASAAAVAPRRETDPRKRVVITGMGLVSVFGNDVDAYYDRLLAGESGIGPIDRFDASNFPTRFAGQIRGFSSEGYIDGKNDRRLDDCLRYCIVSGKKALESAGLALGSKSMDKIEKTRAGVLVGTGMGGLTVFSDGVQNLIEKGHRKITPFFIPYAITNMGSALLGMDIGFMGPNYSISTACATSNYCFYAAANHIRRGEADVMIAGGTEAAIIPIGVGGFVACRALSQRNDDPKTASRPWDQDRDGFVMGEGAGVLVMESLEHAMKRDAPIIAEYLGGAVNCDAYHMTDPRSDGLGVSSCIKQSLADAGVAPEEVNYINAHATSTLAGDLAEVNAIRQVFKDPSEIKINATKSMIGHCLGAAGGLEAIATVKAITTGWVHPSINQFNPEPAVEFDTVPNVKKQHEVNVGISNSFGFGGHNSVVVFAPFKP

SEQ ID NO: 195 - protein, 914 aa, Oryza sativa
MAPPTPSPRPGPPPTPQAAMTTPLKTPASKHRLHFPAMTPRNGGGGGAAAGGTEHPVEVIGRIRNLAAGAGGASALEIAGGGTAVRVRGDAGGCRDFTLDGVSVSEEEDLEGFYRRFVRSRIEGVRVGAKCTVMVYGPTGSGKSHTMFGCAKQPGIVYRALRDILEGGGGGGGGVSGGGGEGDGRGEDDAGFGMGLFVQVAVLEIYNEEIYDLLVGSGANAKGNAPKARLEVMGKKAKNATYISGNEAGKISREVAKVEKRRIVKSTLCNERSSRSHCMIILDVPSVGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHAATPRDKMSSEESSTMLNSRIVAMNQFIYNLQKENKLREKERNEAQSVLRKKEEELAQLRAKLKLIEGQGAAAKEEEINSKVMEKTQSLRTELMKMEEKMLRQQQELLALQQRLKEVECEKPVQQDIIGGRLLARLSEMSARADQSMSMDMSIDFDMGDQPAAQDVKVIKEDTRQQGQIWSQANTAGSCTSAVEQEDAVRLSGYPEKVVLSTVFEEGDEEEDKDSGVEEEVCKEVVEESYVMQQPLAEPEDPATRNNRIQNIFRLCGNHRELAKKVQSPAKKAFGDENSEPAKQTFGDENKQQPAKRVFGDENKNPSAWGAIEPPMCDVRVTDSPASSQLSPIVCQVVDDAKLPASEQLKSCNALEANDENKENNASGQDGLLEIYIKWESGHLIKGLKLLSNSCLSDLRKLLEAHFEEAGSKQQQQFTFLLLGDPSGAPVSREKEAGVPISKLPSCNNQPNSYLACLRAVKKQPATEQMPFSPLESKLNSALNDVHLAALSPKVNPMSPNYIRELRA

SEQ ID NO: 196 - protein, 1218 aa, Oryza sativa
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRVWDATKRTGIQTFRREHDRFWILAAHPEMNLLAAGHDNGMIVFKLERERPAFSVSGDTVFYVKDRFLRFFEYSTQKEVQLAPIRRPGSVSLNQSPRTLSYSPTENAVLICSDVDGGSYELYIVPKDSAGRTDYLQEAKKGAGGSAVFVARNRFAVLEKSSNQVLVKNLKNEIVKKSPLPIAMDAIYYAGTGNLLCKAEDRVTIFDLQQRLILGELQAPAVKYVVWSSDMESIALLSKHAVVIANKKLVHRCTLHETIRVKSGAWDENGVFIYTTLNHIKYCLPNGDSGIIKTLDVPIYITRAIGNNIFCLDRDGKNKLITVDASEYIFKLALLRKRYDHVMSMIKNSQLCGQAVISYLQQKGFPEVALHFVKDEKTRFNLALESGNIQIAVASAKEIDDKDHWYRLGIEALRQGNVGIVEYAYQRTKNFERLAFLYLITGYMDKVGFMCKIAGQNNNLMGQFHNALYLGDAMKRVEILENAGQLPLAYITAATHGLTEIADRLAAELGENIPSLPEGKTRSLLIPPAPLTASGDWPLLRVMRGIFEGGLDATGKAELEEDDEAAGADWGDEDLDMVDASEAMANGGDGFDAEEGEANEEDGEEGGWDLEDLELPPEAETPKNAGNALSVVFVAPPPGMPVSQIWTQKSSLAGEHAAAGNFDTAMRLLSRQLGIKNFAPLKPLFLDLHMGSHSYLRALATAPIIPVAVEKGWSESASPNVRGPPALVFTFSQMEDRLKAAYKATTEGKFPEALRQFLNILHTIPLIVVDSRREVDEVKELIEIVREYVLGLRMELKRKELRDDVNRQQELAAYFTNCKLQRVHMRLVLGSAMGLCYKQKNFATAEHFARMLLENNPNESQAKRARQVQQQCSGKKDSCELNYDYRNPFVVCGATYVPIYRGQKDVSCPYCGSRFVPSIEGQLCTICELAVVGADASGLLCSPTQLR

SEQ ID NO: 197 - protein, 319 aa, Sorghum bicolor
MAFNYHDHALAMDPAAVGAAAANPSFVSGGGGGGGVAGGGPGWEREKAAIAAHPLYERLLEAHVACLRVATPVDQLPRIDAQIAARPPPMAAAAAAAAAGGAHSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYRDKLVDIREEILRKRRAGKLPGDTASTLKAWWQAHSKWPYPTEEDKARLVQETGLQLKQINNWFINQRKRNWHNNPASSSSDKSKRKRSTAGDGNAEQSW

SEQ ID NO: 198 - protein, 618 aa, Sorghum bicolor
MVFASGSGAAGGPQVLTARFVRQVVLGRWFMVFACLLILSASGATYIFSIYSKVLKSSLGYDQRTLNTLSFFKDLGANVGVISGLINEVTPPWVVLAMGAAMNLVGYLMIYLAIDGRTARPPVWLMCIYICVGANSQSFANTGALVTCVKNFPEDRGVVLGILKGFVGLSGAIFTQLYLAIYGDDAKSLVLLIAWLPAAVSILFVHTVRIMPYPRASRRRGASAATSNDAFFCFLYISIALAAYLLVMIVVQRQVNFSHAAYSVSAAALLLVLFLPLAVVVKQEYKIQKELEESLREPPTVTVEKPASLQLAAAPPQSQSMTTGTTEAAAEPSRPSSSSSSCLGSCLRHMFSPPAQGEDYTILQALVSVDMLVLFLATICGVGGTLTAIDNMGQIGQSLGYPAKSINTFVSLISIWNYAGRVTAGFASEVFLARYKFPRPLMLTLVLLLSCVGHLLIAFGVPQSLYVSSVVIGFCFGAQWPLLFAIISEVFGLKYYSTLYNFGSVASPIGAYVLNVRVAGALYDVEAAKQHGGSLVGAGDKTCIGVECFRKSFLIITAATVAGALVSLVLVWRTWNFYKGDIYAKFRESADAAEAEAEDLKRPKETAEAESEVNGRKQ

SEQ ID NO: 199 - protein, 109 aa, Sorghum bicolor
MAEAEGKAKQMAEGPSKIESMRKWVVDHKLRAVGCLWLGGISSSIAYNWSRPNMKTSVKIIHARLHAQGLTLAALVGSACVEYYDNKYGSSGPKVDKYTSQYLAHAHKD

SEQ ID NO: 200 - protein, 388 aa, Triticum aestivum
MFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFKRCINGNTIMMVGSAPGFPHGLIDPIEELGELASQYGICLHVDLCLGGFVLPFARKLGYPIPPFDFSVKGVTSISTDVHKYGLAPKGTSTVLYRNHAIRKHQFVAVTEWTGGLYISPTMAGSRPGGLVAGAWAAMMSLGLNGYLESTGKIMEVSKKIQKGIDDISGLFVIGKPDMTVVAFGSDAVDIFEVNDIMSSKGWHLNALQRPNSLHICVTLQHTAIYEEFLKDLEDSVDTVKANPGPISGGMAPIYGAAGKMPDRGTVKELLVEFMDSSC

SEQ ID NO: 201 - protein, 539 aa, Hordeum vulgare
MEAAAELALRLRAAANGRLAGQEPLLLVAAPLLALLAARAVHAAAAHVADRGLRAVLITLAMAALKLVPGVGGYIAAQKSKVVEQLQSGSASSKKNLRTELPAIGDPDGVIGELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFKRCINGNTIMMVGSAPGFPHGLIDPIEELGELASEYGICLHVDLCLGGFVLPFARKLGYPVPPFDFSVKGVTSISTDVHKYGLAPKGTSTVLYRNHEIRKHQFVAVTEWTGGLYVSPTMAGSRPGGLIAGAWAAMMSLGLNGYLESTGQIMEVSKKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 202 - protein, 475 aa, Triticum aestivum
MNTTEGKPGAAAVEEMAREAAAWCAMHGLVVGDRADPRSGTVPGVGLVHAPISLLPSRLPESFWSQACELAPLFNELVDRVSLDGDFLQDSLSKTRQVDDFTSRLLDIHRKMMDANKEENIRLGLHRSDYMLDSETNSLLQIELNTISVSFPGLCSIVTELHRTLINQYGNLLCLDAKRVPGNDASRQFAKALAKAWDEFNVDSAVVMMIVQPEERNMYDQYWIVKYLRESHGVTTIRKTLSEVEAEGQVLLDGTLVVNGRKVAVVYFRAGYTPNDYPSEAEWSARLLMEQSSAVKCPSISYHLVGTKKIQQELAKPNVLERFLENKEEIAKLRQCFAGLWSLDDEEVVKSAIENPDLFVLKPQREGGGNNIYGLDVREALIRLKKEGGDALSAYILMQRIFPKASLASLVRGGVCHEALTVSELGMYGAYLRNKDKVIINDKCGYLMRTKVSSSDEGGVAAGFAVLDSLYLTDK

SEQ ID NO: 203 - protein, 362 aa, Solanum lycopersicum
MATAVSAAVSLPSSKSTSFSSRNSIISTDKINFNKVPLYYRNVSGASRLVSIRAQVTTEAPAKVEKISKKQEEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIVWADYKKQLKKAEQWNVEVY

SEQ ID NO: 204 - protein, 974 aa, Phaseolus vulgaris
MPVRQMKESSEQHLVIKPHLQNPMNPAKKTTKAAQNGKGPPPLENDSQAFPHAKNKGRRRGRGGRKPDQGDVMMRPRCRPCTATLTSSANGNVENDFVSDMGFPTSSKSLSFARRPGYGQVGTKCIVKANHFFAELPDKDLNQYDVTITPEVSSKTVNRSIIAELVRLYKESDLGMRLPAYDGRKSLYTAGQLPFAWREFKIKLVDEEEGVNGPKREREYRVAIKFVARANLHHLGQFLAGKRADAPQEALQILDIVLRELATKRYCPIGRSFFSPDIRTPQRLGEGLESWCGFYQSIRPTQMGLSLNIDMASAAFIEPLPVVEFVGQLLGKDVMSRPLSDADRIKIKKALRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITALLKVTCQRPRDRENDILRTIQQNAYDQDPYAKEFGIKISEKLASVEARILPAPWLKYHESGKEKNCLPQVGQWNMMNKKMINGMTVNRWACINFSRSVQDSVARTFCNELAQMCQVSGMEFNPEPVIPIYNAKPEQVEKALKHVYHVSASKTKGKELELLLAILPDNNGSLYGDLKRICETDLGLISQCCLTKHVFKITKQYLANVSLKINVKMGGRNTVLLDAVSCRIPLVSDIPTIIFGADVTHPENGEDSSPSIAAVVASQDWPEVTKYAGLVCAQAHRQELIQDLYKTWHDPVRGTVSGGMIRDLLVSFRKATGQKPLRIIFYRDGVSEGQFYQVLLYELDAIRKACASLEPNYQPPVTFIVVQKRHHTRLFANNHRDRSSTDRSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQENGSTGEGNGHSSKGTRAAGDYSVKPLPDLKENVKRVMFYC

SEQ ID NO: 205 - protein, 299 aa, Arabidopsis thaliana
MASSSDHTAKIIDGKAIAHTIRSEIAEEVRGLSEKHGKVPGLAVVIVGSRKDSQTYVNTKRKACAEVGIKSFDVGLPEEVSEADLISKVHELNSNPDVHGILVQLPLPKHINEEHILGAISIDKDVDGFHPLNIGKLAMKGREPLFLPCTPKGCLELLARSGVKIKGQRAVVVGRSNIVGLPVSLLLLKADATVTTVHSHTKDPEAIIREADIVIAACGQAHMIKGNWIKPGAAVIDVGTNAVSDPSKKSGYRLVGDVDFAEASKVAGFITPVPGGVGPMTVAMLLRNTVDGAKRVFGE

SEQ ID NO: 206 - protein, 457 aa, Brassica juncea
MSVSTHCFTSPCHDRTRFFSGDDGNKLLRKRIKGTFLVKILPSSQNAYLRVTAKSSRPLSGFRSGISKGVFDIVALTSKNALKELSTPLMLKLVGVVACAFLIVPSADAVDALKTCACLLKGCRIELAKCIANPSCAANVACLQTCNNRPDETECQIKCGDLFENSVVDEFNECAVSRKKCVPRKSDLGEFPAPDPSVLVKNFNVRDFDGKWYITSGLNPTFDAFDCQLHEFHTEDGKLVGNISWRIKTPDSGFFTRSAVQKFVQDPNQPAVFYNHDNEYLHYQDDWYILSSKIENKPEDYIFVYYRGRNDAWDGYGGAVVYTRSASLPNTIVPELEKAAKSIGREFSTFIKTDNTCGPEPPLVERLEKTVEEGEKIIVKEVEEIEEEVEKEVEKVGKTEMTLFQRLAEGFEELKQDEENFLRGLSKEEMELLDELKMEANEVEKLFGKALPIRKFR

SEQ ID NO: 207 - protein, 297 aa, Phaseolus vulgaris
MHAKTDSEVTSLAASSPTRSPPRRPLYYVQSPSRDSHDGEKTATTSFHSTPVLSPVASPPHSRHSSSTRFSKKDHSHNLKPWKQIDIIEEEGLLQGDDRRNGLPRRCYFLAFVVGFLLLFSLFSLILWGASRPMKPKISVKSIKFDDVRVQAGSDPTGVATDMITMNSTLKFTYRNTGTFFGVHVTATPVELSYSDIVIASGNMKKFYQSRRSQRLVSVAVMGNRIPLYGSGASLSSTTGMPTVPVPLNLNFVLRSRAYVLGKLVKPKYYKTIQCSITLDPKKLSSPVSLKKSCRHD

SEQ ID NO: 208 - protein, 162 aa, Phaseolus vulgaris
MAKDRTIGVAMDFSKSSKNALKWALENLADKGDTIYVIHISPNSLDESRNQLWAKSGSPLIPLQEFREPEIMSKYGVQIDIEVLDTLDTASRQKEVHIVTKIYWGDAREKLLDAIEDLKLDSLVMGSRGLTTIKRIILGSVSNFVMAHASCPVTIVKEPISK

SEQ ID NO: 209 - protein, 192 aa, Phaseolus vulgaris
MEQTIWGHLPVLMRANSKESIEYILQALWRTRKSGLTTSDRCIIQDMLQLHNESDLDPLLVCLRMLIRRCVYENTSKEDIPMLFPGEVLPELQKLLTLLLQKFQREWQEDVMKDQNIVPRLKAMTWNMANLEKGSADPAAVIDLKLQNDTPFHSGVQDVKFQLATDSMDMMLKAMHCIRDQFSTMDEAVNGH

SEQ ID NO: 210 - protein, 146 aa, Phaseolus vulgaris
MDGLVQLQKQLVDYTASLFHEGFLDEQFNQLQQLQDESNPDFVVEVVTLFFEDAERLLNELTKTLGQPSTDFKKLDALVHQLKGSSSSIGAHRVHRVCISFRNSCEEQNVEGCLKNLQQVTQEYYLVKSRLEALFKMEQQILAAGG

SEQ ID NO: 211 - protein, 407 aa, Brassica napus
MESRVLLRATATVTGVPQLRRPIRAINRHFSTASSSFTAFAKPIGSIGEGGNLISGRQLRPVLLLDSSPEKREILKPVRAAAAEGGDSAGETKVGFLGKYPWLVTGFFFFMWYFLNVIFNILNKKIYNYFPYPYFVSVIHLFVGVVYCLVSWSVGLPKRAPINSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGVGTGIAIAGVALYSVIKAKIEEEKRQGKTA

SEQ ID NO: 212 - protein, 475 aa, Medicago truncatula
MYKVAKASQYLVITGIGIKDIKLAKKAWILPGQSYSVFDLSPVNYTFEVQAMSAEKLPFVLPAVFTIGPRVDDKESLLKYAKLISPHDKLSNHVKELVQGIIEGETRVLAASMTMEEVFRGTKEFKQEVFGKVQLELNQFGLLIYNANVKQLVDVPGHEYFSYLGQKTQMEAANQARVDVSEAKMKGEIGSKLREGQTLQNAAKIDAETKIIAMQRAGEGDKEGIKVRTEVKVFENQREAEVAEANSELAKKKAAWTKAAQVAEVEAAKAVALRDAELQGEVERMNALTTTEKLKAEFLSKASVQYETKVQEANWELYKKQKEAEAILYEKKAEAEAQKALADATFYARTQAAEAELYAKKKEAEGIVTLGNAQGVYLSALLNALGNNYTAVRDFLMINGGMFQEIAKINAEAVRGLEPKISIWTNGGDNSGGEGAMKEVAGVYKMLPPLFKTVHEQTGMLPPAWMGVLPDKNLN

SEQ ID NO: 213 - protein, 446 aa, Medicago truncatula
MACTSANSLLQLKGSSFQRPILNLRTNISAPYSPGLFNLKGDGLIHKGFRHQSQKHLTPRNKVTVIRAVAIPVEPAPVESAEYRKQLAERYGFEQIGEPLPDNVTLKDVITSLPKKVFEIDDVKAWKSVLISATSYALGLLMISKAPWYLLPLAWAWTGTAVTGFFVIGHDCAHKSFSTNKLVEDIVGTLAFLPLIYPYEPWRFKHDKHHAKTNMLKEDTAWQPVWQDEFESSPFLRKAIIYGYGPFRCWMSIAHWLVSHFDLKTFRPNEIKRVKISLACVFAFIAIGWPLIIYKTGIMGWIKFWLMPWLGYHFWMSTFTMVHHTAPHIPFKNSEEWNAAQAQLNGTVHCAYPQWIEILCHDINVHIPHHISPKIPSYNLRAAHKSIQENWGKYLNEASWNWRLMKTIMTVCHVYDKQQNYVSFDEVAPKESRPIRFLKKVMPDYA

SEQ ID NO: 214 - protein, 460 aa, Medicago truncatula
MYMATLGANSNIIIKNDIRFRRTTTTRLAVFKVLPTRLHFLRHDRNSRGLVVCQCQHHHHKGKPDSSSNISRILENGVNRMLVVLEDWRNSRIIQLVAILVSILMIVPSADAVDALKTCACLLKECRVELAKCLANPSCAANIACLQTCNNRPDETECQIKCGDVFENKVVDEFNECAVSRKKCVPKKSDVGEFPVPNPDVLVKSFNIADFSGKWFITSGLNPTFDAFDCQLHEFHTESNKLVGNITWRIPTPDGGFLTRSAVQRFVQDPSNPGILYNHDNEYLNYQDDWYVVSSQIENKPDDYIFIYYRGRNDAWDGYGGAVVYTRSAVLPESIIPELDRAAKSVGRDFSKFIRTDNTCGPEPSIVERLEKKVEEGEKTIVREVEELEEEVEKDLEKVGKTEMTLLQRLAEGFKVFQEDEENFLRGLSKEEMEILDSLKLEAEEVEELFGRALPLRKLR

SEQ ID NO: 215 - protein, 339 aa, Medicago truncatula
MNCSQFATTMRSAFSLHHFNSPRLSRHVSNVSASLQPQGQGTDTPPRIGFLGLGIMGTPMALNLIKAGVDLTVWNRTKSKCDPLISLGAKYKPSPEEVAASCDLTFAMLADPQSAVDVACGKHGVANGIGPGKGYVDVSTVDVDTSKLINGHIKSTGALFLEAPVSGSKKPAEDGQLIFLTAGDRNLYETVAPFLDIMGKSKFYLGDVGNGAAMKLVVNMIMGSMMASFSEGLLLSEKVGLDPKVLVEVISQGAINAPMYSMKGPSMIQSNYPTAFPLKHQQKDLRLALGLAESVSQPIPIAAAANELYKVAKSHGYSDEDFSAVIEALKSKFQHSENQ

SEQ ID NO: 216 - protein, 808 aa, Glycine max
MANSETCCSTQLIDGDGTFNVFGVENFMKEVKLAECGLSYAVVSIMGPQSSGKSTLLNHLFGTNFREMDAFKGRSQTTKGIWMARCAGIEPCTLVMDLEGTDGRERGEDDTAFEKQSALFALAVSDIVLINMWCHDIGREQAANKPLLKTVFQVMMRLFSPRKTTLLFVIRDKTRTPLENLEPVLREDIQKIWDSVPKPQAHKETPLSEFFNVEVVALSSYEEKEEQFKDQVASLRQRFHHSIAPGGLAGDRRGVVPASGFSFSSEHIWKVIKENKDLDLPAHKVMVATVRCEEIANEKYVSFVANEDWCQLEEAVQSGPIPGFGKKLSSLLDICFSEYDAEATYFDEGVRSSKQKQLQEKLFQLVQPAFQSALGHIRSGTLDKFKEAFDKTLKGGEGFSVAANNCIGSCMVQFDEACTDVVIEQTNWDTSKVREKLLRDIDAHVATVRATKISELTSSYEEKLKQALSGPVEALLDGANSDTWPSIRNLFRRETESAVSGFSAALTGFDMDEETRQKIILSLEDYARGLVEGKAREEAGRVLIRMKDRFTMLFSHDSDSMPRVWTGKEDIRAITKTARSSSLKLLSVMAAIRLDDDDTDNIEKVLAVALVDSSPNSNATRSMTMVDPLASSSWEQVSSSKTLITPVQCKSLWRQFKTETEYSVSQAISAQEANKRNNNWLPPPWAIVALVILGFNEFMTLLRNPLYLGVIFVGFLLIKALWVQLDVSGEFRNGALPGIISLSSKFIPTIMNLMKKLAEEGQNPAANNPQRTPSKSSYNEGHAVSSSASSNLTRLDNGTEYASPLKDD

SEQ ID NO: 217 - protein, 64 aa, Glycine max
  Sequence also found in Organisms: Vigna unguiculata, Arachis hypogaea
MSTKQGGKAKPLKKPKSDKKDYDEVDMANIQKKKEEEKALKELKAKAQQKGSFGGSGLKKSGKK

SEQ ID NO: 218 - protein, 535 aa, Glycine max
MALAFDEFGRPFIILKEQEQKSRLRGLDAQKANISAGKAVARILRTSLGPKGMDKMLQSPDGDVTITNDGATILDQMDVDNQIAKLMVELSRSQDYEIGDGTTGVVVMAGALLEKAERLLERGIHPIRIAEGYEMASRIAVEHLERVANKFEFDESNLEPLIQTCMTTLSSKIVNRCKRSLAEIAVKAVLAVADLARKDVNLDLIKVEGKVGGKLEDTELIYGIVVDKDMSHPQMPKQIEDAKIAILTCPFEPPKPKTKHKVDIDTVEKFQTLRLQEQKYFDDMVQKCKDVGATLVICQWGFDDEANHLLMHRNLPAVRWVGGVELELIAIATGGRIVPRFQELSPEKLGKAGMVREKSFGTTKDRMLYIEHCANSRAVTIFIRGGNKMIIEETKRSLHDALCVARNLIRNNSIVYGGGSAEISCSIAVEAAADRYPGVEQYAIRAFGDALEAIPMALAENSGLQPIETLSAVKSQQIKDNNPHFGIDCNDVGTNDMREQNVFETLIGKQQQLLLATQVVKMILKIDDVISPSEY

SEQ ID NO: 219 - protein, 609 aa, Glycine max
MEDIEDLLIGSATPPGFRLPLAAAVGVGTKRNQLSSSSLSPSPAIPGTQTIFIKTFGCSHNQSDSEYMAGQLSAFGYSLSDDPDHADLWLINTCTVKSPSQSAMDTIISKGKSSNKPLVVAGCVPQGSRDLKELEGISIVGVQQIDRVVEIVEETLKGHEVRLLTRKKLPALDLPKVRKNKFVEILPINVGCLGACTYCKTKHARGHLGSYTIDSLVGRVKSVISEGVKEIWLSSEDTGAYGRDIGVNLPTLLNALVAELPADASTMLRIGMTNPPYILEHLKEIAEILRHPCVYSFLHVPVQSGSDTILSAMNREYTVSEFRTVVDTLTELVPEMQIATDIICGFPGETDEDFLQTINLIKEYKLPQVHISQFYPRPGTPAARMKKVPSNVVKRRSRELTNVFESFTPYSGMEGKVERIWITDIASDGVHLVGHTKGYIQVLVLAPDNMLGTSAMVKITSVGRWSVFGDVIETVNPVSDNKALNKLVPNQDCGNSAKTGGFSEEPEYCACGNDICCGQGTLENNDNSRGSAVPQNQSKRNFIGWMLRKREHLHKTVESELASGSVKKQEGIMRKWDFVDKVLLGGISISILTIMALVVAVMFRVIWSQ

SEQ ID NO: 220 - protein, 309 aa, Glycine max
MAQQEVVEGFKFEQRHGKERVRVARVWKTRQGQHFVVEWRVGITLFSDCVNSYLRDDNSDIVATDTMKNTVYAKAKECSDILSAEDFAILLAKHFVSFYKKVTGAIVNIVEKPWERVIVDGQPHEHGFKLGSEKHTTEAIVQKSGSLQLTSGIEGLSVLKTTQSGFVNFIRDKYTALPDTRERILATEVTALWRYSYESQYSLPQKPFYFTEKYQEVKKVLADTFFGPPNGGVYSPSVQNTLYLMAKATLNRFPDIAYVSLKMPNLHFLPVNISNKDGPIVKFEDDVYLPTDEPHGSIQASLSRLWSKL

SEQ ID NO: 221 - protein, 253 aa, Solanum lycopersicum
MASTQLTASSISGNGFASFEGLRSTCIVKTVSFAPLKHNNSRSFSRLVVKAATTVAPKYTTLKPLGDRVLVKIKTAEEKTVGGILLPVSVQSKPNGGEVVAVGEGHSAGKTKVDISVKTGAQVIYSKYAGTEVEFDGSKHLILKEDDIVGILETDDVKDLQPLNDRVLIKVAEAEEKTAGGLLLTEAAKEKPSIGTIIAVGPGPLDEEGNRKPLSVSPGNTVLYSKYAGSEFKGADGSDYITLRVSDVMAVLS

SEQ ID NO: 222 - protein, 545 aa, Solanum lycopersicum
MVMEKNETVRTGDVFIDRSKVRILLCDSDAKSSEEVFTLLCKCSYQVISVRSPRQVIDALNAEGSHIDLILSEVDLPMSKGFKMLKHIMRDKQLRHIPVIMMSSQDEVSIVIKCLKFGAADYLVKPLRTNELLNLWTHMWRRRRMLGLVEKNIINYDFNLVVSEPSDPNTNSTTLFSDDTDDKSWKCVNPEICPSTMLQEEARCKSNASTDAAPVETAVVVPFEHPPNAPGTDDQSTGEISLFPKKSELKIGESSAFSTYVKSSLPKSTGQSPTSIRGSVPQQLGIEENTSLGGHEHIDSNIQVTGDVESHLQGDGYDNIPTSFSIERSCTPPLSQEFPHHWNSKMEEFSQVHMHLKNEAQHDVSSFHAQTPYPYYISGVMNQVMMPSTQIYHESLQHLHNHANSAMLPQYNYMPQYPHMHGISSYPFYPIGMCLQPGQLPAAHPWHSFGSSSSAEIKVSKVDLRETALMKFRQKRKERCFDKKIRYINRKQVAEQRPRLRGQFVRKVNGANVDVNGQPSSAGNDDVEEEEVQIEYVDSSHEDDL

SEQ ID NO: 223 - protein, 134 aa, Solanum lycopersicum
MLVSVFLALFLPCVGMSAVFLVYICLLWYAAAYQSAGPGAENYHSQKTNQELGLSAAQLDKLPKITGNELLMGNDCAVCLDEIENEQIARVVPGCNHGFHLECADTWLSKNPICPVCRTKLEPEFFNPPESNPC

SEQ ID NO: 224 - protein, 546 aa, Sorghum bicolor
MGPFHIPSTSGPRKFYHLVLFHVHPFWIQLLYFLSISVLGFLMLRALPMKSISVPRPSALDLVFTSVSATTVSSMVAVEMESFSNSQLLLMTLLMLLGGEVFTSMLGLHFTFTKFIKKREIPHSNNNSLHGNINGPAPAAPSSLEHGHRRRPMEMEAQAAAVQMELAGFNNDDQRDFASIARLLMFIVLGYLSVVHLAGYTLILIYLSVVGSAREVLVGKRISLSTFSVFTVVSTFANCGFVPTNEGMASFKSFPGMLLLVMPHILLGNTLFPVFLRLSITALERVTRRGDLRELLRDGGPGGGGGGGGGPAAAAIGYDHLLPGGRTWCLALTVAVFLAGQLLLYCAMEWGSDGLRGLTAFQKLVAALFMSVNSRHSGEMVVDLATVSSAIVVLYVLMMYLPPYTTFLPIAMEDHQQQQNEAQSDDKSKSSSSISIWQKLLMSPLSCLTIFIVVICITERRQIADDPINFSVLNIVVEVISAYGNVGFSTGYSCSRQVTPDGSCRDAWVGFSGKWSREGKLTLMAVMFYGRLKKFSMHGGQAWKLG

SEQ ID NO: 225 - protein, 178 aa, Zea mays
MQFFGGSSLTSVAPEATPAPAAPPGTGTGASAQVLYVFNRNGVCLLYREWHRPLRTLDPTQDHKLMFGLLFSLRSFTAKIDPTTAEKGNLGVPLLPGQGCSFYSFKTNTYKLNFTESPSGIKLILITHPRTGDQRDSLKHIYNLYVEYVVKNPLYAPGTPIKCELFNKHLDQYVRTII

SEQ ID NO: 226 - protein, 194 aa, Zea mays
MIGVGKAKQYANVLDKPLSRGRQEVSLSAFAFLFSELVQYNQTQVDNITELERRLEDAGYAVGARVLELLCHREKGNRRETRLLGILSFIHSTVWKVLFGKVADSLEKGTEHEDEYMISEKELLVNRFISVPKDMGAFNCGAFVAGIVKGVLDNAGFPAVVTAHFVPIEGQQRPRTTILIKFAEEVLHREARLG

SEQ ID NO: 227 - protein, 343 aa, Zea mays
MARHAKTDSDVTSLAASTPPRSPRGRPAYYVLSPAASHPDVHLGASGGVAGTTPAESPLHYHFHHHRHHSSGGAGVGVGGMHHSRESSTGRLLFSDQLRSGGDVAAVVSVPWRRLGNGSGAGSVGDEDDDGASLRGGSFAESPWRCYALGAVAFVAVFAFFLIVLWGASRSYKPHVVVKSVVFESYHIQGGTDRTGVPTKMMSVNATVRLRFRNRGTFFSLHVTATPFLLFYGDLTVASGEMAEFYQPRKSGRTVTVSVVGKQVPLYGAGASLHSKPNNGRLGPAVVPVRLRFVLRARAHILGLLVKSKFYRRVRCGLDIREAHLGRPARGVASGCDYHDGMR

SEQ ID NO: 228 - protein, 430 aa, Zea mays
MAAPSSAATACFVSPLPPPRRPRHFLRHLARAAAAEPTPASASSFALPSPWPWARRLRDLVPAEAAGRLLSSAAGSLIVALASASLVLGDAGAASAFVVSTPRKLQADELATVRLFQENTPSVVYITNLAVRQDAFTLDVLEVPQGSGSGFVWDKSGHIVTNFHVIRGASDLRVTLADQSVYEAQVVGFDQDKDVAVLRIEAPKDKLRPIPVGVSADLLVGQKVYAIGNPFGLDHTLTTGVISGLRREISSAATGRPIQDVIQTDAAINPGNSGGPLLDSSGNLIGVNTAIYSPSGASSGVGFSIPVDTVGGIVDQLIRFGKVTRPILGVKFAPDQSVEQLGLSGVLVLDAPPNGPAGKAGLQPTKRDPYGRLILGDIITSVNGTKVTNGSDLYRILDQCKVGETVTVEVLRGDHKEKIPVVLEPKADES

SEQ ID NO: 229 - protein, 562 aa, Zea mays
MAASGLGLSTSFLPGHDTLLRRRRRRPAGHAAASFRPVTAELGGVATELGRQLVEAVGVGLPCTVMQCGDVIYRSTLPRNDGLTITAPGLTLALATVSYLWSTPGVAPGFFDMFVLAFAERLFRPTFRKDDLVFGKKLGEGAFGVVCKASLANPEAAKKQGDLVVKKATEYGAVEIWMNERVRRACASSCADFIYGFCETKAKGKGAEEYWLIWRFEGEDTLYDLMQSKEFPYNVETKILGGIQDLPKGIARENKIIQTVMRQLLFALDGLHSTGIVHRDIKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSNLIQFNRQLKRCDYDLQAWRNLVEPRASAELRRGFDIMDLDGGIGWELLTSMVRYKARQRTSAKAALAHPYFNREGLLGLSVMQNVRLQLFRATQKDYSEAARWVIGLMARSGTEDVGGFTEAQLQELREIKPKKSSTQRNALASVLRLQRKIMRTIKESMDELNSQRKSIWWSRWIPREE

SEQ ID NO: 230 - protein, 347 aa, Oryza sativa
MATSLSLAPKPAAVAVAAAAIPRLVPPPSIDMSALSPPPPLVSVSRSMVAKHKAVVVMGATGTGKTRLAVDLALQFGGEVINADKLQLHRGLDVATNKATADERAGVPHHLIGVAHPDEEFTAADFRRAASRAAAAVAARGALPIIAGGSNSYIEELVDGDRRAFRDRYDCCFLWVDVQLPVLHGFVGRRVDDMCGRGMVAEIEAAFDPDRTDYSRGVWRAIGVPELDAYLRSCAAAGGEEERARLLANAIEDIKANTRWLSCRQRAKIVRLDRLWRIRRVDATEAFRRRGGAANEAWERHVAAPSIDTVRSFLHGEFTTAAETTAAPVPPPPFLPMFALAAAGAGV

SEQ ID NO: 231 - protein, 552 aa, Sorghum bicolor
MATATATPPQCWRGLPASARAPPPLSSPLRPRPVAAHFYPLRRRIATATARGRRAPLACSPRCTLETAGPGFDPLGLYEEGSDSPSRSPLSNFFGILAPVFGSSSGGGARREKASYGRGAAAAIEDSSIDIGDFFKGPLPGKFLKLLGFLALSRLGVYIPLGGVNREAFAGNLDQNSLLGTLDSFSGGGIGRLGICSLGIVPFINAQIVFQLLAQLYPKLQDLQRKEGEAGRKKVLQYTRYASVGFAIFQAIGQVLYLRPYVNDFSTEWVLTSVTLLTLGSVFTTFIGERISDLKLGNGTSLLIFTSIISYLPASFGRTVAQAFQDGNYVGLLTIILSFFLLVLGIVYVQEAERKIPLNYASRYSSRTGGLQRSAYLPFKVNSSGVMPIIFSTSSLALPGTLARFAGLDFLKKAAIALNPGGALYLPTNVLLIAFFNYYYTFLQLDPDDLSEQLKRQGASIPLVRPGKSTAAYIKTVLSRISVLGSAFLAVLAAGPSVVEQISHLTAFRGFAGTSVLILVGCATDTARKVQAEIISQKYKNIEFYDVNRFDQ

SEQ ID NO: 232 - protein, 144 aa, Sorghum bicolor
MSAANQLAALIHNMFATGLLDDQFQQLQMLQDPSAPNFVAEVVTLFCQDGERIIGELAKLLDKPVVDFDRVDAFVHQLKGSSASVGALKVKNTCVQFREFCQQRSKDGCLKTLEMVRINFYELRGKFQTMLQLECQVNGFPPNN

SEQ ID NO: 233 - protein, 859 aa, Oryza sativa
MASSLSLDDINDDSVDLSKAPVAEVFQKLKCDRKGLTGAEGESRLRLYGPNKLEEKKESKLLKFLGFMWNPLSWVMEIAAIMAIVLANGGGRPPDWQDFVGIVSLLIINSTISYIEEANAGDAAAALMAGLAPKTKLLRDGRWEEQEAAILVPGDIISIKLGDIIPADARLLEGDPLKIDQSALTGESLPVNKHPGQEVFSGSTVKQGEIEAVVIATGVRTFFGKAAHLVDSTNNVGHFQQVLTAIGNFCIISIGAGMAVEVLVMYPIQHRAYRDGIDNLLVLLIGGIPIAMPTVLSVTMAIGSHRLSQQGAITKRMTAIEEMAGMDVLCSDKTGTLTLNKLTVDKTLIEVCSKGVDKDMVLLYAARASRVENQDAIDTCIVNMLDDPKEARAGIQEVHFLPFNPVDKRTAITYIDGNGDWHRVSKGAPEQIIELCNMAADAEKKVHALIDSYADRGLRSLGVSYQQVPEKSKDSGGDPWQFIGLLPLFDPPRHDSAETIRRALHLGVNVKMITGDQLAIAKETGRRLGMGTNMYPSTTLLGDKNSQVNGLPIDELIERADGFAGVFPEHKYEIVKRLQEMSHICGMTGDGVNDAPALKKADIGIAVDDATDAARSASDIVLTEPGLSVIVSAVLTSRAIFQRMKNYTIYAVSITIRIVLGFLLIAIIWKFDFAPFMVLIIAILNDGTIMTISKDRVKPSPTPDCWKLNEIFLTGVVLGTYMALVTVLFFYLAHDTNFFTDVFGVTSIRESERELMAALYLQVSIISQALIFVTRSRSWSFVERPGFLLLFAFFAAQMVATAIAVYARWDFCRIQGIGWRWGGAVWQFSVVTYLPLDVLKFIIRYALTGGKAGDSAQKK

SEQ ID NO: 234 - protein, 355 aa, Zea mays
MKGKKPVKELKLTVPAQETPVDKFLTASGTFKDGELRLNQSGLRLISEENGDEDESTKLKVEDVQLSMDDLEMIQVIGKGSGGVVQLVRHKWVGTLFALKGIQMNIQESVRKQIVQELKINQATQSPHIVMCHQSFYHNGVIYLVLEYMDRGSLADIVKQVKTILEPYLAVLCKQVLEGLLYLHHQRHVIHRDIKPSNLLVNRKGEVKITDFGVSAVLASSIGQRDTFVGTYNYMAPERISGSTYDYKSDIWSLGLVILECAIGRFPYIPSEGEGWLSFYELLEAIVDQPPPSAPADQFSPEFCSFISSCIQKDPAQRMSASELLNHPFLKKFEDKDLNLGILVENLEPPMNIPE

SEQ ID NO: 235 - protein, 338 aa, Sorghum bicolor
MGPNSSALGKQQQAAAAMAPKRAYVTFLAGDGDYWKGVVGLAKGLRRVGAAYPLVVAVLPDVPEEHRRKLRDQGCVVREIEPVYPPDSQTQFAMAYYVINYSKLRIWELVEYERMVYLDADIQVYSNIDHLFDLEKGKFHAVMDCFCEKTWSHTPQYKIGYCQQCPERVAWPEQEQEQELGPPPPLYFNAGMFVHEPSLRTAKDLLDALVVTPPTPFAEQDFLNLFFRDVYSPIPPVYNLVLAMLWRHPDKLKVVRLDEVKVVHYCAAGSKPWRYTGKEPNMDRDDIKALVAKWWHIFDDQTLDYNGGEAAADQASLPLRQALAQAGAVKYFPAPSAA

SEQ ID NO: 236 - protein, 623 aa, Zea mays
MRSGRGKMATPPPPIRPAAALLLLVLAGVLASAASADLVISKADRRVDLTSHIVRVLASLKAENVGPDPVSQVLLPFPNIQAKNLAAIRAFGSEGKVKGQSTVLPIEVVQPSGAPPELTFFSALLPKPLEKGKTLYLDVLTVFTHSLQPFPEEITQAEAQLVVYQDSAHYLSPYPVKAQTLAIRLPGGRVESYTRHPNAKLVDSELKYGPFHDLPPFSYLPVIVHFENNNPFAVAKEVIREIEISHWGNVQITEHYNIAHGGARLKGEFSRIDYQSRPYVRGVSSFRHLIAKLPPRAHSIYYRDEIGNISTSHLWSDSMKTQLEIEPRFPLFGGWQTTFTVGYGLPLEDFVFYSDGKRFLNITFGSPLEEILIEKLIVKVVLPEGSKDIEVSAPFPTQQQQEVKYSHLDIVGRPVVVLEKPDVIPEHNLYFQVYYRFNNISLLREPLMLITGFFLLFVACIVYMRTDMSISKSSPSYLAKLQWDEVQATVQKIQGIFEQCLAVHDKLEASLRDLSRTGDIQSCKAARKAADTQFKELSKDLKPLLATLQSSPQSYQIWPKVEDLIVKEREMQEKLMTRHSTVVDSFEKKLRGQDVENRIALQQQKIAALRQEVESLLEYISEI

SEQ ID NO: 237 - protein, 521 aa, Sorghum bicolor
MAAAPANGDSQSGPQRNYQVVVAATRDMGIGKDGVLPWKLLGDLKFFKELTLTTSDPAKKNAVIMGRKTWESIPVKSRPLPGRLNVILTRSGSFDFATVENVVICGSMKSALELLASTPYCLSIERVFVVGGGQVLREYLNGPACEAIHLTDIQSSIECDTFIPPVDFSVFQPWYSSFPVVESNIRHSFVTFVRVRKSVAETHESNGKESTEVDTKNDKFEIENFSFLPEMVYDRHEEYQYLNLVEDIIRSGAQKNDRTGTGTLSKFGCQMRFNLRKNFPLLTTKRVFWRGVVEELLWFINGSTNAKVLQEKGIHIWDGNASREYLDSVGLAHREEGDLGPVYGFQWRHFGAEYTDMHADYTGKGFDQLMDVIDKIKNNPDDRRIIMSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPILKINPSKKDIDSFMASDFKLVGYDPHQKIEMKMAV

SEQ ID NO: 238 - protein, 701 aa, Brachypodium distachyon
MGDSSVPGALVPTVPKPEPARSGDGSAAAQAVVARQQAEEAGAASRSPEVEEEEEQALADGEAAAAAGAPDGDLLCPICMGVIKDAFLTACGHSFCYMCIVTHLGHKSDCPCCGNYLTKAQLYPNFLLDKVVKKMSARQIAKTASPVDQFRHVVQQGNDMTVKELDSLMTLIAEKKRQMEQQESETNMQILLVFLHCLRKQKLEELNEIQTDLQYIKDDISSVERHRLDLYRTKERYSMKLRMLLDEPAASKMWSSPTDKPSSLFASNSRAPLSASSQGGLQNRRLDLRHQANHQGFQRREALASSDPPNPPMQSGNVIARKRRVQAQFNELQEYYLQRRRNGAQSRRQEERDTVMMNKEGYHAGLDDFQSVLTTFTRYSRLRVIAELRHGDLFHSPNIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASAINIDMKANICSVKYNPGSSYYVAVGSADHNIHYFDLRNPSTPLHIFGGHKKAVSYVKFLSNNELASASTDSTLRLWDVKENCPVRTFRGHKNEKNFVGLSVSNDYIACGSETNEVFVYHKAISKPASSHRFVSSDVDDADDDPGTYFISAVCWKSDSPTMLTANSQGTIKVLVLAP

SEQ ID NO: 239 - protein, 481 aa, Zea mays
MGSTGREPEVTRANFPDGFVFGVATSAYQIEGARREGGKGDNIWDVFTDDKERVLDRSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQSGEVGLVVDCEWAEPFSEKLEDQIAAQRRIDFQLGWYLDPIYFGDYPESMRQRLGSDLPTFSEKDKKFIKNKIDFIGLNHYTSRLIAHHQNPDDVYFYKVQQMERVEKWSSGESIGERAASEWLVIVPWGLHKLLNYIVKKYNNPVIYVTENGMDDEDDQSATIDQVLNDTKRVGYFKGYLNSVAQAIKDGADVRGYFAWSFLDNFEWAMGYTKRFGIVYVDYKDGLSRHPKASALWFSRLLKGEAAENSYS

SEQ ID NO: 240 - protein, 143 aa, Zea mays
MALAAIYNLFIINKSGGLIYYKDYGSAGRMDTNDSLRLASLWHSMHAISQQLSPTPGCTGIDLLQAHNFDLHCFQSLTGTKFFVVCETGAPNMEMLLKVIYELYTDFVLKNPFYEMEMPIRCELFDHNLAQMIQKDRVALLGR

SEQ ID NO: 241 - protein, 695 aa, Oryza sativa
MAKKGAPRRQPPPPPPRQLAAGKKGKASPKAAKRAAPKKQRLLESSSDDSELEQQQGQLQEVESGSDLDVPSDSGAEELSDSDDASFEGGDSGDDEEEEDDEDGDDDPLADDFLAGSDDESDGGDDSGVDSDESDDLEAKSRAIDEEKEKAEEEAEEELKLNIRSESDEFRLPTKEELEEEALRPPNLPNLKRRISEIVRVLSNFSKLRQKDVPRKDYVNQLKTDIMSYYGYNDFLVEAFIEMFPAVELVELLESFEKKPPECLRTNTLKTRRRDLAAALIPRGFNLDPIGKWSKVGLVVYDSTISAGATVEYMAGHYMKQGASSFLPVMALAPQEKERIVDMAAAPGGKTTYIGALMKNTGIIYANEFNEKRLHGLLGNIHRMGVTNTIVCNYDGKELPKVLGMNSVDRVLLDAPCTGTGTIWKDPQIKTSKGIEDIRDCAFVQKQLLLAAIDLVDANSKTGGYIVYSTCSLMIPENEAVVDYALKKRNVKLVPCGLDFGRPGFIRFREHRFDTSLDKTRRFYPHVNNMDGFFVAKLKKLSNTIPVASESSNVPEEAIEKADPSSDDPQKQPIQSKKHKDVKTTNEETSILDGVTKDKRQTHETLKNHKKGEKKRNGPESTKIKGDQKETHNEQEEPTSEKKQPVSAEIKKSVPKRISGNKGKKLDTGKGEKRKRNWMVRRDWEAYKKSRSKQV

SEQ ID NO: 242 - protein, 576 aa, Sorghum bicolor
MAASLLPPAATLVKKYPALLHPSGAKPHAQRLIFRCGATSADDGWASLVDELKRSLQQADTSDTVTSNAGAGVTPNDLVTALPLEPSTTTGPAVGDATSAAAGAVNELLGVDAASSDGGGAAAIPDGLLSALLHLDASSNPVARAAGGALSGLDALTSGLSDAQRWALFGFLAATWLYLTARPGVLSGAVDTYVLAPLQLALDSVLGRRSLKMSDFVVGERIGEGSFGVVYAGAVVPKDGTVVEERSGRARTTLQNDDRYKEKVILKKIKMLTVGAKECGDYEEWFNYRVARAAPESCADFLGSFVADKNKAEFVKGGKWLVWKFEGDRTLANYMSDRGFPSNLEPLMFGRVLQGLRTQERDALVVKQVMRQLITSLKRIHATGIVHRDIKPSNLVVTRRGQVKLIDFGAATDLRIGKNYVPDRALLDPDYCPPELYVLPEETPEPPPEPIAAILSPILWQLNSPDLFDMYSAGIVLMQMAIPTLRTQSGLKNFNAELRSAGYDLNRWRQSARRRPDLQILDLDSGRGWDLATKLISERGPNGGGRLSAAAALRHPYFLLGGDQAAAVLSKFSLSK

SEQ ID NO: 243 - protein, 685 aa, Oryza sativa
MGDSTVAGALVPSVPKQEQAPSGDASTAALAVAGEGEEDAGARASAGGNGEAAADRDLLCPICMAVIKDAFLTACGHSFCYMCIVTHLSHKSDCPCCGNYLTKAQLYPNFLLDKVLKKMSARQIAKTASPIDQFRYALQQGNDMAVKELDSLMTLIAEKKRHMEQQESETNMQILLVFLHCLRKQKLEELNEIQTDLQYIKEDISAVERHRLELYRTKERYSMKLRMLLDEPAASKMWPSPMDKPSGLFPPNSRGPLSTSNPGGLQNKKLDLKGQISHQGFQRRDVLTCSDPPSAPIQSGNVIARKRRVQAQFNELQEYYLQRRRTGAQSRRLEERDIVTINKEGYHAGLEDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASAINIDMKANICSVKYNPGSSHYVAVGSADHHIHYFDLRNPSAPVHVFGGHKKAVSYVKFLSTNELASASTDSTLRLWDVKENCPVRTFRGHKNEKNFVGLSVNNEYIACGSETNEVFVYHKAISKPAANHRFVSSDLDDADDDPGSYFISAVCWKSDSPTMLTANSQGTIKVLVLAP

SEQ ID NO: 244 - protein, 705 aa, Hordeum vulgare
MAWRRVLSQAARNQSAYAIYNELAASSPLRLLRSDISAGGALRNLHERYHSSYFGGLSRSMRDLGSQSEASMLKEIYRSDPERVIKIFESQPLLRSNPSALSEYVKALVKVDRLDDSTLLKTLQRGLAASERAEGSLGSVPALKSAGQVTKDGIIGTANAPIHMVTAETGQFKDQLWRTFRSIALTFLLISGIGALIEDRGISKGLGLNEEVQPSMESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILEAHMSKVLKGDDVDLMIIARGTPGFSGADLANLVNVAALRAAMDGAKSVSMNDLEYAKDRIMMGSERKSAVISDECRKLTAYHEGGHALVAMHTDGAHPVHKATIVPRGMALGMVAQLPDKDETSVSRKQMLARLDVCMGGRVAEELIFGDSEVTSGASSDFEQATLMARAMVTQYGMSKQVGLVSYNYEDDGKTMSSETRLLIEEEVKNFLERAYNNAKAILTKHNKELHALANALLEHETMSGTQIKNLLAQVDNKQPQQGHAVEAPQKAPASPPSPAAAAAAAAAAAAQQAAAQAKGVAGIGS

SEQ ID NO: 245 - protein, 178 aa, Hordeum vulgare
MAELLFAPAMAGLVHLPEVLDRLAAADADHRDHAHHHAAHGHGHAHPRAHIGAGGGAPVDIVETPGEYSFLLDVPGLSKSDIQVTLEEDNVLVMKSASSSNGGGANGKRKREEEEADCRYIRLERRASPRSFVRKFRLPEDADAGAVAARCENGVLTVTVKKQPPPEKKTKSVQVAIA

SEQ ID NO: 246 - protein, 367 aa, Hordeum vulgare
MATISAALSVSILPPLARRAVSTATSSPPRFKRAARFRCCAEPPSPEQKETSAPPPPPPAPPSSLWGVSTSAWTAGVAGLGLLETGYLSYLKLTGSEAFCPVAGGGCGDVLDSDYSVVFGIPLPLVGMVTYGMVTALSLQENGDELLPGLDDLDIRLTLLLLATSLATASAYFLFILNTKFVGTSCLYCLSSAFISFTLFFIRLKELLQDIGLARIQKFVGLQLAVAVIVALALTNSYSSATTQLKGTGDFVLEPYKTEVTSESTPFAISLARHLHSIGAKMYGAFWCTHCNDQKQLFGREAMEILDYVECFPNGAGKGKKMAEECVTTGLEGFPTWVINGKLLSGDQELSVLAEESGFVSESPEQS

SEQ ID NO: 247 - protein, 350 aa, Gossypium hirsutum
MPSSPKFFHARTSPPATPHTRSTLLIFASLLTFAIVSFLFALSSFLSSGGSGYRCRNSDPRSVRVIWDKTGHGNNGLSAAGDDDGTKRHKIMGFVGIQTGFGSTGRRQSLRKTWMPSDRQGLQRLEEATGLAFRFVIGRTNDKSKMAELKKEVAEYDDFLLLDIEEEYSKLPYKTLAFFKAAYALFDSEFYVKADDDIYLRPDRLSLLLVKERSHSQTYLGCMKKGPVFTDPKLKWYEPLSFLLGKEYFLHAYGPIYALSADVVASLVALRNDSFRMFSNEDVTIGAWMLAMNVNHEDNRALCEPECTQSSVAVWDIPKCSGLCNPEKKMLELHQIDACSKSPTLPSDDD

SEQ ID NO: 248 - protein, 543 aa, Setaria italica
PAASLSLSLSLSLSLSLSLPLSRKRAQERRVQRRLSAMMDLRVAAAAPAGTGVRVLGGSVARVPPRPWALRGKRRLSVRMSVATTEAATAATAVGASEDQVLESRNAKTVVAVILGGGAGTRLFPLTKRRAKPAVPIGGSYRLIDVPMSNCINSGINKVYILTQFNSMSLNRHLSKAYDFSNGVAFGNGFVEVLAATQRPGSEGKRWFQGTADAVRQFDWLFDDAKAKDIEDVLILSGDHLYRMDYMDFVQSHRQRGAGISICCLPIDGSRASDFGLMKIDDTGRVISFSEKPKGDELNAMQVDTTVLGLSKEEAEQKPYIASMGVYIFKKDILLNLLRWRFPTANDFGSEIIPASAKEINVKAYLFNDYWEDIGTIKSFFEANLALTEQPPKFSFYDADKPMYTSRRNLPPSMVNNSKITDSIISHGCFLDNCKIEHSVVGVRSRIGRNVHLKDTVMLGADYYETDAERGEQLAEGKVPIGIGDNTTIQKCIIDKNARIGKNVTISNSEGVEEADRTSEGFYIRSGITIVLKNSIIADGLVI

SEQ ID NO: 249 - protein, 248 aa, Zea mays
MSERSESATEKIMSSIMDTIADNLPKQKSGKFDPGSVSDKVKNKLFGRQKTLHGVLGGGKPADVLLWRNKKISSSVLALATAIWVFFEWLDYHFLTIVSFALVLGMVVQFVWSNFSNMLSSGSRSQVPRVELPDELFVNIAVAIGAQVNKFLCFLQDVSCERNLKHFVVAIAGLWAAAVIGSWCNFLTVIYVGFVCVHTLPVLYEKYEDQVDDFLYSLLGLLRDQYQKLDQGVLSKIPKGNMKAKKNE

SEQ ID NO: 250 - protein, 515 aa, Zea mays
METSAPPNAPAPPAQPRRRLPDFQQSVRLKYVKLGYHYLISHGMYLLLSPLMALVAVQLSTVSPHDLADLWEQLRFNLLSVVACSTLLVFLSTVYFLTRPRPVYLLDFACYKPESERKCTRETFMHCSKLTGSFTDENLEFQRKILERSGLGEDTYLPPAVLRVPPNPCMDEARKEARAVMFGAIDQLLEKTGVRPKDIGVLVVNCSLFNPTPSLSAMVVNHYKLRGNIVSYNLGGMGCSAGLLSIDLAKDLLQVHPNSYALVISMENITLNWYFGNNRSMLVSNCLFRMGGAAILLSNRRSDRRRSKYELVHTVRTHKGANDKCFGCVTQEEDEIGKIGVSLSKDLMAVAGDALKTNITTLGPLVLPLSEQLLFMGTLIAKKVLKMKIKPYIPDFKLAFEHFCIHAGGRAVLDELEKNLELTDWHMEPSRMTLYRFGNTSSSSLWYELAYTEAKGRIRKRDRIWQIAFGSGFKCNSAVWKALRTVNPAKEKSPWMDEIDNFPVDVPKISKVGGA

SEQ ID NO: 251 - protein, 329 aa, Zea mays
MVSHSLSAWLMSSAPPPAWFAALVAVGMYTALRSAATFLAWLHRAFLRPGRDLAGRYGTWAVVTGATDGIGRAVALELARAGLHLVLVGRSPDKLARVAKELAAAAPACKVRSVAFDLAVTGDAARRGVARVAAAVEGRDVGVLVNNAGATYPCAAYFHEVEGPVWEAVLRVNVEAATRITRALLPAMAARGRGAVVNVGSGSSVVVPAFPLYAVYAASKAYVDQFSRSLSVEYKQYGVDVQCQIPLYVATKMSPVKGASPFIPSPEEYARAALRCVGYEARCVPYWRHSVQWFLASLAPDAALNHWRLQTGLQKRNETKALLGGKDCS

SEQ ID NO: 252 - protein, 870 aa, Zea mays
MDITQVLIAAQSPDANLRTVAEGNLTQFQEQNFPNFLLSLSIELSNDEKPPESRRLAGIILKNSLDAKDSAKKELLTQQWVSVDPSIKLKIKELLLVTLGSSVHDARHTSSQVIAKVASIEIARREWQDLVAKLLGNMTSAGAPAPLKQATLEALGYVCEEISPQDLEQDQVNAVLTAVVQGMNQTELSPEVRLAAVKALYNALDFAESNFANEMERNYIMKVVCDTAVSKEVEIRQAAFECLVAIASTYYSHLEPFMETIFYLTANAVKGDEEPVALQAVEFWSAICDEEIALQDEYEGSEDGNSAIHFRFIEKALPLLVPLLLETLLKQEEDQDQDDNAWNISMSGGTCLGLISRTVGDAVVPLVMPFVETNITKPDWHCREAATFAFGSILEGPSVGKLAPLVQAGLDFLLNTMNDANSQVKDTTAWTLGRVFELLHSPAGINSIINGSNLPRIMSVLLESTKDAPNVAEKVCGAIYFLAQGYEDAESTSSVLTPYLSNTIAALLSAADRAETTHFRLRASAYEALNEIVRVSNIPETSGIIAQLLQEIMRRLNLTFDLHILSSGDKEKQSDLQALLCGVLQVIIQKLSSTDAKSIISQTTDQLMVLFLRVFACHNSTVHEEAMLAIGALAYATGPDFVKYMPNFFTYLEAGLQNYEEYQVCSISVGVVGDICRALEDKSLPFCDRIMTVLLKDLSSSMLNRSVKPLIFSCFGDIALAIGENFEKYLPYAVPMLQGAAGLLGTLDLSDDDMVDYGNQLRRGIFEAYSGILQGIKGPKAQLMIPYATHLLQFTEAVSKDRSRDDSVTKAAVAVLGDLADTLGQSSKDLFKTHLFHVEFLRECQAQELDDEVRETAQWAQGMINQAVVS

SEQ ID NO: 253 - protein, 201 aa, Zea mays
MGHRRHEGSCRCELCGAPAAVHCAADEAFLCAACDAKVHGANFLASRHRRTRLRLAAAGPPPPDDEAGYGSAASSCVSTADSAPRPRRGARAPAGSVRPEAVLEAWAKRMGLGAGARRRVPPRVAVAAALWWEAAGRGGVGGHAQALRRLEACAHVPARLVLAVAASLARARALLRRAATDAVEGWDECAWAGPKSSPSRS

SEQ ID NO: 254 - protein, 604 aa, Oryza sativa
MSAMRRRPVLPTHQDDMEKVGGKPPQSRLCFLATLCAMFWVLIFYFHFFVIANEPGSAGADTAAGAAASIARAELPLPEPERVSDPAVPLPPPALVSEPPPTTATVAKVEDEEKPTAVAHQEAAPRDYAFQRALKTAENKSDPCGGRYIYVHELPPRFNDDMLRECERLSLWTNMCKFMSNEGLGPPLGNEEGVFSNTGWYATNQFMVDVIFRNRMKQYECLTKDSSIAAAVFVPFYAGFDVARYLWGHNISTRDAASLDLIDWLRKRPEWNVMGGRDHFLVGGRIAWDFRRLTDEESDWGNKLLFMPAAKNMSMLVVESSPWNANDFAIPYPTYFHPAKDADVLLWQDRMRSLERPWLFSFAGAPRPDDPKSIRSQLIDQCRTSSVCKLLECDLGESKCHSPSAIMNMFQNSLFCLQPQGDSYTRRSAFDSMLAGCIPVFFHPGSAYVQYTWHLPKNYTRYSVFIPEDGVRKGNVSIEDRLKSIHPDMVKKMREEVISLIPRVIYADPRSKLETLKDAFDVSVEAIINKVTQLRRDIIEDHEDKDFVEENSWKYDLLEEGQRTIGPHEWDPFFSKPKDKGGDSTNPSTNAAKNSWKNEQRGQN

SEQ ID NO: 255 - protein, 496 aa, Oryza sativa
MGENGVVASKLCYPAAAMEVVAAELGHTAGSKLYDDDGRLKRTGTMWTASAHIITAVIGSGVLSLGWAIAQLGWVAGPAVMLLFSFVTYYTSALLADCYRSGDESTGKRNYTYMDAVNANLSGIKVQVCGFLQYANIVGVAIGYTIAASISMLAIKRANCFHVEGHGDPCNISSTPYMIIFGVAEIFFSQIPDFDQISWLSILAAVMSFTYSTIGLGLGVVQVVANGGVKGSLTGISIGVVTPMDKVWRSLQAFGDIAFAYSYSLILIEIQDTIRAPPPSESRVMRRATVVSVAVTTLFYMLCGCTGYAAFGDAAPGNLLTGFGFYEPFWLLDVANAAIVVHLVGAYQVYCQPLFAFVEKWAQQRWPKSWYITKDIDVPLSLSGGGGGGGRCYKLNLFRLTWRSAFVVATTVVSMLLPFFNDVVGFLGAVGFWPLTVYFPVEMYIVQKRIPRWSTRWVCLQLLSLACLAITVASAAGSIAGILSDLKVYKPFATTY

SEQ ID NO: 256 - protein, 220 aa, Oryza sativa
MDAMAVLARTSRPAPTLLAATSPAVSRRPAAVSFAAAASPGSRGRVALSAAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 257 - protein, 748 aa, Oryza sativa
MAKSNNGNGYLGVTEPISLSGPTEKDVVRTQEVEKCLADAGLYESQEEAVSREEVLGKLDQIVKAWIKKATRASGFGDQFVQEANAKIFTFGSYRLGVHGPGADIDTLCVGPRHATRTEYFFQALYDMLVDMPEVTELHPVPDAHVPVLKFKLNGVSIDLLYANLTHVVIPEDLDLSHDSILHNVDEQTVRSLNGCRVTDKILRLVPNILTFRTTLRFMRFWAKRRGVYSNVIGFLGGINWALLVARICQLYPNASPSMLISRFFKVYSKWKWPNPVMLCHIEEGSLGLLVWDPRRNFRDRGHHMPIITPAYPSMNSSYNVSISTRHVMVQEFTRASDICQAIDERKADWDALFEPYPFFESYRNYLKIEITARNEDDLRNWKGWVESRLRTLVLKIERFTREMLLSHPNPRDFIDSSRPLHCFYFMGLWKKQISQAQEAEQYDIRAIVNEFKSNIHAYQHWREGMEIEVSHVKRKDIPSFVFPGGIRPSRPSRTVGKEARAVSRSNISANVQERNVPSMAQPMPYKSSEVNKIPSDPHGGYQSQERNNAVVSSLPCEETGHMFNGYANLHTESVELEHLRSYKGSTSVPENHVVHDLVKPPESMPPNSIHVYPSPTNGLGHLLDSSCKKPADIIVNKTTNFSSAVLAVPDELDELDSHQVKVNQKDLTAVDQGLSLEHKVGSNGGKAGTTGSPDNNHLKRKAEEELEPLELAAPLVRPPAPTSTTQRRPLRLRLSTVVQPKPAEGTS

SEQ ID NO: 258 - protein, 446 aa, Oryza sativa
MAPPSAMNTSRAEEKAIDDWLPITSSRNAKWWYSAFHNVTAMVGAGVLSLPFAMSELGWGPGVAAMIMSWVITLYTLWQMVEMHECVPGRRFDRYHELGQHAFGDKLGLWIVVPQQLVVEVGVCIVYMVTGGKSLKKFHDLVAPPSAPPIRTSYFIVIFGCLHLVLSQLPNFNSISGVSLAAAVMSLSYSTIAWAASLHHHNHNNGAAAGGVDYSLTEATPAGRTFNFLSALGDVAFAYAGHNVVLEIQATIPSTAERPSKGPMWRGVVLAYGVVAVCYLPVAFAGYYVFGNAVDDNVLITLERPAWLIAAANMFVVVHVVGSYQIYAMPVFDMLETFLVKKLRFKPGMPLRLIARSLYVLFTMFVAIAVPFFGGLLGFFGGFAFAPTTYFLPCIMWLSIMKPKRFGLSWCINWFCIIIGVLLSVFAPIGGLRSIIVNAQSYKFFS

SEQ ID NO: 259 - protein, 406 aa, Sorghum bicolor
MSAAGTLSGGAAGLSGLLRLRRRAAPAPAIAAPSLHPAGTIKCTAVPDAAPIVWGRQLRPALLLPAALLPSSQPAKKHNLRPAAAAAESAGEAKGFLEKYPALVTGFFFFMWYFLNVIFNILNKKIYNYFPYPYFVSLIHLVVGVAYCLVGWSVGLPKRAPINANLLKLLFPVALCHGIGHVTSNVSFAAVAVSFAHTIKALEPFFSAAATQFILGQQVPLSLWMSLAPVVIGVSMASLTELSFNWTGFINAMISNISFTYRSIYSKKAMTDMDSTNVYAYISIIALIVCIPPAIIFEGPQLMSHGFSDAIAKVGLTKFVSDLVLVGLFYHLYNQIATNTLERVAPLTHAVGNVLKRVFVIGFSIVVFGNKISTQTGIGTSIAIAGVALYSYIKAKIEEEKRKKSA

SEQ ID NO: 260 - protein, 567 aa, Sorghum bicolor
MGAAAAGPAAAPPATTHCRCIQLLLLALAVVPLGSRGLRVRAVGADTGGLSRDAFPKGFIFGTATSAFQVEGAATSGGRGPSIWDPFVHTPGKISEDGNADVTTDEYHRYKEDVDLMKSLNFDAYRFSISWSRIFPDGEGKVNEEGVQYYNNLIDYMIKQGLTPYANLNHYDLPLALQKKYQGWLGPKIVDIFADYADFCFKTFGDRVKNWFTLNEPRIVSFLGYDKGIDPPNRCTQCTAGGNSSTEPYIVVHNILLSHATAVARYRNKYQATQKGKVGIVLDFNWYEPLTNSTEDQAAAQRARDFHIGWFLDPLINGQYPKTMQDIVKDRLPSFTPEQAKLVKGSSDYFGINQYTTNYISNQQTTQQGPPSYSSDWGVQYNFERNGVQIGQLAHSVWLYIVPTGMYGVVTYLKEKYQNPTIIISENGMDQPGDLTREEYLHDTVRIDFYKNYLTELKKGIDDGANVVGYFAWSLLDNFEWLSGYTSKFGIVYVDFTTLKRYPKDSAYWFRDMLSGTGSKAAAAPQTGSGTRPAVSASATSNGAALLVSLFVSLCVLLPSVFMVSSV

SEQ ID NO: 261 - protein, 343 aa, Sorghum bicolor
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGKYCVCFDPLDGSSNIDCGVSIGTIFGIYMIKDKDNVTLADVLQPGKDMLAAGYCMYGSSCTLVLSTGSGVNGFTLDPSLGEFILTHPDIKIPKKGKIYSVNEGNAKNWDVPVAKFVEKCKYPEDGTPPKSLRYIGSMVADVHRTLLYGGVFLYPADQKSPNGKLRVLYEVFPMSFLMEQAGGQSFTGKERALDLVPTKIHDRSPIFLGSYDDVEEIKALYAEQAKSSSA

SEQ ID NO: 262 - protein, 223 aa, Sorghum bicolor
MPQSSAEKMPSVYLYIPNIIGYFRIIINFIAFAVCYSNRLLFAMLYFFSFVLDGVDGWFARKFNQASTFGAVLDMVTDRVSTACLLALLSQCYRPGLVFLMLLGLDITSHWFQMYSSFLSGKTSHKDVKNTGNWLLKLYYGYRPFMAFCCVSCEVLYIILFLFADEKSTSLLGTCRGVLKQGPLTLLVFISTLVGWAVKQVTNIIQMKTAMDTCVEFDPKRSK

SEQ ID NO: 263 - protein, 348 aa, Sorghum bicolor
MGDSGGSVVSVDVERISFGGKEHHIQTSHGPVSVAVYGDHDKPALVTYPDIALNHMSCFQGLLFCPEAASLLLHNFCIYHISPPGHELGAAPISPNAPIPSVDDLADQVADVLDFFGLGSVMCFGVTAGAYILTLFATKYRERVLGLILVSPLCKGPTWTEWLYSKVTSNLLYYYGMCGLVKECLLQRYFSKEVRGFSELPESDIVQACKSLLDQRQSMNVWRFVQTMNERYDLTEQLKQLQCRTLIFVGENSQFHTEAVHMTSKLDKRYCALVEVQACGSLVTEEQPHAMLIPMEYFFMGYGLYRPSQLDCSPRSPLSPFCISPDLLSPESMGVKLKPIKTRVRLEV

SEQ ID NO: 264 - protein, 189 aa, Sorghum bicolor
MRKEMIIRVQTTGSEKGHSKAIKVAAAISGVESVTIAGEDKNLLLVIGVGIDSDRITKKLRRKVGHAEVVELRTVDAAALADDLVGGGRAIAAADHAYRYHASPSPYRHHHHSGARDHYYGGMDHYYAGGGSAYAPPAPPPLYYGGGGGGYPAQAQYEQHDYLYHPAGAKTHTVVHHEYASDPNGCSIM

SEQ ID NO: 265 - protein, 373 aa, Solanum lycopersicum
MGRVRLSVKRLESNSNRQSTYCKRRCGILKKAQEISVLCDIDIILLLFSPTGKPTLFQGGQSNFDEIIAKFAQLTPQERAKRKLESLEVSLIFITTMCSPLAMLCCYFIIQVKVITMLMVTLQTLRKTFKKLDNDIGVPEFLDASDPSVEELHSQVKLLQSRLTDVEMRLNWWSNPDNINKVEDFALMESALRESLNAVHVRKLQKTTHLHLLMNSELDGNTHQWHPENKILHMPFPQTPNILPQENMGYFGDNSVAESSHVLGSGEVDQARQATTAILDNGVLNDLSSIACLRQQLSEQYSYNPNEDLDLLERNMLDPQSDANLKGYLMDYEFQRNLNLTRSVDSVNYSAVNAVAVPDFDEKSYAQPATSSD

SEQ ID NO: 266 - protein, 345 aa, Triticum aestivum
MASFNAAGAGAANPNPNKSLEVNPAPGDSVSSLSFSPKANHLIATSWDNQVRCWEVQPGGQCQAKASISHDQPVLCSAWKDDGTTVFSGGCDKVVKMWPLLSGGQATAFSGHEAPVKELAWIPQMSLLVSGSWDKTLRYWDIRQPNPAHVQQLPERCYALSLSYPLMAVGTADRNVVIFNLQNPQAEFKRIVSPLKFQTRCIAAFPDQQGFLVGSIEGRVGVHHVDDSNQSKNFTFKCHREGSDIFSVNSLNFHPVHHTFATAGSDGGFNFWDKDSKQRLKAFSKCPSPITCSTFNQDGSIFAYAVCYDWSKGAEKHNPSTAKTNIFLHSVQESDVKGKPRTGKK

SEQ ID NO: 267 - protein, 507 aa, Sorghum bicolor
MGLRVAATAPAAAGVRVLGGGAASVKPRPWVALGGRRRLSVRMSVATTETTTSAAAAVGASEDQALEARNSRTVVAVILGGGAGTRLFPLTKRRAKPAVPIGGAYRLIDVPMSNCINSGINKVYILTQFNSQSLNRHLSRAYDCTNGVAFGDGFVEVLAATQRPGSEGKRWFQGTADAVRQFDWLFDDAKSKDIDDVLILSGDHLYRMDYMDFVQSHRQRGAGISICCLPIDDSRASDFGLMKIDDTARVISFSEKPKGDELKAMQVDTTVLGLSKEEAEKKPYIASMGVYIFKKDILLNLLRWRFPTANDFGSEIIPAAAKEINVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETDAERRELLAEGNVPIGIGENTTIQKCIIDKNARIGKNVIISNSEGVVEADRTSEGFYIRTGVTVVLKNSIIADGLVI

SEQ ID NO: 268 - protein, 438 aa, Sorghum bicolor
MAPPSSMSTEKEEKAIDDWLPITSSRNAKWWYSAFHNVTAMVGAGVLSLPYAMSELGWGPGVVAMLLSWVITLYTLWQMVEMHECVPGKRFDRYHELGQHAFGDKLGLWIVVPQQLIVEVGVCIVYMVTGGKSFEKCYAVSCPDCKPLNTSSWIMIFAAIHLLLSQLPNFNSITLVSLAAAVMSLSYSTIAWAASAHKGRHAAVDYSMKASTATGQTFNFLSALGDVAFAYAGHNVVLEIQATIPSTPDKPSKKPMWQGVVLAYIVVAICYLPVAFVGYYVFGNAVDDNILITLEKPRWLIAMANIFVVVHVIGSYQIYAMPVFDMLETFLVKKLRFRPGLPLRLIARSLYVVFTALVGIAVPFFGGLLGFFGGFAFAPTTYYLPCILWLKIKKPKTFSLSWFINWFCIIVGVLLTVFAPIGGLRSIIVNASTYKFFS

SEQ ID NO: 269 - protein, 217 aa, Oryza sativa
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELKDHTDANIVIMLVGNKADLRHLRAVSTEDAKAFAEKENTFFMETSALESMNVENAFTEVLTQIYHVVSKKALDIGDDPAAPPKGQTINVGGKDDVSAVKKSACCSSA

SEQ ID NO: 270 - protein, 1218 aa, Oryza sativa
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRVWDATKRTGIQTFRREHDRFWILAAHPEMNLLAAGHDNGMIVFKLERERPAFSVSGDTVFYVKDRFLRFFEYSTQKEVQLAPIRRPGSVSLNQSPRTLSYSPTDNAVLICSDVDGGSYELYIVPKDSAGRTDYLQEAKKGAGGSAVFVARNRFAVLEKSSNQVLVKNLKNEIVKKSPLPIATDAIYYAGTGNLLCKAEDRVTIFDLQQRLILGELQAPAVKYVVWSSDMESIALLSKHAVVIANKKLVHRCTLHETIRVKSGAWDENGVFIYTTLNHIKYCLPNGDSGIIKTLDVPIYITRAIGNNIFCLDRDGKNKLITVDASEYIFKLALLRKRYDHVMSMIKNSQLCGQAVISYLQQKGFPEVALHFVKDEKTRFNLALESGNIQIAVASAKEIDDKDHWYRLGIEALRQGNVGIVEYAYQRTKNFERLAFLYLITGYMDKVGFMCKIAGQNNNLMGQFHNALYLGDAMKRVEILENAGQLPLAYITAATHGLTEIADRLAAELGENIPSLPEGKTRSLLIPPAPLTASGDWPLLRVMRGIFEGGLDATGKAELEEDDEAAGADWGDEDLDMVDASEAMANGGDGFDAEEGEANEEDGEEGGWDLEDLELPPEAETPKNASNALSVVFVAPPPGMPVSQIWTQKSSLAGEHAAAGNFDTAMRLLSRQLGIKNFAPLKPLFLDLHMGSHSYLRALATAPIIPVAVEKGWSESASPNVRGPPALVFTFSQMEDRLKAAYKATTEGKFPEALRQFLNILHTIPLIVVDSRREVDEVKELIEIVREYVLGLRMELKRKELRDDVNRQQELAAYFTNCKLQRVHMRLVLGSAMGLCYKQKNFATAEHFARMLLENNPNESQAKRARQVQQQCSGKKDSCELNYDYRNPFVVCGATYVPIYRGQKDVSCPYCGSRFVPSIEGQLCTICELAVVGADASGLLCSPTQLR

SEQ ID NO: 271 - protein, 504 aa, Hordeum vulgare
LAARAVHAAAAHVADRGLRAVLITLAMAALKLVPGVGGYIAAQKSKVVEQLQSGSASSKKNLRTELPAIGDPDGVIGELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEMIIAESAHSAYDKAAQYFNIKVRRVPVNKEFLADVKGFKRCINGNTIMMVGSAPGFPHGLIDPIEELGELASEYGICLHVDLCLGGFVLPFARKLGYPVPPFDFSVKGVTSISTDVHKYGLAPKGTSTVLYRNHEIRKHQFVAVTEWTGGLYVSPTMAGSRPGGLIAGAWAAMMSLGLNGYLESTGQIMEVSKKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 272 - protein, 400 aa, Brassica juncea
PLSGFRSGISKGVFDIVALTSKNALKELSTPLMLKLVGVVACAFLIVPSADAVDALKTCACLLKGCRIELAKCIANPSCAANVACLQTCNNRPDETECQIKCGDLFENSVVDEFNECAVSRKKCVPRKSDLGEFPAPDPSVLVKNFNVRDFDGKWYITSGLNPTFDAFDCQLHEFHTEDGKLVGNISWRIKTPDSGFFTRSAVQKFVQDPNQPAVFYNHDNEYLHYQDDWYILSSKIENKPEDYIFVYYRGRNDAWDGYGGAVVYTRSASLPNTIVPELEKAAKSIGREFSTFIKTDNTCGPEPPLVERLEKTVEEGEKIIVKEVEEIEEEVEKEVEKVGKTEMTLFQRLAEGFEELKQDEENFLRGLSKEEMELLDELKMEANEVEKLFGKALPIRKFR

SEQ ID NO: 273 - protein, 201 aa, Zea mays
MGHRRHEGSCRCELCGAPAAVHCAADEAFLCAACDAKVHGANFLASRHRRTRLRLAAAGPPPPDDEAGYGSAASSCVSTADSAPRPRRGARAPAGSVRPEAVLEAWAKRMGLGAGARRRVPPRVAVAAALWWEAAGRGGVGGHAQALRRLEACAHVPARLVLAVAASLARARALRRRAATDAVEGWDECAWAGPKSSPSRS

SEQ ID NO: 274 - protein, 434 aa, Solanum lycopersicum
MGRVRLSVKRLESNSNRQSTYCKRRCGILKKAQEISVLCDIDIILLLFSPTGKPTLFQGGQRCHHELELDVSIDNRCSYEEPLLLQKMLFNFDEIIAKFAQLTPQERAKRKLESLEVSLIFITTMCSPLAMLCCYFIIQVKVITMLMVTLQTLRKTFKKLDNDIGVPEFLDASDPSVEELHSQVKLLQSRLTDVEMRLKYSPAFLFVARSYGLNESCHFSPCINLTPLLRRSWWSNPDNINKVEDFALMESALRESLNAVHVRKLQKTTHLHLLMNSELDGNTHQWHPENKILHMPFPQTPNILPQENMGYFGDNSVAESSHVLGSGEVDQARQATTAILDNGVLNDLSSIACLRQQLSEQYSYNPNEDLDLLERNMLDPQSDANLKGYLMDYEFQRNLNLTRSVDSVNYSAVNAVAVPDFDEKSYAQPATSSD

SEQ ID NO: 275 - protein, 234 aa, Gossypium hirsutum
  Sequence also found in Organisms: Gossypium raimondii
MEFPNLDPESSSQKKMGRGKIEIKRIENTTNRQVTFCKRRNGLLKKAYELSVLCDAEVALIVFSSRGRLYEYANNSVRATIERYKKACSDATTPGSVAEANIQFYQQEATKLRRQIRDVQNMNRHILGEALSSLTFKELKNLEGRLEKGICRIRSKKNELLFAEIGFMQKREVELQNDNMYLRAKIAENERAQQQSNQLMQAASSYNRNFLPVNLLEPSNNDYSNQDQTPLQLV

SEQ ID NO: 276 - protein, 143 aa, Gossypium raimondii
MFSRGTNAPSGMGVADHSKSTYLELQRKKVFRYVIFKIDEKKKEVVVEKTGGPSENYDDFTASLPENDCRYAVYDFDFVTSENCQKSKIFFIAWSPSVSRIRAKMLYATSKERFIRELEGIHYEIQATDPTEMDLEVIRERAS

SEQ ID NO: 277 - protein, 831 aa, Sorghum bicolor
MEAFSGFYVDEKAARVENIFLEFLKRFKESDGAGEPFYEVEMEAMRSRESTTMYVDFEHVMRFNDVLQKAISEEYLRFEPCLRNACKRFVLEHRAGENRAPIISDDSPNKDINIAFYNIPMLKKLRELGTAEIGKLTAVMGVVTRTSEVRPELLQGTFKCLDCGNVVKNVEQQFKYTEPIICVNATCQNRTKWALLRQESKFTDWQRVRMQETSKEIPAGSLPRSLDVILRHEIVEKARAGDTVIFTGTVVAVPDVMALTSPGERAECRREGPQRKNGGVQEGVKGLKSLGVRDLSYRLAFVANSVQVADGRREVDIRDRDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALAPAFSTAQLKRYISFAKSLKPQLSSEAKKVLVESYVTLRRGDSTPGTRVAYRMTVRQLEALIRLSEAIARSHLERVVLPAHVRLAVKLLKTSIISVESSEVDLSDFQDAEDGTNVPSENDAGQPAEEDTAPQQQGAENDQAADNGKKKLVITEEHFQRVTQALVMRLRQHEESVKKDGDGLAGMKQGDLIIWYVEQQNAKGAYSSTAEVKEEVKCIKAIIERLIQREGHLIVIDEGTAAPAEDGSGVRRTSESRILAVNPNYVVD

SEQ ID NO: 278 - protein, 523 aa, Gossypium hirsutum
MKRTATKKNRRPRATKTPAVNDSSRHALSQRDQRREGEGEDDEEQKRLLGSLMEAFGSISLEEATSAYNQADGDLDKAAEILSNLIDNGNNSEDPDPSTSSISSGSSSSGSSGFGFSETSCLQNLNSRRGRSRWGKQQKRVVASTGTVSTVLGKDYVRSSPWRDPAAVAPAKSVLATEEAEQFLCSMLGEECELSMAVVRDVLCQCGYNVEKALDALLDLSASSYEKSKSFNDNLNSRQDTGFVIECADNLTDRTSDCISKLLESELQDSIWSAGYGHRNYSKVLASSEAMQPPCPRNNVSNLPQEVLDSLFKIPKSSEHEPSTMSWRNVVKKMQLLGPPIDFCPSTDAEPQQDIYAKGDEYHKFRECAKEHWDSMRSYYQKAATAYSKGELEYAAYLSDQGKIQTKLAREADERASQNIFKARNKAFENVITIDLHGQHVKQAMKLLKLHLLFGIHVPSVQTLRVITGCGTHGMGKSKLKQSVTKLLEKEGIQWREENRGTVLIKLGGYREFSFLESNSDTE

SEQ ID NO: 279 - protein, 923 aa, Oryza sativa
MAPPTPSPRPGPPPTPQAAMTTPLKTPASKHRLHFPAMTPRNGGGGGAAAGGTEHPVEVIGRIRNLAAGAGGASALEIAGGGTAVRVRGDAGGCRDFTLDGVSVSEEEDLEGFYRRFVRSRIEGVRVGAKCTVMVYGPTGSGKSHTMFGCAKQPGIVYRALRDILEGGGGGGVSGGGGEGDGRGEDDAGFGMGLFVQVAVLEIYNEEIYDLLVGSGANAKGNAPKARLEVMGKKAKNATYISGNEAGKISREVAKVEKRRIVKSTLCNERSSRSHCMIILDVPSVGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHAATPRDKMSSEESSTMLNSRIVAMNQFIYNLQKENKLREKERNEAQSVLRKKEEELAQLRAKLKLIEGQGAAAKEEEINSKVMEKTQSLRTELMKMEEKMLRQQQELLALQQRLKEVECEKPVQQDIIGGRLLARLSEMSARADQSMSMDMSIDFDMGDQPAAQDVKVIKEDTRQQGQIWSQANTAGSCTSAVEQEDAVRLSGYPEKVVLSTVFEEGDEEEDKDSGVEEEVCKEVVEESYVMQQPLAEPGDPATRNNRIQNIFRLCGNHRELAKKVQSPAKKAFGDENSEPAKQTFGDENKQQPAKLVFGDENMQPAKQVFGDENKNPSAWGAIEPPMCDVRVTDSPASSQLSPIVCQVVDDAKLPASEQLKSCNALEANDENKENNASGQDGLLEIYIKWESGHLIKGLKLLSNSCLSDLRKLLEAHFEEAGSKQQQFTFLLLGDPSGAPVSREKEAGVPISKLPSCNNQPNSYLACLRAVKKQPATEQMPFSPLESKLNSALNDVHLAALSPKVNPMSPNYIRELRA

SEQ ID NO: 280 - protein, 539 aa, Hordeum vulgare
MEAAAELALRLRAAANGRLAGQEPLLLVAAPLLALLAARAVHAAAAHVADRGLRAVLITLAMAALKLVPGVGGYIAAQKSKVVEQLQSGSASSKKNLRTELPAIGDPDGVIGELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKRGITKPEMIIAESAHSAYDKAAQYFNIKVRRVPVNKEFLADVKGFKRCINGNTIMMVGSAPGFPHGLIDPIEELGELASQYGICLHVDLCLGGFVLPFARKLGYPIPPFDFSVEGVTSISTDVHKYGLAPKGTSTVLYRNHEIRKHQFVAVTEWTGGLYVSPTMAGSRPGGLIAGAWAAMMSLGLNGYLESTGQIMEVSKKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 281 - protein, 475 aa, Triticum aestivum
MNTTEGKPGAAAVEEMAREAAAWCAMHGLVVGDRADPRSGTVPGVGLVHAPISLLPSRLPESFWSQACELAPLFNELVDRVSLDGDFLQDSLSKTRQVDDFTSRLLDIHRKMMDANKEENIRLGLHRSDYMLDSETNSLLQIELNTISVSFPGLCSIVTELHRTLINQYGNLLCLDAKRVPGNDASRQFAKALAKAWDEFNVDSAVVMMIVQPEERNMYDQYWIVKYLRESHGVTTIRKTLSEVEAEGQVLPDGTLVVNDRKVAVVYFRAGYTPNDYPSEAEWSARLLMEQSSAVKCPSISYHLVGTKKIQQELAKPNVLERFLENKEEIAKLRQCFAGLWSLDDEEVVKSAIENPDLFVLKPQREGGGNNIYGLDVREALIRLKKEGGDALSAYILMQRIFPKASLASLVRGGVCHEALTVSELGMYGAYLRNKDKVIINDKCGYLMRTKVSSSDEGGVAAGFAVLDSLYLTDK

SEQ ID NO: 282 - protein, 457 aa, Brassica juncea
  Sequence also found in Organisms: Brassica rapa
MSVSTHCFTSPCHDRTRFFSGDDGNKLLRKRIKGTFLVKILPSSQNAYLRVTAKSSRPLSGFRSGISKGVFDIVALTSKNALKELSTPLMLKLVGVVACAFLIVPSADAVDALKTCACLLKGCRIELAKCIANPSCAANVACLQTCNNRPDETECQIKCGDLFENSVVDEFNECAVSRKKCVPRKSDLGEFPAPDPSVLVKNFNVKDFDGKWYITSGLNPTFDAFDCQLHEFHTEDGKLVGNISWRIKTPDSGFFTRSTVQKFVQDPNQPAVFYNHDNEYLHYQDDWYILSSKIENKPEDYIFVYYRGRNDAWDGYGGAVVYTRSASLPNTIVPELEKAAKSIGREFSTFIKTDNTCGPEPPLVERLEKTVEEGEKIIVKEVEEIEEEVEKEVEKVGKTEMTLFQRLAEGFEELKQDEENFLRGLSKEEMELLDELKMEANEVEKLFGKALPIRKFR

SEQ ID NO: 283 - protein, 297 aa, Phaseolus vulgaris
MHAKTDSEVTSLAASSPTRSPPRRPLYYVQSPSRDSHDGEKTATTSFHSTPVLSPVASPPHSRHSSSTRFSKKDHSHNLKPWKQIDIIEEEGLLRGDDRRNGLPRRCYFLAFVVGFLLLFSLFSLILWGASRPMKPKISVKSIKFDDVRVQAGSDPTGVATDMITMNSTLKFTYRNTGTFFGVHVTATPVELSYSDIVIASGNMKKFYQSRRSQRLVSVAVMGNRIPLYGSGASLSSTTGMPTVPVPLNLKFVLRSRAYVLGKLVKPKYYKTIQCSITLDPKKLSSPVSLKKSCRHD

SEQ ID NO: 284 - protein, 192 aa, Phaseolus vulgaris
MEQTIWGHLPVLMRANSKESIEYILQALWRTRKSGLATSDRCIIQDMLQLHNESDLDPLLVCLRMLIRRCVYENTSKEDIPMLFPGEVLPELQKLLTLLLQKFQREWQEDVMKDQNIVPRLKAMTWNMANLEKGSADPAAVIDLKLQNDTPFHSGVQDVKFQLATDSMDMMLKAMHCIRDQFSTMDEAVNGH

SEQ ID NO: 285 - protein, 475 aa, Medicago truncatula
MYKVAKASQYLVITGIGIKDIKLAKKAWILPGQSYSVFDLSPVNYTFEVQAMSAEKLPFVLPAVFTIGPRVDDKESLLKYAKLISPHDKLSNHVKELVQGIIEGETRVLAASMTMEEVFRGTKEFKQEVFGKVQLELNQFGLLIYNANVKQLVDVPGHEYFSYLGQKTQMEAANQARVDVSEAKMKGEIGSKLREGQTLQNAAKIDAETKVIALQRTGEGDKEGIKVRTEVKVFENQREAEVAEANSELAKKKAAWTKAAQVAEVEAAKAVALRDAELQGEVERMNALTTTEKLKAEFLSKASVQYETKVQEANWELYKKQKEAEAILYEKKAEAEAQKALADATFYARTQAAEAELYAKKKEAEGIVTLGNAQGVYLSALLNALGNNYTAVRDFLMINGGMFQEIAKINAEAVRGLEPKISIWTNGGDNSGGEGAIKEVAGVYKMLPPLFKTVHEQTGMLPPAWMGVLPDKNLN

SEQ ID NO: 286 - protein, 343 aa, Zea mays
MARHAKTDSDVTSLAASTPPRSPRGRPAYYVLSPAASHPDVHLGASGGVAGTTPAESPLHYHFHHHRHHSSGGAGVGVGGTHHSRESSTGRLLFSDQLRSGGDVAAVVSVPWRRLGNGSGAGSVGDEDDDGASLRGGSFAESPWRCYALGAVAFVAVFAFFLIVLWGASRSYKPHVVVKSVVFESYHIQGGTDRTGVPTKMMSVNATVRLRFRNRGTFFSLHVTATPFLLFYGDLTVASGEMAEFYQPRKSGRTVTVSVVGKQVPLYGAGASLHSKPNNGRLGPAVVPVRLGFVLRARAHILGLLVKSKFYRRVRCGLDIREAHLGRPARGVASGCEYHDGMR

SEQ ID NO: 287 - protein, 623 aa, Zea mays
MRSGRGKMATPPPPIRPAAALLLLVLAGVLASAASADLVISKADRRVDLTSHIVRVLASLKAENVGPDPVSQVLLPFPNIQAKNLAAIRAFGSEGKVKGQSTVLPIEVVQPSGAPPELTFFSALLPKPLEKGKTLYLDVLTVFTHSLQPFPEEITQAEAQLVVYQDSAHYLSPYPVKAQTLAIRLPGGRVESYTRHPNAKLVDSELKYGPFHDLPPFSYLPVIVHFENNNPFAVAKEVIREIEISHWGNVQITEHYNIAHGGARLKGEFSRIDYQSRPYVRGVSSFRHLIAKLPPRAHSIYYRDEIGNISTSHLWSDSMKTQLEIEPRFPLFGGWQTTFTVGYGLPLEDFVFYSDGKRFLNITFGSPLEEILIEKLIVKVVLPEGSKDIEVSAPFPTQQQQEVKYSHLDIVGRPVVVLEKPDVIPEHNLYFQVYYRFNNISLLREPLMLITGFFLLFVACIVYMRTDMSISKSSPSYLAKLQWDEVQATVQKIQGIFEQCLAVHDKLEASLRDLSRTGDIQSCKAARKAADTQFKELSKDLKPLLATLQSSPQSYQIWPKVEDLIVKERDMQEKLMTRHSTVVDSFEKKLRGQDVENRIALQQQKIAALRQEVESLLEYISEI

SEQ ID NO: 288 - protein, 481 aa, Zea mays
MGSTGREPEVTRANFPDGFVFGVATSAYQIEGARREGGKGDNIWDVFTDDKERVLDRSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQSGEVGLVVDCEWAEPFSEKLEDQIAAQRRIDFQLGWYLDPIYFGDYPESMRQRLGSDLPTFSEKDKKFIKNKIDFIGLNHYTSRLIAHHQNPDDVYFYKVQQMERVEKWSSGESIGERAASEWLVIVPWGLHKLLNYIVKKYNSPVIYVTENGMDDEDDQSATIDQVLNDTKRVGYFNGYLNSVAQAIKDGADVRGYFAWSFLDNFEWAMGYTKRFGIVYVDYKDGLSRHPKASALWFSRLLKGEAAENSYS

SEQ ID NO: 289 - protein, 693 aa, Oryza sativa
MAKKGAPRRQPPPPPPRQLAAGKKGKASPKAAKRAAPKKQRLLESSSDDSELEQQQGQLQEVESGSDLDVPSDSGAEELSDSDDASFEGGDSGDEEEEEDDEDGDDDPLADDFLAGSDDESDGGDDSGVDSDESDDLEAKSRAIDEEKEKAEEEAEEELKLNIRSESDEFRLPTKEELEEEALRPPNLPNLKRRISEIVRVLSNFSKLRQKDVPRKDYVNQLKTDIMSYYGYNDFLVEAFIEMFPAVELVELLESFEKRPPECLRTNTLKTRRRDLAAALIPRGFNLDPIGKWSKVGLVVYDSTISAGATVEYMAGHYMKQGASSFLPVMALAPQEKERIVDMAAAPGGKTTYIGALMKNTGIIYANEFNEKRLHGLLGNIHRMGVTNTIVCNYDGKELPKVLGMNSVDRVLLDAPCTGTGTIWKDPQIKTSKGIEDIRDCAFVQKQLLLAAIDLVDANSKTGGYIVYSTCSLMIPENEAVVDYALKKRNVKLVPCGLDFGRPGFIRFREHRFHTSLDKTRRFYPHVNNMDGFFVAKLKKLSNTIPVASESSNVPEEAIEKADPSSDDPQKQPIQSKKHKDVKTTNEETSILDGVTKDKRQTHETLKNHKKGKKRNGPESTKIKGDQKETHNEEEPTSEKKQPVSAKIKKSVPKRISGNKGKKLDTGKGEKRKRNWMVRRDWEAYKKSRSKQV

SEQ ID NO: 290 - protein, 576 aa, Sorghum bicolor
MAASLLPPAATLVKKYPALLHPSGAKPHAQRLIFRCGATSADDGWASLVDELKRSLQQADTSDTVTSNAGAGVTPNDLVTALPLEPSTTTGPAVGDATSAAAGAVNELLGVDAASSDGGGAAAIPDGLLSALLHLDASSNPVARAAGGALSGLDALTSGLSDAQRWALFGFLAATWLYLTARPGVLSGAVDTYVLAPLQLALDSVLGRRSLKMSDFVVGERIGEGSFGVVYAGAVVPKDGTVVEERSGRARTTLQNDDRYKEKVILKKIKMLTVGAKECGDYEEWFNYRVARAAPESCADFLGSFVADKNKAEFVKGGKWLVWKFEGDRTLANYMSDRGFPSNLERLMFGRVLQGLRTQERDALVVKQVMRQLITSLKRIHATGIVHRDIKPSNLVVTRRGQVKLIDFGAATDLRIGKNYVPDRALLDPDYCPPELYVLPEETPEPPPEPIAAILSPILWQLNSPDLFDMYSAGIVLMQMAIPTLRTQSGLKNFNAELRSAGYDLNRWRQSARRRPDLQILDLDSGRGWDLATKLISERGPNGGGRLSAAAALRHPYFLLGGDQAAAVLSKFSLSK

SEQ ID NO: 291 - protein, 367 aa, Hordeum vulgare
MATISAALSVSILPSLARRAVSTATSSPPRFKRAARFRCCAEPPSPEQQKTSAPPPPPPAPPSSLWGVSTSAWTAGVAGLGLLETGYLSYLKLTGSEAFCPVAGGGCGDVLDSDYSVVFGIPLPLVGMVTYGMVTALSLQENGDELLPGLDDLDIRLTLLLLATSLATASAYFLFILNTKFVGTSCLYCLSSAFISFTLFFIRLKELLQDIGLARIQKFVGLQLAVAVIVALALTNSYSSATTQLKGTGDFVLEPYKTEVTSESTPFAISLARHLHSIGAKMYGAFWCTHCNDQKQLFGREAMEILDYVECFPNGAGKGKKMAEECVATGLEGFPTWVINGKLLSGDQELSVLAEESGFVSESPEQS

SEQ ID NO: 292 - protein, 350 aa, Gossypium hirsutum
MPSSPKFFHARTSPPATPHTRSTLLIFASLLTFAIVSFLFALSSFLSSGGSGYRCRNSDPRSVRVIWDKTGHGNNGLSAAGDDDGTKRHKIMGFVGIQTGFGSTGRRQSLRKTWMPSDRQGLQRLEEATGLAFRFVIGRTNDKSKMAELKKEVAEYDDFLLLDIEEEYSKLPYKTLAFFKAAYALFDSEFYVKADDDIYLRPDRLSLLLVKERSHSQTYLGCMKKGPVFTDPKLKWYEPLSFLLGKEYFLHAYGPIYALSADVVASLVALRNNSFRMFSNEDVTIGAWMLAMNVNHEDNRALCEPECTQSSVAVWDIPKCSGLCNPEKKMLELHQIDACSKSPTLPSDDD

SEQ ID NO: 293 - protein, 248 aa, Zea mays
MSERSESATEKIMSSIMDTIADNLPKQKSGKFDPGSVSDKVKNKLFGRQKTLHGVLGGGKPADVLLWRNKKISSSVLALATAIWVFFEWLDYHFLTIVSFALVLGMVVQFVWSNFSNMLSSGSRSQVPRVELPDELFVNIAVAIGAQVNKFLCFLQDVSCERNLKHFVVAIAGLWAAAVIGSWCNFLTVIYVGFVCVHTLPVLYEKYEDQVDDFLYSLLGLLRDQYQKLDHGVLSKIPKGNMKAKKNE

SEQ ID NO: 294 - protein, 748 aa, Oryza sativa
MAKSNNGNGYLGVTEPISLSGPTEKDVVRTQEVEKCLADAGLYESQEEAVSREEVLGKLDQIVKAWIKKATRASGFGDQFVQEANAKIFTFGSYRLGVHGPGADIDTLCVGPRHATRTEYFFQALYDMLVDMPEVTELHPVPDAHVPVLKFKLNGVSIDLLYANLTHVVIPEDLDLSHDSILHNVDEQTVRSLNGCRVTDKILRLVPNILTFRTTLRFMRFWAKRRGVYSNVIGFLGGINWALLVARICQLYPNASPSMLISRFFKVYSKWKWPNPVMLCHIEEGSLGLLVWDPRRNFRDRGHHMPIITPAYPSMNSSYNVSISTRHVMVQEFTRASDICQAIDERKADWDALFEPYPFFESYRNYLKIEITARNEDDLRNWKGWVESRLRTLVLKIERFTREMLLSHPNPRDFIDSSRPLHCFYFMGLWKKQISQAQEAEQYDIRAIVNEFKSNIHAYQHWREGMEIEVSHVKRKDIPSFVFPGGIRPSRPSRTVGKEARAVSRSNISANVQERNVPSMAQPMPYKSSEVNKIPSDPHGGYQSQERNNAVVSSLPCEETGHMFNGYANLHTESVELEHLRSYKGSTSVPENHVVHDLVKPPESMPPNSIHVYPSPTNGLGHLLDSSCKKPADIIVNKTTNFSSAVLAVPDELDELDSHQVKVNQKDLTAVDQGLSLEHKVGSNGGKAGTTGSPDNNHLKRKAEEELEPLELAAPLVRPPAPTSMTQRRPLRLRLSTVVQPKPAEGTS

SEQ ID NO: 295 - protein, 567 aa, Sorghum bicolor
MGAAAAGPAAAPPATTHCRCIQLLLLALAVVPLGSRGLRVRAVGADTGGLSRDAFPKGFIFGTATSAFQVEGAATSGGRGPCIWDPFVHTPGKIAEDGNADVTTDEYHRYKEDVDLMKSLNFDAYRFSISWSRIFPDGEGKVNEEGVQYYNDLIDYMIKQGLTPYANLNHYDLPLALQKKYQGWLGPKIVDIFADYADFCFKTFGDRVKNWFTLNEPRIVSFLGYDKGIDPPNRCTQCTAGGNSSTEPYIVVHNILLSHATAVARYRNKYQATQKGKVGIVLDFNWYEPLTNSTEDQAAAQRARDFHIGWFLDPLINGQYPKTMQDIVKDRLPSFTPEQAKLVKGSSDYFGINQYTTNYISNQQTTQQGPPSYSSDWGVQYNFERNGVQIGQLAHSVWLYIVPTGMYGVVTYLKEKYQNPTIIISENGMDQPGDLTREEYLHDTVRIDFYKNYLTELKKGIDDGANVVGYFAWSLLDNFEWLSGYTSKFGIVYVDFTTLKRYPKDSAYWFRDMLSGTGSKAAAAPQTGSGTRPAVSASATSNGAALLVSLFVSLCVLLPSVFMVSSV

SEQ ID NO: 296 - protein, 373 aa, Solanum lycopersicum
MGRVRLSVKRLESHSNRQSTYCKRRCGILKKAQEISVLCDIDIILLLFSPTGKPTLFQGGQSNFDEIIAKFAQLTPQERAKRKLESLEVSLIFITTMCSPLAMLCCYFIIQVKVITMLMVTLQTLRKTFKKLDNDIGVPEFLDASDPSVEELHSQVKLLQSRLTDVEMRLNWWSNPDNINKVEDFALMECALRESLNAVHVRKLQKTTHLHLLMNSELDGNTHQWHPENKILRMPFPQTPNILPQENMGYFGDNSVAESSHVQGSGEVDQARQDTTAMLDNGVLNDLTSIACLRQQLSEQYSYNPNEDLDLLERNMLDPQSDANLKGYLMDYAFQRNFNLTRSVDSVNYSAVDAVAVPDFDEKSYAQPATSSD

SEQ ID NO: 297 - protein, 345 aa, Triticum aestivum
MASFNAAGAGAANPNPNKSLEVNPPPGDSVSSLSFSPKANHLIATSWDNQVRCWEVQPGGQCQAKASISHDQPVLCSAWKDDGTTVFSGGCDKVVKMWPLLSGGQATAFSGHEAPVKELAWIPQMSLLVSGSWDKTLRYWDIRQPNPAHVQQLPERCYALSLSYPLMAVGTADRNVVIFNLQNPQAEFKRIVSPLKFQTRCIAAFPDQQGFLVGSIEGRVGVHHVDDSNQSKNFTFKCHREGSDIFSVNSLNFHPVHHTFATAGSDGGFNFWDKDSKQRLKAFSKCPSPITCSTFNQDGSIFAYAVCYDWSKGAEKHNPSTAKTNIFLHSVQESDVKGKPRTGKK

SEQ ID NO: 298 - DNA, 2506 bp, Secale cereale
cccgccggcgtctccgcgtcccccttcgtcccgctcttccccgacgccgccgaccgctccctcccctccaggtcgacttctacaaggttctcggcgcggagccgcatttcctcggcgacggcgtcaggcgggccttcgaggcgcgggccgccaagccaccgcagtacggctacaacacagacacccttgtcggccgccggcaaatactgcagattgcacatgacactctcacaaaccagagctcccgcaccgagtatgaccgcgcgctctccgaggaccgtgacgcggcgctcacgttggatgttgcctgggacaaggttcctggcgtgctgtgtgcccttcaggaggctggggaggcacaggcagtgctcgcaattggagagcacttgctggaggaccgcccgcccaagcggttcaagcaggatgtggtgctggcaatggctctggcttatgtcgatctatcaagggacgcaatggcggctagccctccagacgtaatccgctgctgtgaggtgcttgaaagggctctcaagctcttgcaggaggatggggcaatcaatctcgcacctgatctgctttcacaaattgatgaaactctggaggagatcacacctcgttgtgttttggagcttcttgcccttcctcttgatgaaaaacaccacaatagacgccaagaaggtcttcgtggtgtgagaaacattttgtggagtgttggtagaggaggtattgctactgttggaggaggattttcgcgtgaagcctacatgaatgaggcctttctgcagatgacatcagcggagcagatggatttcttttcaaaaacaccgaatagcataccgcctgaatggtttgaaatctacagcgtggcactcgcaaatgttgctcaagcaattgtaagtaaaaggccagagctcatcatggtggcagatgatctttttgaacagctccagaagttcaatataggttctcaatatgcttatgataacgagatggatcttgcattggaaagggcactttgttcattgcttgtgggagacattagcaactgcagaaattggcttgcgattgataatgaatcctcaccacatagagaccccaaaattgtagagtttattgtgaacaactctagcatcgaccaccaggagaatgatcttcttccaggcctctgtaagcttttggagacttggcttgtctcagaggttttccctaggagcagagatactcgaggcatgcagtttacacttggagactactacgatgatccaaaagttttaagctacctagaaatgatggaaggtggcggtgcttctcatttggctgctgctgctgctattgcaaaactcggtgctcaagctacagctgcgcttggtagcgtgaaatcaagtgctgtccaagcattcaacaagatttttccattgatagatcgaacagccatggagaatcctaatgatggccttgaggaatctgtcaacaaatttgaccagaaaaacattatgggatttgatatccttgattccaaaaacgctgccctgaagattgtatctgctactgcattatttgctctgttgacagtaataggcctcaagtacttgcctcgtaagagggtgctccctgctatcagaagcgagcatgagtcagcggcggttgctaatgttgttgactcagttgatgatgatgcagtggatgagccaatacagattcctagaatggatgcgaagctggcagaggatattgttcgcaagtggcagagcatcaaatccaaggccttgggatcagatcattcggtggaatcattgcaagaggttctcgacggcaacatgctgaaggtatggacggaccgagcagcggagatcgagcgcaaaggctggttctgggactacacgctgtcggacgtggcggtcgacagcatcaccgtctccctggacgggcggcgggcgaccgtggaggcgacgatcgaggaggcgggccagctcaccgacgcaaccgaccccaggaacaacgatttgtacgacaccgagtacaccgcccggtacgagatggccttcaccggagcaggagggtggaagataaccgaaggcgcggtcctcaagtcgtcgtagggggcgtccggtgcgcagtaaaccgtgtcgattgattcctccctgtgttctttctggtgtgtaaataagcagtctaggcccttttcagtttggaagttggagatagtttggttagtctggcgtgtgatcagcgatgagctttgtttttccctgtgctgtattcggattattgctaggctagaagagatccttgggttggggataagagaaaacatgtcgtcatccgtggtccgtggcgcgcaattccccagtttgttttcctagcactacatatggagtaaaatgaatgaatctatgttctaaaaaaataaaaaaaaaaaaaaaaaacaaaaaaaaaaaaaaacaaaaaaaaaaaacaacaagaactagacaagacacaacgaaggaagtaagaccacccccccccc

SEQ ID NO: 299 - DNA, 2131 bp, Lolium multiflorum
ggcccccgcctccgcgtcccccttcgtcccgctcttccccgacgccgccgaccgatctctccccctccaagtcgacttctacaaggtcctgggcgcagagccccatttcctgggcgacggcgtcaggagggcgttcgaggcgcggacagccaagccgccgcagtacggttacagcacggacacgctcgtcggtcgccggcagatactgcagatcgcccacgacactctcacggaccagagctcccgcacggagtacgaccgcgcgctttccgagaaccgcgatgcggcgcttacgttggatgttgcttgggacaaggttccgggcgtgctgtgtgccctccaggaggctggggaggcacaggcggtgctcgcgatcggagagcagttgctggaggaccgcccgcccaaacggttcaagcaggatgtggtgctagcaatggctctggcttatgtggacctatcgagggattcgatggcggcaagccctccagatgtgattttctgctgtgaggtgcttgaaagggccctcaagctcttgcaggaggatggggcaagcaatctcgcacctgatctgctgtcacagattgatgaaactttggaggagatcacacctcgttgtgttttggagcttcttgcccttcctcttgatgaaaaacatcggaataaacgccaagaaggtcttcgaggtgtgagaaacattttatggagtgttggtagaggaggtattgctactgttggaggaggattttctcgtgaagcttacatgaatgaggcctttttgcagatgacgtcggctgagcagatggatttcttttcaaaaactccgaatagcataccacctgagtggttcgaaatctacagtgtggcactcgcaaatgttgctcaagcaattgtaagtaaaaggccagagctcatcatgatggcagatgatcttttcgaacagctccagaagttcaatataggttctcaatatgcttatgataacgagatggatcttgcattggaaagggcactctgctcattgcttgtgggagatattaccaactgcagaatttggcttgcaattgataatgaatcctcaccacatagagaccccaaaattgtagagtttattgtgaacaactctagcatcgaccaagagaatgatcttcttccagggctgtgtaagcttttggagacttggcttgtctcagaggttttccctaggagcagagatactcgaggtatgcagttcagacttggagactactatgatgacccaaaagttttaagctacctagaaatgatggaaggtggtggtgcttctcatttggctgctgctgccgctatagcaaaactcggagctcaagctacagctgctcttggtaccgtcaaatcaagtgctctccaagcattcagcaagatttttccattgatagaacagctagatctttcagccatggaaaatcctgacaatggtcttgagggttctcttcagaaatttgatctgaaaaaagttatgggatttgacatacatgattccaaaaatgcggccttgaagattgtctctgctggtgcattgtctggtctgctggcagtaataggcctcaagtacatgcctcgtaagagggtgctccctgctatcaggagcgagcacgaggccgtagcagttactaatgttgttgactcagttgatgatgatgcattcgacgagtcaatacagattcctagaatggatgcaaagttggcagaagatattgtgcgcaagtggcagagtatcaaatccaaggccttgggatcggatcattctgttgcgtcattgcaagaggttcttgacggcaacatgctaaaggtatggacggaccgagccgcagagatcgagcagcatggctggttctgggactacacgctgtccgacgtgacgatcgacagcatcaccatctccctggacggacgacgggcgagcgtggaggcaacaatcgaggaggcaggccggctcactgacataaccgactcaaagaacaacgattcgtacgacaccaagtacaccacccggtatgagatggccttcaccaaatcaggagggtggaagataacagaaggcgcggtcctcaagtcttagaacattcggtgtgcagcaaccttcctaatt

SEQ ID NO: 300 - DNA, 2670 bp, Brachypodium distachyon
cccctctgcttcctcgccttgtaaacccctcctctccccgcggcctcctccgcctctgccgccgccgccggcaaaatggagggcttccacaacctgctcgcccgccccaacaccgcgcctctcgccttctccctcccgcgcccgcgccgccggcccgctgaagccgtcatcgtctgccgcgccgcgagccggtgggccgaccgcctcttcgccgacttccacctcctcccgtccgccacccccgccgcgaccgacccgccggccgcggcccctgccggcgcatccacggcccccttcgtcccgctcttccccgacgccgccgaccgatctctccctctccaagtcgacttctacaaggttctcggtgcagagccacatttcctcggtgatggcgtcaagagggcattcgaggcacgggtagccaagccactgcagttcggctacagcacggatgctcttatcagccgtcggcaaatgctgcagattgcccatgatactctcacaaaccagagctcccgcactgagtacgaccgtgcactttctgagaaccgtgacgcggccctcacattggatgttgcttgggacaaggttcctggtgtgctctgcgcccttcaggaggctggggaggcgcaggcagtgctcgcaattggagagcagttactggaggaccgaccacccaagcggttcaagcaggatgtggttctagctatggctttggcttatgtggacgtatcaagggatgcaatggcgacaagccctccagatgtaattcgctgctgtgaggtgcttgaaagggctctcaagctcttgcaggaggatggggcgagcaatcttgcacctgatctgctgtcacagattgatgaaactttggaggagatcacacctcgttgtgttttggagcttcttgccctccctcttgatgaaaaacatcagagcaaacgccaagaaggtcttcgaggtgtgagaaacattttgtggagtgttggtagaggaggtatttctaccgttggaggaggattttctcgtgaagcctacatgaatgaggcttttttgcagatgacatctgctgagcagatggatttcttttcaaaaacaccgaatagcataccacctgaatggtttgaaatctatagtgtggcgctggcaaatgttgctcaagcaattgtaagtaaaaggccagaactcatcatgatggcagatgatcttttcgaacaactgcagaagttcaatataggttctcaatatgcttatgataatgagatggatcttgcattggaaagggcactttgttcattgcttgtgggagatattagtaactgcagaatttggcttgggattgacaatgaatcctcgccgcatagagaccctaaaattgtagagtttatcgtgaacaactctagcattgaccaagagaatgatcttcttccagggttgtgtaagcttttggagacttggcttgtctcagaggttttccctaggagcagagatactcggggtatgcagtttagacttggagactactatgatgacccaaaagttctaagctaccttgaaatgatggaaggtggtggggcttctcatctggcggctgctgccgctatagcaaaacttggtgctcaagctacagctgctcttggtaccgtgaaatcaagtgctctccaagcattcagcaaggtttttccactgatagaacggctagacctgtcagccatggaaaatcctgacgatggtcttgagcaatctcttgaggaaaatggtgctggatatgacatctatggttccaagaatgcggctttgaagattgtctctgctagtgcattctttgcgctgttgacagtaataggcctgaagtacatgccacgtaagagggtgctccctgctatgaggagcgagcatgagtccgtggcagtcgctgatgttgtcaattcagttgatgaccatgcattggatgagtcaatacagattcctagaatggatgcgaagttggcagaagatattgtccgcaagtggcagagtataaaatccaaggccttggggtcagatcattctgttgcatcattgcaagaggttctcgatggcaacatgctaaaggtatggaccgaccgagcagcggagattgagcgcaacggctggttctgggactacaaactgtccgacgtgacgatcgacagcatcaccgtctccatggacggtcgacgtgcaaccgtggaggctacgatcgaggaggcaggccagctcaccgatgtaaccaaccccaagaacaacgactcgtacgacaccaagtacaccacacggtacgagatgaccttcgccaaatccggagggtggaagataaccgaaggcgcggtcctcaagtcgtagaagagtcgacgtgcaggcagcaccttaattccttctggattttcgaagtgtaaataagcagtgtaggctcttttagggcagagtttgtctaggctgatcagcgtgaatttgttttcctggtgttgtattgtcactactactattgctgctagttctaggctagatccttgaagataaaagagaaacatagtgctagatttgcagatcagatcaatttttttttgttgttgtcttctttgtgcttgacattttctttcttaactcgaaggcacactatcatcctgtgtgaaggtatgaatttcgctgttt

SEQ ID NO: 301 - DNA, 2669 bp, Brachypodium distachyon
gcttcctcgccttgtaaacccctcctctccccgcggcctcctccgcctctgccgccgccgccggcaaaatggagggcttccacaacctgctcgcccgccccaacaccgcgcctctcgccttctccctcccgcgcccgcgccgccggcccgctgaagccgtcatcgtctgccgcgccgcgagccggtgggccgaccgcctcttcgccgacttccacctcctcccgtccgccacccccgccgcgaccgacccgccggccgcggcccctgccggcgcatccacggcccccttcgtcccgctcttccccgacgccgccgaccgatctctccctctccaagtcgacttctacaaggttctcggtgcagagccacatttcctcggtgatggcgtcaagagggcattcgaggcacgggtagccaagccactgcagttcggctacagcacggatgctcttatcagccgtcggcaaatgctgcagattgcccatgatactctcacaaaccagagctcccgcactgagtacgaccgtgcactttctgagaaccgtgacgcggccctcacattggatgttgcttgggacaaggttcctggtgtgctctgcgcccttcaggaggctggggaggcgcaggcagtgctcgcaattggagagcagttactggaggaccgaccacccaagcggttcaagcaggatgtggttctagctatggctttggcttatgtggacgtatcaagggatgcaatggcgacaagccctccagatgtaattcgctgctgtgaggtgcttgaaagggctctcaagctcttgcaggaggatggggcgagcaatcttgcacctgatctgctgtcacagattgatgaaactttggaggagatcacacctcgttgtgttttggagcttcttgccctccctcttgatgaaaaacatcagagcaaacgccaagaaggtcttcgaggtgtgagaaacattttgtggagtgttggtagaggaggtatttctaccgttggaggaggattttctcgtgaagcctacatgaatgaggcttttttgcagatgacatctgctgagcagatggatttcttttcaaaaacaccgaatagcataccacctgaatggtttgaaatctatagtgtggcgctggcaaatgttgctcaagcaattgtaagtaaaaggccagaactcatcatgatggcagatgatcttttcgaacaactgcagaagttcaatataggttctcaatatgcttatgataatgagatggatcttgcattggaaagggcactttgttcattgcttgtgggagatattagtaactgcagaatttggcttgggattgacaatgaatcctcgccgcatagagaccctaaaattgtagagtttatcgtgaacaactctagcattgaccaagagaatgatcttcttccagggttgtgtaagcttttggagacttggcttgtctcagaggttttccctaggagcagagatactcggggtatgcagtttagacttggagactactatgatgacccaaaagttctaagctaccttgaaatgatggaaggtggtggggcttctcatctggcggctgctgccgctatagcaaaacttggtgctcaagctacagctgctcttggtaccgtgaaatcaagtgctctccaagcattcagcaaggtttttccactgatagaacggctagacctgtcagccatggaaaatcctgacgatggtcttgagcaatctcttgaggaaaatggtgctggatatgacatctatggttccaagaatgcggctttgaagattgtctctgctagtgcattctttgcgctgttgacagtaataggcctgaagtacatgccacgtaagagggtgctccctgctatgaggagcgagcatgagtccgtggcagtcgctgatgttgtcaattcagttgatgaccatgcattggatgagtcaatacagattcctagaatggatgcgaagttggcagaagatattgtccgcaagtggcagagtataaaatccaaggccttggggtcagatcattctgttgcatcattgcaagaggttctcgatggcaacatgctaaaggtatggaccgaccgagcagcggagattgagcgcaacggctggttctgggactacaaactgtccgacgtgacgatcgacagcatcaccgtctccatggacggtcgacgtgcaaccgtggaggctacgatcgaggaggcaggccagctcaccgatgtaaccaaccccaagaacaacgactcgtacgacaccaagtacaccacacggtacgagatgaccttcgccaaatccggagggtggaagataaccgaaggcgcggtcctcaagtcgtagaagagtcgacgtgcaggcagcaccttaattccttctggattttcgaagtgtaaataagcagtgtaggctcttttagggcagagtttgtctaggctgatcagcgtgaatttgttttcctggtgttgtattgtcactactactattgctgctagttctaggctagatccttgaagataaaagagaaacatagtgctagatttgcagatcagatcaatttttttttgttgttgtcttctttgtgcttgacattttctttcttaactcgaaggcacactatcatcctgtgtgaaggtatgaatttcgctgtttctggat

SEQ ID NO: 302 - DNA, 2657 bp, Sorghum bicolor
acgacccagtatctcgtgtgcaactgtgcataaccctcgctcacaatctcgccgcccccgccggccgccggcaatggagggcgtccacagcctcctggcccggcccaactccgcgccgttcgccttctcccagccgcccctccgcaggcaccacaggccgccaccgcctggcccctccgcctgccgcgccgccagccgctgggccgaccgcctcttcgccgacttccacctcctccctaccgccaccgccgccgccgacccgccggccgcggccccctcctcgtccccgttcgtcccgctcttccccgacgccgccgaccgcgccttgcccctcccggtcgacttctacaagattctcggtgtggagccacatttcctaggcgatggcattcggagggcatttgagtcgcggatagccaagccacctcagtacggctacagcacggaagctctcgttgggcgtcggcagatgctgcagattgcgcatgatactctcacaaaccagagctcccgtactgagtacgaccgtgcgctttctgaggatcgtgatgcggcactcaccatggatgttgcctgggataaggtaccaggtgtgctgtgtgtgcttcaggaggctggggaggcacaactggtgttagcaactggagagcagctgcttcaggaccgtccacctaagcggttcaagcaggatttggtgctagcaatggcattggcttatgtggacctatcaagggacgctatggcagcaagccctccagatgtaatctgttgttgtgaggtgctcgagagggcacttaagctcctgcaggaggatggtgcaagcaatcttgcacctgaactgcttgcacagattgatgaaactttggaggagattacacctcgctgtgtattggagcttcttgctcttcctactgatgaaaaacataaaaataaacgccaagaaggtctgcaaggtgcaagaaacatattgtggagtgttggccaaggtggtatcgctactgttggaggaggattttctcgtgaggccttcatgaatgaggcttttttgcagatgacatcagccgagcagatggatttcttctctaaaacaccgaatagcataccacctgaatggtttgaaatctatagtgtggcacttgcccatattgctcaagcaattgcaagtaaaaggccacaattcatcatgatggcagatgacctctttgaacaacttcagaagttcaatataggttctcaatatccttatgaaaatgagatgaaccttgcattagaacgggcactctgctcgttactggtgggagatatcagcaactgcagaatgtggcttggaattgataatgagtcctcgccatatagggaccccaaaattattgagtttgtggtgaataactctagtatcgatgaagagaatgatcttcttccagggctgtgcaagcttttggagacttggcttgtctccgaggtattcccaaggagcagagatactcgagggatgcagttcagactgggagactattatgacgacccaaaagttttaagctacttagaaaggatggaaggtggtggagcttctcatttggccgcagctgctgctatagcgaaacttggtgcccaagctactgccgcgcttggtacggtaaaatcaagtgctcttcaagctttcagcaaggttttcccattgatagaacagctagacagatcaggcaaggataccccaggtgatgatcttgagaaatctcttgaaaaacttgcccaagaaagtgttgctggagatgctatccatgattccaaaaatgccgctttgaagattatctctgctggtgcactgtttgcactatttgcagtaataggtctgaagtgcttgcctcgtaagaagtcacttcctgctcttaagagcgaatatgggtctgtggcagttgctgactctgttgatggtctgggagcagatgaagagccactagaaattcctagaatggatgcaaagttggctgaagatattgttcgcaagtggcaaagtatcaagtccaaggctttggggccagaacacactgtcacggcattgcaagagatcctcgatggcaacatgctgaaggtatggatggaccgagccacagagattgagcgtcacggttggttctgggaatacacactctccgacgtgacgatcgacagtatcaccgtctccatggacggtcgacgggcaactgtggaggcgacgattgaggagatgggccaacttaccgacgtagcagacccaaagaacaacgacgcctacgacacaaagtacaccgctcggtacgagatgagctactccaagtccggagggtggaggatcaccgaaggagcagtcctcaagtcgtagaacggtcgtgcagcaggagtaggcgagtaggggttgctcaactcccattcttttttcttttgcaccagtgtatgtaaataaacagtgtgagcacaggttcttttctctcctggagagagtttggttacgttgattagtgatgagttcctgaggccgagagaatttgtcatctagtttgtattgatagagataatttggtgttactattactaggtcagatttttcttctgaaacaaacaatagatcctaacgaaggctgcagtgcatcattgcttaccacatcactgcatcagac

SEQ ID NO: 303 - DNA, 2796 bp, Setaria italica
ctccgccacaaccccaaaaaccctcgcccacgagctcgccgcctccgcccccgcgcccccgccggcaatggagggggtccacagcctcctggcccggcccaactcggcgccgttcgccttctccctcccgccggccgtgccccggagccccaggccgccgcccgcccccttcgcctgccgcgccgccagccgctgggccgaccgcctcttcgccgacttccacctcctccccaccgccgccgccgccgacccgccggccgcggcctcctcctcgtcgtccccgttcgtaccggtcttccccgacgccgccgaccgcgccttgcccctcccagttgacttctacaagattctcggagcggagccacattttcttggtgatggcattaggagggcctttgaggcgcggatagccaagccaccacagtatggctacagcacagaagctcttgttgggcgtcggcaaatgctgcagcttgcccatgatactctcacaaaccagagctcccgaactgagtacgatcgcgcactttccgaggatcgtgatgcaacactcaccatggatgttgcctgggataaggttccaggtgtgctttgtgtacttcaggaggctggggaggcaccgctagtgcttgcaactggagagcagttgcttcaggaccgtccacctaagcgtttcaagcaggatgtggtcctagcaatggcattggcttatgtggacctatcaagggacgcaatggctgcaagccctccagatgtaatccactgctgtgaggtgctcgagagggcactcaagctcctgcaggaggatggtgcaagcaatctcgcacctgatctgctttcacaaattgatgaaactttggaagagattacacctcgctgtgtgctggagctacttgctcttcctattgatgaaaaacataaaaataaacgccaagaaggtctgcaaggtgcaagaaacatattgtggagtgttggcagaggtggtatcgctactgttggaggaggattttctcgtgaggcattcatgaatgaggcctttttgcggatgacatcagctgagcagatggatttcttctctaaaacaccaaatagcataccacctgaatggtttgaaatctatagtgtggcccttgcacatattgctcaagcaattgcaagtaaaaggccacaattcatcatgatggcagatgatcttttcgaacaacttcagaagttcaatataggctctcaatatccttatgaaaatgagatggaccttgcattggaacgggcactctgctcattactggtgggagatattagcaattgcagattgtggcttggaattgataacgagtcctcgccatatagagaccccaaaattattgagtttgtggtgaataactctagcatcgatgaagagaatgatcttcttccagggctgtgcaagcttttggagaattggcttgtctctgaggtttttccaaggagcagagatactcgaggcacgcagttcagacttggagactattatgacgacccaaaagttttaagctacctagaaaggatggaaggtggtggggcttctcatttggctgcagctgctgccatagcaaaacttggtgctcaagctacagctgcacttggttcggtaaaatcgagtgctcttcaagcattcagcaaggttttcccattgatggaacaactagacaggtcagacaaggataatccgagtgatgatattgagaaatctcttgaaaaccttgcccaacaaaatgttactggagatgatattcatgattctaaaaatactgctttgaagattatctctgctggtgcactgtttgcactatttgcagtaataggtctgaagtgcttgcctcgtaagaagtcgcttcctgctgttaggagcgagtatgagtctgtggcagttgctgactctgtcagtggtccagcagtagatgaagagccactagaatttcctagaatggatgcaaagttggctgaagatattgttcgcaagtggcagagtatcaagtccaaggctttgggtccagaacactctgttccagcactgcaagaggttcttgatggcaatatgctgaaggtatggagtgaccgagctacagagatcgagcgccatggttggttctgggagtacacgctgtccgacgtgacaatcgacagcgtcactgtctcagtggacggccgacgtgcaacagtggaggtgacaatcgaggaggtgggccaacttaccgacgtggcagactctaagaacaatgattcatacgacacaaagtacaccacgcgctatgagatggcctactcgaaatcaggagggtggatgataaccgaaggagcagtcctcaagtcatagaacggtgtgaagtagcgggtagcggtagcagtagcttaattccccttcagttttgcaatgtaaataaacaggttgagtgcggactctttccagtcctagggagcttgattaggtcctgccgtttgtattgattgaaacaaatggatggcagacttgcagatcagattgtgttagggaaagtgttttgggtcagatcctgtgcaaggaaaaggcagtgcaggatcagatgagatgtactagtgtgaggcatcagtgcatcactgcttaccacatcactacttcagataaggtcactgcttaccacaccagatcatttgcttctgggttgggtatgctcatttcatttcctgcatttgcccgaggtgaatgaaattgtatttgcgaaaataactttaaacaccagactatttttatttatttgattgacattgcaaatacat

SEQ ID NO: 304 - DNA, 2801 bp, Setaria italica
gctttcccctccgccacaaccccaaaaaccctcgcccacgagctcgccgcctccgcccccgcgcccccgccggcaatggagggggtccacagcctcctggcccggcccaactcggcgccgttcgccttctccctcccgccggccgtgccccggagccccaggccgccgcccgcccccttcgcctgccgcgccgccagccgctgggccgaccgcctcttcgccgacttccacctcctccccaccgccgccgccgccgacccgccggccgcggcctcctcctcgtcgtccccgttcgtaccggtcttccccgacgccgccgaccgcgccttgcccctcccagttgacttctacaagattctcggagcggagccacattttcttggtgatggcattaggagggcctttgaggcgcggatagccaagccaccacagtatggctacagcacagaagctcttgttgggcgtcggcaaatgctgcagcttgcccatgatactctcacaaaccagagctcccgaactgagtacgatcgcgcactttccgaggatcgtgatgcaacactcaccatggatgttgcctgggataaggttccaggtgtgctttgtgtacttcaggaggctggggaggcaccgctagtgcttgcaactggagagcagttgcttcaggaccgtccacctaagcgtttcaagcaggatgtggtcctagcaatggcattggcttatgtggacctatcaagggacgcaatggctgcaagccctccagatgtaatccactgctgtgaggtgctcgagagggcactcaagctcctgcaggaggatggtgcaagcaatctcgcacctgatctgctttcacaaattgatgaaactttggaagagattacacctcgctgtgtgctggagctacttgctcttcctattgatgaaaaacataaaaataaacgccaagaaggtctgcaaggtgcaagaaacatattgtggagtgttggcagaggtggtatcgctactgttggaggaggattttctcgtgaggcattcatgaatgaggcctttttgcggatgacatcagctgagcagatggatttcttctctaaaacaccaaatagcataccacctgaatggtttgaaatctatagtgtggcccttgcacatattgctcaagcaattgcaagtaaaaggccacaattcatcatgatggcagatgatcttttcgaacaacttcagaagttcaatataggctctcaatatccttatgaaaatgagatggaccttgcattggaacgggcactctgctcattactggtgggagatattagcaattgcagattgtggcttggaattgataacgagtcctcgccatatagagaccccaaaattattgagtttgtggtgaataactctagcatcgatgaagagaatgatcttcttccagggctgtgcaagcttttggagaattggcttgtctctgaggtttttccaaggagcagagatactcgaggcacgcagttcagacttggagactattatgacgacccaaaagttttaagctacctagaaaggatggaaggtggtggggcttctcatttggctgcagctgctgccatagcaaaacttggtgctcaagctacagctgcacttggttcggtaaaatcgagtgctcttcaagcattcagcaaggttttcccattgatggaacaactagacaggtcagacaaggataatccgagtgatgatattgagaaatctcttgaaaaccttgcccaacaaaatgttactggagatgatattcatgattctaaaaatactgctttgaagattatctctgctggtgcactgtttgcactatttgcagtaataggtctgaagtgcttgcctcgtaagaagtcgcttcctgctgttaggagcgagtatgagtctgtggcagttgctgactctgtcagtggtccagcagtagatgaagagccactagaatttcctagaatggatgcaaagttggctgaagatattgttcgcaagtggcagagtatcaagtccaaggctttgggtccagaacactctgttccagcactgcaagaggttcttgatggcaatatgctgaaggtatggagtgaccgagctacagagatcgagcgccatggttggttctgggagtacacgctgtccgacgtgacaatcgacagcgtcactgtctcagtggacggccgacgtgcaacagtggaggtgacaatcgaggaggtgggccaacttaccgacgtggcagactctaagaacaatgattcatacgacacaaagtacaccacgcgctatgagatggcctactcgaaatcaggagggtggatgataaccgaaggagcagtcctcaagtcatagaacggtgtgaagtagcgggtagcggtagcagtagcttaattccccttcagttttgcaatgtaaataaacaggttgagtgcggactctttccagtcctagggagcttgattaggtcctgccgtttgtattgattgaaacaaatggatggcagacttgcagatcagattgtgttagggaaagtgttttgggtcagatcctgtgcaaggaaaaggcagtgcaggatcagatgagatgtactagtgtgaggcatcagtgcatcactgcttaccacatcactacttcagataaggtcactgcttaccacaccagatcatttgcttctgggttgggtatgctcatttcatttcctgcatttgcccgaggtgaatgaaattgtatttgcgaaaataactttaaacaccagactatttttatttatttgattgacattgcaaata

SEQ ID NO: 305 - DNA, 2727 bp, Panicum virgatum
ccgccagccgctgggccgaccgcctcttcgccgacttccacctcctccccactgccgccgccgccgacccgccggccgcggcctccccctcctcgtccccgttcgtcccgatcttccccgacaccgccgaccgcgccttgcccctccctgtcgacttctacaagattctcggagcggagccacattttcttggtgatggcattaggagggcctttgaggcacggatagccaagccaccacagtatggctacagcacagaagctcttgttgggcgtcggcaaatgctgcagcttgcccatgatactctgacaaaccagagctcccgtactgagtacgatcgttcactttctgaggaccgtgatgcgacactcaccatggatgttgcctgggataaggttccaggggtgctgtgtgtacttcaggaggctggggaggcacagctagttcttgcaacaggagagcagttgcttcaggaccgtccacctaagcggttcaaacaggatgtggtgctagcaatggcactggcttatgtggacctatcaagggacgcgatggctgcaagccctccagatgtaatccactgctgtgaggtgctcgagagggcactcaagcttctgcaggaggatggtgcgagcaatcttgcacccgatctgctttcacagattgatgaaactttggaggaaattacacctcgttgtgtattggagctacttgctcttcctattgatgaaaaacataataataaacgccaagaaggtctgcaaggtgcaagaaacatattgtggagtgttggtagaggcggtattgctactgttggaggaggattttctcgcgaggccttcatgaatgaggcctttttgcggatgacatcagctgagcagatggatttcttctctaaaacaccgaatagcataccaccagaatggtttgaaatctatagtgtggcacttgcaaatattgctcaagcaattgcaagtaaaaggccacaattcatcatgatggcagatgatctttttgaacaacttcagaagttcaatataggttctcaatatccttatgaaaatgagatggacctcgcgttggaacgggcactctgctcgttactggtgggagatattagcaattgcagaatgtggcttggaattgataatgagtcctggccatatagagaccccaaaattattgagtttgtggtgaataactctagcatcgatgaagagaatgatcttcttccagggctgtgcaagcttttggagagttggcttgtctctgaggttttcccaaggagcagagatactcgtgggatgcaattcagacttggtgactattatgatgacccaaaagttttaagctacctagaaaggatggaaggtggtggggcttctcatttggctgcagctgctgctatagcaaaacttggtgctcaagctacagctgtgcttggtacggtaacatcaagtgctcttcaagcattcagcaatgttttcccattgatagaacagctagacagatcagacaaagaaaatcctagcgatgatctggagaaatctcttgaaaagcttgccccacagcatgttactggagatgtcatcaatgattccagaaatgctgctttgaagattatctctgctggtgcattgtttgcactatttgcagtaataggcctaaagtgcttgcctcgtaagaagtcacttcctgctattaggagtgagcatgggtctgtggcagttgctgagtccgttggtggtccagcagcagatgaagaaccactagaaattcctagaatggatgcaaagttggctgaagatattgttcgcaagtggcagagtatcaagtccaaggctttgggtccagaacactctgctgtagtattgcaagaggttcttgacggcaatatgctgaaggtatggactgatcgagctacagagattgcgcgccatggatggttctgggagtacacactgtccgacgtgacaattgacagtgtcactgtctcagtggacggccgacgtgcaacagtggaggcgacgattgaggaggtgggccaacttacagacgtagcagaccctaagaacaatgattcatacgacacaaagtacactacgcgctatgagatggcctactcgaaatcaggagggtggaggataaccgaaggagcagtcctcaagtcatagaacggtgtgctgtagcagtagcagtagctgtagcttaattccctttcagttttgcactgtaaatacaacgggttcttctcagtcctagagagcttgattaggttggtctgtgacgagttccgccggtggaaaaaaattgtcgctaaggcatatgctcttcgtttagtttgtattagttggaggtttgagatagatcctttgaagcaatggacggcagagacttgctgatcagattgtgttagggaaagtgtttttggttggatcctgtaaggaaaaggcagtacaagatgagatgagatcctagtggtaggcgtaagtgccactggcttaccacatcactgcatcagacaaaggtcactgcttaccacatcagatcatttgcctgtggctgtggctccataccattgctgggttttatgctcatttcatttcccagatttgtccgaggagaatgagattgtaaatctccttggaaataagttacatcaaactgtatttattttattccacagatatattcagatggaaatagatagttggaattgaaactgtc

SEQ ID NO: 306 - DNA, 2627 bp, Zea mays
ggcaggtcctgtgcataatccaccatctcgctcacaggctcgccgcccccgccggcaatggagggcgttcacagcctcctggcccggcccaactccgcgccgttcgccttctcaccgctgcccctccgcaggagccacaggccgccaccgcctggcccctccacctgccgcgccgccagccgctgggccgaccgcctcttcgccgacttccacctcctccccgccgccgccgacccgccagccgcggcctcctcttcctcctcgtccccgttcgtcccgatcttccccgaagccgccgaccgcgccttgcccctcccggtcgacttctacaagattcttggtgcggagccacatttcctaggcgatggcattcggagggcgttcgagtcgcggatagctaagccacctcagtatgggtacagcacagaagctcttgttgggcgacggcaaatgctgcagattgcccatgatactctcacaaaccagagctcgcgcaccgagtacgaccgtgcgctttccgaggaccgtgatgcggcgctcaccatggatgttgcctgggataaggttccaggtgtgctgtgtgtgcttcaggaggctggggaggcacaactggtgttagcaactggagagcacttgcttcaggaccgtccacctaagcggttcaagcaggatgtggtgctagcaatggcattggcttatgtggacatatcaagggatgctatggcagcaagccctccagatgtaatctgctgttgtgaggtgcttgagagggcactgaagctcctgcaggaggatggtgcaagcaatcttgcacctgaactgcttgcacagattgatgaaactttggaggagattacacctcgttgtgtattggagcttcttgctcttcctactgatgaaaaacataaaaataaacgccaagaaggtctgcaaggtgcaaaaaacatattgtggagtgttggcaggggtggtattgctactgttggaggaggattttctcgtgaggccttcatgaatgaggctttcttgcagatgacatcagctgagcagatggatttcttctctaaaacaccgaatagcataccacctgaatggtttgagatctatagtgtcgcacttgcccacattgctcaagcaattgcaagtaaaaggccacaattcatcatgatggcagatgaactcttcgaacaacttcagaagttcaatataggttctcaatatccttatgaaaacgagatggacctcgcattagaaagggcactctgctcgttacttgtgggggatatttgcaattgcagaatgtggcttggaattgataatgagtcctcgtcatatagggaccccaaaaatatcgagtttgtggtgaataactctagcatgaacgaagagaatgatcttcttccagggctgtgcaagctcttggagacatggcttgtctccgaggtattcccaaggagcagagatacccgagggacgcagttcagactgggagactattacgacgacccaaaagttctaagctacttagaaaggatggaaggcggtggtgcttcccatttagctgcagctgccgctatagcaaaacttggtgctcaagctactgctgcgcttggtactgtaaaatcaagtgctcttcaagctttcagtaaggttttcccattgacagaacagctagacatgtcaggcaaggatatcccaagtgatgatcttgataaatctcttgaaaaactcgcccaaggaagtgttgctggagacgctatccatgattccagaaatgacgccttgaagattatctctgctggtacactgcttgcactatttgcagtgttaggtctcaagtgcttgcctcgtaacaagtcacttcctgctcttaggggcgagtatgggtctgtggcggttgttgactccattgatggtccagcggcagatgaagagccactggaaatccctaggatggacgcgaagttggctgaagacattgttcgcaggtggcaaagcatcaagtccaaggctttggggccagaacacactgtcacggcattgcaagaggtcctcggcggcaacatgctgaaggtgtgggcggaccgagctgcagagatcgagcgccacggctggttctgggagtacgcgctctctggcgtgacgatcgacagcatcaccgtctccgtggacggccggcgggcagcggtggaggcgacgatcgaggaggtgggccggcttaccgacgtgaccgaccctaagaacgacgacgcgtacgacaccaagtacaccgcccggtacgagatgacctactccaggccagcagggtggaggatcaccgaaggcgcagtcctcaggtcgtaggtagaacggctgtgcttgtgcagctgcagcaggagtaggcgagtagcggtaagctcgattcccattcttttcttttcttttggcagcgtgtgtaaataaacagtgtgagcactggctcgttccagtactagaaagcttggttaggttgctgagtgatgagctcctgaggtcgaaatttgtcatgtagtttttattgatagataatttggtgttactattgctgggtcagatcctctgaaacgattgatcttaatgaaggcggcagtgcatcactgcttaccaca

SEQ ID NO: 307 - DNA, 2007 bp, Triticum aestivum
gttccggctcaccagccagagccaggtgggtaggggtttaggagaagccgcaaacccaacaaaaaacagattccggattctaccacctccggaactgaaaccccactcctcccgtcggcggccaaccacctcaaattctccacctccgtccccaaatctcaagtgcttgctgattcttttgtgaagcgcgcggcggcgatatcttgggatttcggcgcggtccggcctgagtcgctcgtgagctgcaggtccgccttcttccccgccgccgccatcgccgttcccgtcctacaaaccaacctccgaattttctgggtgtgcaccggcacgccaggcacatcatctggatccgcctctgcgtgccattcagctcgctgggatggcgacgcagctgccctgcttcacgcagctcaccccgccgtcgccgggatggagaaacgaagccgggagcctcggggctgcatctgggagggcattggtcagaagcgttccattttcaggtcactctcgcttcaggtgtcgcgcaaccccacgcagcgctaactcgtttcagaagaaagactccttcctggaccttcacccggaggtgtccctgctccgaggcgagcagaacgacgaggctattaacccaaggaaagcttcttctgatgggagcacgttggaggggctgggggtgccgccgagccaggacgattacaacgctgccaagatcaaggtcgttggagtcgggggtgggggttcaaatgctgtcaacaggatgattgagtactccatgaatggtgtcgagttttggatcgtcaacaccgatgtccaggcgataaggatgtccccggtgcattcccagaacaggctgcagattgggcaggagctcactcggggtttgggtgcgggtgggaaccctgatattgggatgaatgccgccaaggagagctgtgagtccatagaggaagcacttcatggtgctgacatggtttttgtcacggctggaatgggtgggggaactggaactggaggtgcccctgtaattgctggaattgccaagtccatgggtatactgacagtgggtattgtcacaacgcccttttcatttgaggggaggaggcgggcagttcaggctcaagaaggaatatcagccttgagaaatagtgtggacactctcattgtcatcccaaatgacaagctgttgtctgctgtttctccaaacactcctgtcacggaagcattcaacttggctgatgatattctttggcaaggaattcgcggtatctctgatatcattacggttcctgggttggttaatgttgattttgctgatgtgcgagccataatgcaaaatgcagggtcatctttgatgggtatagggactgcaacaggcaagtcaagagcaagagacgccgctcttaatgccattcagtcaccactgctagatattggaattgagagggctacaggcatcgtgtggaatatcactggaggaaatgatttgactttgtttgaggtaaatgctgcagccgaagtaatctacgatctagttgatccaaatgctaatctgatatttggttctgtcatagacccatcactcaatggccaggttagcataacgttgatcgctactggctttaaacggcaggatgaagcagaaggtcgcaccgcaaagggtggccagcaaatgcaaggagacaatggtcgacatccatcttccacaggtggcagcaaggtggagattcctgagttccttcggaggagaggtccttctcgcttcccgcgaatttgactcttctccagggctccctttctcagatatgcctgttgagactcgcccctcgtagattagatgccctcttgtaagataccagacctgtagagtctagctgttttccgtagaggttttacttttttgtagttttgtttgatctttctgttctttatcttggaatgctactgccaataatgtgtagctgtgagcatatcagtgttgtagaaaatgttctgccttcctggtgtgtc

SEQ ID NO: 308 - DNA, 1861 bp, Secale cereale
ccaaatctctctcgtgaagcgcacggcggcgataccttgggatttcggcgtggtctggcctgaattgctcgtgactttgccgtgccctagagctgcaggcgtgccgcggcccgccttcgtccgcgccgccgccgccgccgccatcaccgttcccgttctacaaaccaacctccaaattttctgggtgtgcaccggcacgccaggcacagcatctggatccgcctctgcgtgccattcagctcgctgggatggcgacgcagctgccgtgcttcacgcagctcaccccgccgtcacctggatggagaaacgaagccgggagcctcggggctgcatctgggagggctttggtcagaagcgttccattttcaggtcactctcgcttcaggtgtcgcgcaaccctacgcagcgctaactcgtttcagaagaaagactccttcctggaccttcacccagaggtgtccctgctcggaggcgagcagaacgacgaggctattaatccaaggaaaacttcttctggtgggagcacgctggaggggttgggggtgccgccgagccaggacgattacaacgctgccaagatcaaggtcgttggagtcgggggtgggggttcaaatgctgtcaacaggatgattgagtactccatgaatggtgtcgagttttggatcgtgaacaccgatgtccaggcgataaggatgtccccggtgcattcccagaacaggctgcagattgggcaggagctcactcggggtttgggtgcgggtggaaaccctgatattgggatgaatgccgccaaggagagctgtcagtccatagaggaagcacttaatggtgctgacatggtttttgtcacggctggaatgggtgggggaactggaactggaggtgcccctgtaattgctggaattgccaagtccatgggtatactgacagtgggtattgtcacaacgcccttttcatttgaggggaggaggcgggcagttcaggctcaagaaggaatatcagccttgagaaatagtgtggacactctcattgtcatcccaaatgacaagctgttgtctgctgtttctccaaacacccctgtcacagaagcattcaacttggctgatgatattctttggcaaggaattcgcggtatctctgatatcattacggttcctgggttggttaatgttgattttgctgatgtgcgagccataatgcaaaatgcagggtcatctttgatgggtatagggactgcaacaggcaagtcaagagcaagagacgccgctcttaatgccattcagtcaccactgctagatattggaattgagagggctacaggcatcgtgtggaatatcactggaggaaatgatttgactttgtttgaggtaaatgctgcagccgaagtaatctacgatctagtcgatccaaatgctaatctgatatttggttctgtcatagacccatcactcaatggccaggttagcataacgttgatcgccactggctttaaacggcaggatgaagcagaaggtcacaccgcaaagggtggccagcaaatgcaaggagacaatggtcgacatccatcttccacaggtggcagcaaggtggagattcctgagttccttcggaggagaggaccttctcgcttcccgcgaatttgacttctccagctctccctttctcagatatgcccgttgagactcgcccctcgtagattagatgccctcttgtaagataccagacctgtagagtctagctgttttccgtagaggttttgattttttgtagttttgtttgatctttctgttctttatcttggaatgttactgccaataatgtgtagctgtgagcatatcagtgttgtagaaaatgttctgcc

SEQ ID NO: 309 - DNA, 1775 bp, Avena sativa
cactccgccgtcacctggatggagaggcgaggccgggagcctcggggctacatctgtgaaggcactggtcagaagcaccccattttcgggccactctcacttcaggtgttgcgcgagcccacgcagcgctaactcgtttcagaagaaagactccttcctggacctccacccagaggtgtccctgctccgaggtgagcagaacgatgaggttatcaacccaaggaaagattcttctaacaggagcacgctggagggactgggggcgcccccgaccgtgatgattacaacgctgcaaagatcaaggtcattggagtcggggcgggggttcaaatgctgtcaacaggatgattgagtgctccatggacggtgtcgagttttggattgtgaacaccgatgtgcaggcgataaggatgtccccggtgcattcccagaacaggctgcagattgggcaggagctgactcggggtctgggtgcgggtggaaaccctgatattgggatgaatgctgccaaggagagttgtgagtccatagaagaagcacttgatggtgctgacatggtttttgtgacggctggaatgggtgggggaactggaactggaggtgctcctgtaattgctggaatcgccaagtcgatgggcatactgaccgtgggaatcgtcacaacgcccttctcatttgaggggaggaggcgggcagttcaggctcaagaaggaatagcagccttgaggaatagcgtggacactctaatcgtaatcccaaatgacaagttgttgtctgctgtttcaccaaacactcctgtcacggaagcattcaacttggctgatgatattctttggcaaggaattcgtggtatctctgatatcatcactgtgcccgggttggttaatgttgattttgctgatgtgcgagccatcatgcaaaatgcagggtcatctctgatgggtatagggactgctacaggcaagtcaagagcaagagatgctgctcttaatgccatccaatcaccactgctagatattggaattgagagggctacaggcatcgtgtggaatatcaccggaggaactgatttgactttgtttgaggtaaatgctgctgctgaaataatctacgatcttgttgatccaaatgctaatctgatatttggttctgtcatagacccatcactcagtggacaggtgagcataaccttgatcgcaactggctttaaacggcaggatgaaccggaaggtcagacctcaaagggggcccaacaaacgcaaggagacaatggtcgacatccatccacaggtggcagcaaggtggagattcctgagttccttcggaggagaggaccatcccgctttaaacgaatttgactcttctcaaactccgtctctggagatatgcctgatgccgctcgcgcctccttagattagcttcccacttgtaagataccaggcatgtagagtctagttgttttccgtagaggtttgtttttcagttttgtttggtctttctgttctttatcttggaataatactagcaataatgtgtagcagtgagctttgccagtgctgtagaagatgttactggcttcctagcctgcccttctatccttgctccctctgctaaaatttgtctcttctattactattggccgtgctcttcttcatgtcccctcatgcctgatggttcccctgcccctttgctggttctttgcctacctgtcatgccgtaatggccgaggactctggtggcttgtgtgccgttctatgaacttgatctttgactat

SEQ ID NO: 310 - DNA, 1931 bp, Brachypodium distachyon
cctcgctccgtcgctcgtcttcctcctcgtgcgagcgcctccaccgccggtatctatctccccttcaattctctcgttcccgaccgtttctcctcccatcaccccacgaacagatcccgccctttagcttcccgttgcatctccttaatcttccccaattcgtaactgaggcaaaaaacaaggtagggcggccgccctaccttgccctatcgggtcctccgcccttctagatccgccgctgtggtgtgccattgggcttgctgagatggcgactcagcttccgtgcttcacgcagcttactccgccgtcacctggatggagaagcgacggggcaacatctggaagggcatttctcagaagcactccatttctgggtcactctcacttcaggtgtggcgcaactccccgcagcgctaactcgtttaagaagaaagactcgttcctggacctccacccagaggtgaccctgctccgaggtgagcaaagcaacgatgttattaactcaaggaatgcttcttctgaggttagcacgttggaggggttgggggtgccgccggatcggaatgattacaacgaagccaagatcaaagttgttggagtcggtggtgggggttcaaatgctgtcaacaggatgattgagttctccatgaatggtgtcgaattttggattgtgaacactgatgtgcaggcgataaggatgtccccggtgcattcccagaatagactgcagattggacaggagctgacacggggtctaggtgcgggtggaaaccctgatattgggatgaatgccgcaaaggagagctgtgagtccatacaggaagccctctatggtgctgacatggtttttgtgacggctggaatgggtgggggaactggaactggaggtgtccctgtaattgccggaattgccaagtccatgggtatactgactgtgggtattgtcacaacgcccttttcatttgaggggaggaggcgcgcagttcaggctcaagagggaatagcagccttgagaaatagtgtggatactctcattgtcatcccaaatgacaagttgttgtcagctgtttctccaaacactcctgtcacagaagcattcaacttagctgatgatattcttcggcaaggcatccgtggtatctctgatatcatcacggttcctgggttggttaatgttgattttgctgatgtgcgagccatcatgcaaaatgcagggtcgtcgttgatgggtatagggactgctacaggcaagtcaagagcaagagatgctgctcttaatgccatccagtcaccactgctggatattggaatagagagagctacaggcatcgtgtggaatatcaccgggggaactgatttgactctgtttgaggtaaatgctgctgctgaaataatctacgatcttgttgatccaaatgctaatctgatatttggtgctgtcatagacccatcactcagtggccaggtgagcataaccttgatcgctacaggctttaaacggcaggatgaaccagaaggtcgcacctcaaagggggcccaacaaatgcatggagacaatggccgacatccatcctccacagatgctagcaaggtggagattcctgagttccttcggaggagaggaccttctcgcttcccgcgagtttgattcttccagactcctctcgagatacgcctgatgagactcttagatcagataccacctgtaagataccaagacctgtagactctagtgtttttcccatgtagaggtttcttttttagttctgtttggtctgtttcgttctgtattctggaactctactgccaataatgtgtagcagtgagctttgcagtgctatagaaaattttagtgccatcctttcctgcccttcgagcttcgaggcttcgaccttcgtcatacccacccaagtctttgatctttttgcctg

SEQ ID NO: 311 - DNA, 2143 bp, Brachypodium distachyon
ccccctcgctccgtcgctcgtcttcctcctcgtgcgagcgcctccaccgccggtatctatctccccttcaattctctcgttcccgaccgtttctcctcccatcaccccacgaacagatcccgccctttagcttcccgttgcatctccttaatcttccccaattcgtaactgaggcaaaaaacaaggtagggcggccgccctaccttgccctatcgggtcctccgcccttctagatccgccgctgtggtgtgccattgggcttgctgagatggcgactcagcttccgtgcttcacgcagcttactccgccgtcacctggatggagaagcgacggggcaacatctggaagggcatttctcagaagcactccatttctgggtcactctcacttcaggtgtggcgcaactccccgcagcgctaactcgtttaagaagaaagactcgttcctggacctccacccagaggtgaccctgctccgaggtgagcaaagcaacgatgttattaactcaaggaatgcttcttctgaggttagcacgttggaggggttgggggtgccgccggatcggaatgattacaacgaagccaagatcaaagttgttggagtcggtggtgggggttcaaatgctgtcaacaggatgattgagttctccatgaatggtgtcgaattttggattgtgaacactgatgtgcaggcgataaggatgtccccggtgcattcccagaatagactgcagattggacaggagctgacacggggtctaggtgcgggtggaaaccctgatattgggatgaatgccgcaaaggagagctgtgagtccatacaggaagccctctatggtgctgacatggtttttgtgacggctggaatgggtgggggaactggaactggaggtgtccctgtaattgccggaattgccaagtccatgggtatactgactgtgggtattgtcacaacgcccttttcatttgaggggaggaggcgcgcagttcaggctcaagagggaatagcagccttgagaaatagtgtggatactctcattgtcatcccaaatgacaagttgttgtcagctgtttctccaaacactcctgtcacagaagcattcaacttagctgatgatattcttcggcaaggcatccgtggtatctctgatatcatcacggttcctgggttggttaatgttgattttgctgatgtgcgagccatcatgcaaaatgcagggtcgtcgttgatgggtatagggactgctacaggcaagtcaagagcaagagatgctgctcttaatgccatccagtcaccactgctggatattggaatagagagagctacaggcatcgtgtggaatatcaccgggggaactgatttgactctgtttgaggtaaatgctgctgctgaaataatctacgatcttgttgatccaaatgctaatctgatatttggtgctgtcatagacccatcactcagtggccaggtgagcataaccttgatcgctacaggctttaaacggcaggatgaaccagaaggtcgcacctcaaagggggcccaacaaatgcatggagacaatggccgacatccatcctccacagatgctagcaaggtggagattcctgagttccttcggaggagaggaccttctcgcttcccgcgagtttgattcttccagactcctctcgagatacgcctgatgagactcttagatcagataccacctgtaagataccaagacctgtagactctagtgtttttcccatgtagaggtttcttttttagttctgtttggtctgtttcgttctgtattctggaactctactgccaataatgtgtagcagtgagctttgcagtgctatagaaaattttagtgccatcctttcctgcccttcgagcttcgaggcttcgaccttcgtcatacccacccaagtctttgatctttttgcctgagtttctccttgtgtcacgagctggagggcaagggctctggttcatggcgatgatctgaacccggggaggggggcctcgatcgtgagttccttcgttgcgagatctttccctccatactcctgtcgtctgggttcatgtcccctgtcgccatctttccctccatactcctgacaccttggattcgtactgtactactctttttgttccg

SEQ ID NO: 312 - DNA, 1750 bp, Pennisetum glaucum
cgaggctgctggcgatcccgctccgctgcggccgagttcgcgccggccggaatcgctcgtggtatgagcagctgacaagtcaaactttgagaccattgggcactgtcaggactcaggagaagtgcattgatagcttggccatcaactcagtaagatggctacacagttgccatgcttcacacagctcagcccaccatcttctagttggggaaatgaagttgcaagctgcaaggatacatctggtagggcatttgtcagaagtactcgagctttgggtcgctgtcacttccggtgctgtgcaagcccccgcagtgccaattctttccggaagaaagactcgttccttgacctccatccagaggtgtctctgctccgtggtgagaagaatgtcgaggttgtggacccattgaaaggtgcttctgatggaagcccgttagaggggctgggagtgccaccagaccggagtgattataatgaggccaagatcaaggttgttggagttggtggtgggggttcaaatgctgtcaacaggatgattgaaagctctatgaatggtgttgagttttggattgtgaacactgatgtgcaggcgataagaatgtctcctgtactttcccacaataggttgcagattgggcaggagctgactcgaggtttgggtgcggggggcaaccctgatattgggatgaatgcagcgaaggagagcagtgaatccatacaggaagcactttatggtgctgacatggtttttgtgacggctggaatgggtggagggaccggaactggaggtgctcctgtaattgctgggattgccaagtccatgggtatacttactgtgggtattgtcactacgcctttctcatttgaggggaggcggcgggcagttcaagctcaggaaggaatagcagctttgcgaaatagtgtggacaccctgattgtcatcccaaatgacaagctcttatctgctgtttctccaaatactcctgtaacagaagcatttaatttggctgatgacatccttcgacaaggcattcgtggcatatctgatatcattacggttcctggattggttaatgttgactttgctgatgtgcgtgccatcatgcaaaatgcagggtcatctttgatgggtatagggactgctacaggtaaatcaagagcaagagatgctgctcttaatgccattcagtcgccactactagatattggaattgaaagagctacaggcatcgtatggaatatcactgggggaatggatctgactttgtttgaggtaaatgcagctgctgaaataatctacgaccttgttgatccaaatgctaatctgatatttggtgctgtcatagacccttcactgagtggtcaagtgagcataaccttgattgctactggattcaaacggcaggatgaaccagaaggtcgcacctcaaagggtggccagcagatccaaggcgagaatggccgacgcccatcctccggcgaaggcagcatggtggagatccctgaattcctccgacgaagaggcccctctcgcttcccacgagtttgattgtccaggcttcgccctgctcccgccctgtatgatatacccccgttaggtcagatggctcctgtaaggcaccaagccttccggactaggcgtagtggttcttgttcagttttgtttgctccttcgttcgtgatgtttttcgaatccttctgtcaataatgtgtagaggtgagcttgctagtgctatagaaaatgtgttcc

SEQ ID NO: 313 - DNA, 1996 bp, Setaria italica
gcaaaccgtgggtttaggggaagccgccaggccaggcgccaccccgcagcgaaaacaagagattccactccaagtacaccacctcacctgcgagctgcgaacaaagcccaaaacccttttgacgataaggcggccgcccggcgtcggccgattcctccccaaatttcccatcctcgagctgctgccgatcccgctccgctgtcggccgagttcgcgccggccggaatcgctcgtgatatgagcagctgataagtcgaatttcaaggccattggacactgtcaggagaagtacattgattgcctgcccattaacttattaagatggctacacagttaccatgcttcacacagctcagtccaccatcttctagttggggaagtgaagttccaagctgcaaggatacatctggtagggcatttgtcagaagtactcgaactttgggtcactgtcacttcaggtgctgtgcaagcccccgcagtgccaactctttccagaagaaagactcgttccttgacctccatccagaggtgtctctgctccgtggtaagaagaatgttgaggtcgtggacccattgaaaggtgcttctgatggaagcccgttagaggggctgggagtgccaccagaccggagtgattataatgaggccaagatcaaggttgttggagttggaggtggaggttcaaatgctgtcaacagaatgattgaaagctctatgaatggtgttgagttttggatcgtgaacactgatgtgcaggcgataagaatgtctcctgtgcttccccacaataggttgcagattgggcaggagctgactcgaggtctgggtgcggggggaaaccctgatattgggatgaatgcagcgaaggagagcagtgaatccatacaggaagcactttatggtgctgacatggtttttgtgacggctggaatgggtggagggactggaactggaggtgctcctgtaattgctggaattgccaagtccatgggtatacttactgtcggtattgtcactacgcctttctcatttgaggggaggcggcgggcagttcaagctcaggaaggaatagcagctttgcgaaatagtgtggacaccctgattgtcatcccaaatgacaagctgttatctgctgtttctccaaatactcctgtaacagaagcatttaatttggctgatgacattcttcgacaaggcattcgtggcatatctgatatcattacggttcctggattggttaatgttgactttgctgatgtgcgtgccatcatgcaaaatgcagggtcatctttgatgggtatagggactgctacaggaaagtcaagagcaagagatgctgctcttaatgccattcaatcgccactgctagatattggaattgaaagagctacaggcatcgtatggaatatcactgggggaatggaccttactttgtttgaggtaaatgcagctgctgaaataatctacgaccttgttgatccaaatgctaatctgatatttggtgctgtcatagacccttcactgagtggtcaagtgagcataaccttgattgctactggattcaaacggcaggatgaaccagaaggtcgcacctcaaagggtggccagcagatccaaggcgagaatggccgacgcccatcctctggcgaaggcagcatggtggagatccccgaattcctccgacgaagaggcccctctcgcttcccacgagtttgattgtccaggcttcgcccttctcccgccctgtatgatatacctccgttaggtcagatggttcctgtaaggcactgaagcctttcagactaggcgtagtggttcttgttcagttttgtgcgtgatatttttcgaatcctcctgtcaataatgtgtagaagtgagcttgctagtgctatagaaaatgtgttcccttttactccgatctgctcatcgttgtctgtcgtgctgttctgctggatcatactctggataggagagaagtgatggttgtctagttggc

SEQ ID NO: 314 - DNA, 1913 bp, Setaria italica
aggccaggcgccaccccgcagcgaaaacaagagattccactccaagtacaccacctcacctgcgagctgcgaacaaagcccaaaacccttttgacgataaggcggccgcccggcgtcggccgattcctccccaaatttcccatcctcgagctgctgccgatcccgctccgctgtcggccgagttcgcgccggccggaatcgctcgtgatatgagcagctgataagtcgaatttcaaggccattggacactgtcaggagaagtacattgattgcctgcccattaacttattaagatggctacacagttaccatgcttcacacagctcagtccaccatcttctagttggggaagtgaagttccaagctgcaaggatacatctggtagggcatttgtcagaagtactcgaactttgggtcactgtcacttcaggtgctgtgcaagcccccgcagtgccaactctttccagaagaaagactcgttccttgacctccatccagaggtgtctctgctccgtggtaagaagaatgttgaggtcgtggacccattgaaaggtgcttctgatggaagcccgttagaggggctgggagtgccaccagaccggagtgattataatgaggccaagatcaaggttgttggagttggaggtggaggttcaaatgctgtcaacagaatgattgaaagctctatgaatggtgttgagttttggatcgtgaacactgatgtgcaggcgataagaatgtctcctgtgcttccccacaataggttgcagattgggcaggagctgactcgaggtctgggtgcggggggaaaccctgatattgggatgaatgcagcgaaggagagcagtgaatccatacaggaagcactttatggtgctgacatggtttttgtgacggctggaatgggtggagggactggaactggaggtgctcctgtaattgctggaattgccaagtccatgggtatacttactgtcggtattgtcactacgcctttctcatttgaggggaggcggcgggcagttcaagctcaggaaggaatagcagctttgcgaaatagtgtggacaccctgattgtcatcccaaatgacaagctgttatctgctgtttctccaaatactcctgtaacagaagcatttaatttggctgatgacattcttcgacaaggcattcgtggcatatctgatatcattacggttcctggattggttaatgttgactttgctgatgtgcgtgccatcatgcaaaatgcagggtcatctttgatgggtatagggactgctacaggaaagtcaagagcaagagatgctgctcttaatgccattcaatcgccactgctagatattggaattgaaagagctacaggcatcgtatggaatatcactgggggaatggaccttactttgtttgaggtaaatgcagctgctgaaataatctacgaccttgttgatccaaatgctaatctgatatttggtgctgtcatagacccttcactgagtggtcaagtgagcataaccttgattgctactggattcaaacggcaggatgaaccagaaggtcgcacctcaaagggtggccagcagatccaaggcgagaatggccgacgcccatcctctggcgaaggcagcatggtggagatccccgaattcctccgacgaagaggcccctctcgcttcccacgagtttgattgtccaggcttcgcccttctcccgccctgtatgatatacctccgttaggtcagatggttcctgtaaggcactgaagcctttcagactaggcgtagtggttcttgttcagttttgtgcgtgatatttttcgaatcctcctgtcaataatgtgtagaagtgagcttgctagtgctatagaaaatgtgttcccttttactccgatctgctcatcgttgtctgtcgtg

SEQ ID NO: 315 - DNA, 2082 bp, Panicum virgatum
tttgtccaattgactgtagatatgagcagctgagaagttgagttttgaggccattgggtactctcaggagaagtgcattgatagcctgaccattaacttcttaagatggctacacagttaccatgctttacacagctcagtccaccatcttctagttggggaaacgaagctgcaagctgcaaggatacatctggtagggcatttgtcagaagtactcgagctttgggtcattgtcacttccggtgctgtgcaaggccccgcagtggcaactctttccagaagaaagactcgttccttgaccttcatccagaggtgtctctgctccacggtgagaagaatgttgaggttgtggacccattgaaaggtgcttctgatggaagtccgttagaggggctgggagtgccaccagaccggagtgattataatgaggccaaaatcaaggttattggagttggaggtgggggttcaaatgctgtcaacaggatgattgagagtgctatgcatggtgttgagttttgggttgtgaacactgatgtgcaggcgataagaatgtctcctgtgcttcctcacaataggctgcagattgggcaggagctgactcgaggtttgggtgcagggggaaaccctgatattggtatgaatgcagcaaaggagagcagtgaatccatacaggaagcactttatggtgctgacatggtttttgtgacggctggaatgggtggagggactggaactggaggtgctcctgtaattgctggaattgccaagtccatgggtatacttactgtcggtattgtcactacgcctttctcatttgaggggaggcggcgggcagttcaagcacaggaaggaatagcagctttgcgaaacagtgtggacaccctaattgtcatcccaaatgacaagttgttatctgctgtttctccaaatactcctgtaacagaagcattcaatttggctgatgatatccttcgacaaggcattcgtggcatttctgatatcattacggttcctggattggttaatgttgattttgctgatgtacgtgccatcatgcaaaatgcagggtcatctttgatgggtatagggactgctacaggaaagtcaagagcaagagatgctgctcttaatgccattcagtcacctctgctagatattggaattgaaagagctacaggcattgtatggaatatcactgggggaatggacctgactttgtttgaggtaaatgcagccgctgaaataatctacgacctcgttgatccaaatgctaatctgatatttggtgctgtcattgacccatcactgagtggtcaagtgagcataaccttaattgctactggattcaagcggcaggatgaaccagaggatcgcaccccaaagggcggccagcagatccaaggcaagaatggccgacgcccatcctccgcagagggcagtatggtggagatccccgaattccttcgacgaagaggcccttctcgcttcccacgagtttgaaccaggcttcccccttctcccgccctgtatgatatacctccgttaggtcagatggctcctgcaaggctccgaagccttccagactaggtgtcgtagtggttcttgttcagttttgtttgctccttcgtctccagtctttcagtcaataatgtgtagaagtgagcttgctagtgctatagaaaaatgtgttcccttttacactgatctgcttgacattgtctgtcgtgccctgattccttcagctggccggcacttcagctgaaaacatctgtttgtcttagttaaggtccattttggtgttcctgtggtgtgccgcgacgacgagcctagcttgttccgttatgggatcctcaaaggccatggcagcgtcaccttagcacctcttgtggtgcttctccggcacactggtagggtactagggtgtaagcgccgccgcaacaccattatttatgttgtgaaacacctcgataacggttggaccctctcgctttcatgcctctcgcggcaagtgacaaagcataagaatagaagaaccaaatatgaggaattattttttattctatgaatatcgatgatttacaa

SEQ ID NO: 316 - DNA, 1990 bp, Panicum virgatum
attgactgtagatatgagtagtggataagttgaattttgaggccattgggtactctcaggggaagtgcattgatagccttaccattaacttcctaagatggctactcagttaccatgcttcacacagctcagtccaccatcttctaattggggaaatgaagctgcaatctgcaaggatacatctggtagggcatttgtcagaagtactcgagctttgagtcattttcacttccagtgctgtgcaaggccccgcagtgccaactctttccagaagaaagactcgttccttgaccttcatccagaggtgtctctgctccgtggtgagaagaatgttgaggttgtggacccattgaaaggtgcttctgatggaagtccgttagaggggctgggattgccaccagaccggagtgattataatgaggccaagatcaaggttgttggagttggaggtgggggttcaaatgctgtcaacaggatgattgagagctctatgcatggtgttgagttttgggtcgtgaacactgatgtgcaggcgataagaatgtctcctgtgcttcctcacaataggttgcagattgggcaggagctgacacgtggtttgggagcagggggaaaccctgatattggtatgaatgcagcaaaagagagcagtgaatccatacaggaagcacttcatggtgctgacatggtttttgtgacggctggaatgggtggagggactggaactggaggcgctcctgtaattgctggaattgccaagtcaatgggtatacttactgttggtattgtcactacgcctttctcatttgaggggaggcggcgggcagttcaagcacaggaaggaatagcagctttgcgaaatagtgtggacaccctaattgtcatcccaaatgacaagttgttatctgctgtttctccaaatactcctgtaacagaagcattcaatttggctgatgatatccttcgacaaggcattcgtggcatatctgatatcattacggttcctggattggttaatgttgattttgctgatgtgcgtgccatcatgcaaaatgcagggtcatctttgatgggtatagggactgctacaggaaagtcaagagcaagagatgccgcccttaatgccattcagtcacctctgctagatattggaattgaaagagctacaggcatcgtatggaatatcactgggggaatggacctgactttgtttgaggtaaatgcagccgctgaaataatctacgacctcgttgatccaaatgccaatctgatatttggtgctgtcatagacccatcactgagtggtcaagtgagcataaccttgattgctactggattcaaacggcaggatgaaccagaggatcgcagcccaaaggtcggccagcagatccaaggtgagaatggccgacgcccatcctccacagaaggcagcatggtggagatccccgagttccttcgacgaagaggcccttctcgcttcccacgagtttgaaccaggcttcccccttgtcccgccctgtatgatatacctccgttaggtcagatggctcctgcaaggcaccgaagccttccagattaggtgttctcggtagtggttcttgttcagttttgtttgctccttcgtgcgccatatttctctagtctttcagtcaataatgtgtagaagtgagcttgctagtgctatagaagaatgtgtttccttttacactgatctgctcgacattgtctgtcctgctctgattccttcgacttgccggcacttcagctgaaaacatctgtttgtcctagttaaggtccattttggtgctcctgtgctgtgccgcagcgacgaacctagcttgttccgttatgggatcctcaaaggctatggcaccttagcatctcttatggtgcttgtccagcaccactggtagggtgtaagcacagcaacgctatagtttatgttgtgaaacacctcgttaactgttggatcgtctcgccttcatgcctc

SEQ ID NO: 317 - DNA, 1970 bp, Saccharum officinarum
caaagcccaaaatccttcgccccccggcacctgctctctctcgcgcgcctcccgtgcccctcactagtgtctagcggcgacgactgggcgaccgcctccgccgtccgctaggggccgtgccccaggtctccaccttcgggcgcttcgcccaccagatatgagcagctgaaaactcgattttgaggccattatttgacacccaaggagaagtgcacctgttacctggccattttagcttgttgagatggctacacagttgccatgcttcacacagctcagtccaccgtcttctaattggataaaagatgctgggaactgcaaggctacgcctggtagggtagtcaaaagtgctcgagctttgggccactcccacttccggtgctgcgcaagcccccgtagtgccaactctttcaagaagaaagactctttcctcgaacttcatccggaggtatctctgctccgtggcgagaagagtgttgatgttgtgccaatgaaaggctcctctgatgggagtctgttagagggtccaggggtgccgccggaccggaatgattataacgaggctaagatcaaggtagttggagtaggaggtgggggttcgaatgccgtcaatcggatgattgagagctccatgaacggcgttgagttttggatcgtgaacactgatgtgcaggccataagaatgtctcctgtgctcccccacaataaactgcagattggacaggagttgactcgaggcctgggcgctgggggaaaccctgatattgggatgaatgcggcaaaggagagcaacgagtccattcaagaagctctttttggtgctgacatggtttttgtgacggctggaatgggtggaggaactggaactggaggtgctcctgtaattgctggaattgccaagtccatgggtatacttactgttggcattgtcacaacgcctttctcgttcgaggggaggagacgggcagttcaagctcaggaaggaatagcagcattgagaaatagtgtggacaccctaattgtcatcccaaatgataagctgctgtctgctgtttctccaaatacacctgtaactgaagcatttaatttggctgatgatattcttcgacaaggcattcgcggcatatctgatataattacggttcctgggttggttaatgttgattttgctgatgtgcgtgctatcatgcaaaatgcagggtcatctttgatgggtatagggactgctacaggaaagtcaagagcaagggatgctgctcttaatgccatccagtcgccactgcttgatattggaattgaaagagctacaggaattgtgtggaatatcactgggggaactgacctgactttgtttgaggtaaatgctgcggccgaaattatatacgaccttgttgatccaaatgctaatctgatatttggcgctgtcatagacccgtcactgagtgggcaagtgagcataaccttgatagctactggcttcaaacggcaggatgaaccagaaggtcgtgcttctaagggtggccagcaaggtgagaatggccgacgcccgtcctctgcagaaggcagcatggtggagatcccagagttccttcgaagaagaggaccttctcgcttcccacgagtttgactgtccagccatgctccctgctccctgctcctgcccctgcacctgtataatatgccccactcttaggtcagaattagatggtcttgtatggcaccaagcctgctctaggcatcgtctctagcggttctttctagttttgtttccccctttctgtgtgataattttttttgccaccgattcttacgatcaataatgtgtagctgctgtgagctctctagtgctatatatatagcccatagagaatgtctttttcccttccattgcctgttacactggatctgaatgggtgatgcactgcggctggtcacaggacctgtcgacatggtagttgaagaagtgaaga

SEQ ID NO: 318 - DNA, 2545 bp, Sorghum bicolor
cctcgcagcgccgctggctcggtcctcagcgcagatcttctgctcctccccccactcgcgctcaggctcgatcccagggatcggatcttccgcgcgtcggcggctccccctcggcggcgtccagcgacggaggggcagtcccaggctcggcggcggcgtcggcggctccacctccagcctctcgccagtcgcctcgcgccctcgcctccgtcctccgcgcaccggccggcgaccctgcatatgagcgtctgacaagtcgattttgaggccattatttgataccccaggagaagtgcaccgattgcatgcccattttagcctgttgagatggctacacaattgccgtgcttcacacagctcagcccaccgtcttctagttgggtaaaagatgtcgggaactgcaaggcagctacgcctggtagggtagtcagaagtgctcgagctttgggccactctcacttccggtgctgtgcaagcccccgcagtgccaactctttcaagaagaaagactctttcctcgaacttcatcctgaggtatctctgctccgtggcgagaagactgttgacgttgtgccaatgaaaggttccactgatgggagtctgttagagggtccgggggtgccgccggaccggaatgattataacgaggctaagatcaaggtagttggagtaggaggtgggggttcgaatgcagtcaatcggatgattgagagctccatgaatggtgttgagttttggatcgtgaacactgatgtgcaggctataagaatgtcacctgtgctcccccacaatagactgcagattggacaggagttgactcgaggcctgggcgctgggggaaaccctgatattgggatgaatgcagcaaaggagagcagcgagtccattcaggaagctctttttggtgccgacatggtttttgtgacggctggaatgggtggaggaactggaactggaggtgctcctgtaattgctggaatcgccaaatccatgggtatacttaccgttggcattgtcacaacgcctttctcatttgaggggaggagacgggcagtccaagctcaggaaggcatagcagcattgagaaatagtgtggacaccctaattgtcatcccaaatgataagctgctgtctgctgtttctccaaatacacctgtaaccgaagcatttaatttggctgatgatattcttcgacaaggcattcgtggtatatctgatataattacggttccggggttggttaatgttgattttgctgatgtgcgtgctatcatgcaaaatgcagggtcatctttgatgggtatagggactgctacaggaaagtcaagagcaagggatgctgctcttaatgccatccagtcgccactgcttgatattggaattgaaagagctactggcattgtgtggaatatcactgggggaactgacctgactttgtttgaggtaaatgctgcggcagaaattatctacgaccttgttgatccaaatgctaatctgatatttggcgctgtcatagacccgtcactgagtggacaggtgagcataaccttgatagctactggcttcaaacggcaggatgaaccagaaggtcgcgcttctaagggtggccaacaaggtgagaatggccgacgcccatcctctgcagaaggcagcatggtggagatcccagagttccttcgaagaagaggaccttctcgcttccctcgagtttgactgtccagtcatgctccctgctcctgcccagcacctgtataatatgccccactcttagatcagaattagtgttcttgtatggcaccaagccttctgtaggcatcctctctagcagttctctctggttttgttttgcgatattttttccccccccccccgctgattcttacggtcaataatatgtagctgctgtgagctctctagtgctatatatatagttcatagagaatgtgtttttcccttccattgcctgttatacttggatctgaatggatgatacagtgcggctagtcctgtgacatggtagctgaagaagtgaagattgcctgcttggctgtgttttcttggctctgtgacttgtttacttccaaaaaattttgcaaaatatgaatagtagcattttcgtttgtatttgacaaatattgtctaattatggactaactaggctcaaaagattcgtctcgtcaattccgaccaaattatgtaattagtttttatttttatttatatttaatactctatgcatatgtctaaagattcgatgcgacggggaatctgaaaaattttgcaaaatttttagggaagtaattagacaatgtgggcattcggtgccacacgacactgcaaatttgtaatgtgacatgtcaggccttaactgtcgcagtccaatcaaacggttcaaattatcaattgcaccctgtatcccaatcttaagaataaatgttattctagctatgaatcatccacctctacttcgtcagcggtcatgtttgaccaagtcaagagagattcacaagggaggggaacatcagaacatcacatctgaatcagt

SEQ ID NO: 319 - DNA, 1828 bp, Echinochloa colona
tgcgaacaaaccccaaaaccaaaacctctcccccctctcggcggcgataaggcggccgccccgcctgcgccgattcctccccacaaattccccgtcctcaagctgccgatcccgctctgctgtgtggcgtggcgccgaatcgaactggttgcgcccggcgggaatagcaatcgctcctgatatgagcagctgtctagtcgaattttgaggccattggataccttcaagagaagtacattgatagcctggccattgacttcttgagatggctacacagttaccatgcttcacacaggtcagtccgccattgtctagttggggaaatgaagttgcaagctccaaggccgcatctgttagggcattggtaagaagtactcgagctttgggtcactgtcacttccgctgctgtgcaagcccccgcagagccaactctttccagaagaaagactcgttccttgacctccatccagaggtgtctctgctccgtggtgagaagaatgttgaggttgtggaaccactgaatggtgcttctaatggaagcccattagaggggccgggagtgtcaccagaccggagtgattataatgaggccaagatcaaggttgttggagttggaggtgggggttcaaatgctgtcaacaggatgattgagagctctatgaatggtgttgagttttggattgtgaacactgatgtgcaggcgataagaatgtctcctgtgcttccccacaacaggttgcagattgggctggagctgactcggggtttgggtgcgggaggaaaccctgatattgggatgaatgcagcgaaggagagcagtgaatccatacatgaagcactgtatggtgctgacatggtttttgtgacggctggaatgggtggagggactggaactggaggtgctcccgtcattgctggaattgccaagtccatgggtatacttactgtaggtattgtcactacgcctttctcattcgaggggaggcggcgggcagttcaagctcaggaaggaatagcagctttgcgagatagtgtggacaccctaattgtcatcccaaatgataagctattgtcagctgtttctccaaatactcctgtaacagaagcatttaatttggctgatgatatccttcgacagggcattcgtggcatatctgatatcattacggttcctggattggttaatgttgattttgctgatgtgcgtgccatcatgcaaaatgcagggtcgtctttgatgggtatagggactgctacaggaaagtcaagagcaagagatgccgctcttaatgccattcagtcgccactgctagatattggaattgaaagagccactggcatcgtatggaatataactgggggaatggacctgactttgtttgaggttaatgcggctgctgaaataatctatgaccttgttgatccaaatgctaatctgatatttggagctgtcatagatccgtcacttagtggtcaagtgagcataaccttgattgctactggattcaaacggcaggacgaaccagaaggtcgcccctcaaagggtggccagcagatccaaggcgaggatggccgacgccagtcctccgcagaaggcagcatggtggagatccccgagttccttcgacgaagaggcccttctcgcttcccgcgagtttgactgtcctggcttctccttctcccgccctgtatgatatacctccgttaggtcagatggctcctgtaatgcaccgaaaccttgcaggctaggcgttcttggtagtggttcttgttcagttttgtttgctcctttgtgcgcgatatttcttgaatctttatgtcaatataa

SEQ ID NO: 320 - DNA, 1997 bp, Zea mays
ccaccacctcacttgcgatgcgaacaagagcaaagccctgaaatccttctccccctgcacgcacctgcagacctgctctctcgcgcgcatctcccgtgcccctcactgtttagtggcgacgactgggcgacagtcgccgccgccgcccgctaggggccgtgcccctggtctccatcttcgggcgcttcgcccaccagatatgagcagctggcaattcgattttgaggccattatttgataacccgggacaagtgcactgttacctgaccattttagcttgttcagatggctacacagttgccatgcttcacacagctcagtccaccgtcttgtagttggataaaagatgtcgggaactgcaaggctacgcctgatagggtagccagaagtgcccgagctttgggccactgtcacttccggtgctgtgcaggcccccgtagtgcaaactctttcaagaagaaagactctttcgagaagaaagactctttcctcgaacttcatccggaggtatctctgctccgtggcgagaagagtgccgaggttgtgccaatgaaaggttcctctgatgggggtctgttagagggactgggggtgccgccggaccgaaatgattacagtgaggctaagatcaaggtagttggagttggaggcgggggttcgaatgcagtcaatcggatgattgagagctccatgaacggcgttgagttttggatcgtgaacactgatgtgcaggccataagaatgtctcctgtgctcccccacaatagactgcagattggacaggagttgactcgaggcctgggcgctgggggaaaccctgatattgggatgaatgcagcaaaggagagcagcgagtccattcaggaagctctttttggtgctgacatggtttttgtgacggctggaatgggtggaggaactggaactggaggtgctcctgtgattgctggaatagccaagtccatgggtatactaaccgttggcatagtcacaacgcctttctcgttcgaggggagaagacgggcagttcaagctcaggagggaatagcagcattgagaaatagtgtggacaccctaatcgtcatcccaaatgataagttgctgtctgctgtttctccaaatacacctgtaactgaagcatttaatctggctgatgatattcttcgtcaaggcattcgtggcatatctgatataattacggttcctgggttggttaatgttgattttgctgacgtacgtgctatcatgcaaaatgcagggtcatccttgatgggtatagggactgctacaggaaagtcaagagcaagggatgctgctcttaacgccatccagtcgccgctgcttgatattggaattgaaagagccacaggcattgtgtggaatatcactgggggaactgacctgactttgtttgaggtgaatgctgcggccgaaattatctacgaccttgtcgatccaaacgctaatctgatatttggcgccgtcatagacccgtcactgagtgggcaggtgagcataaccttgatagctactggcttcaaacggcaggatgaaccagaaggccgcgtgtcgaagggtgggcaacaaggtgagaatggccgacgcccatccccagcagagggcagcagcacggtggagatcccagagttcctgcgacgaagaggaccttctcgcttcccacgagtttgactgtcctgtcctgcacctgtatgatatgctccacccacccttaggtcagaattagatgatcttgtatggcacctagtcttctctaggcatcgatcgtctctagcggtttgttctttctagttttctttttttccccgccaccaattcttatggttatggtcatcaataatgtgtagctgctgtgagctctctagcgctatatgtaatgtagtccgtggagaatgtgttttccctgttacactggatctgattagaatggtagctgaagaagtgatggttgcctgcattagtatggtagctgaccaagg

SEQ ID NO: 321 - DNA, 2225 bp, Oryza sativa
cgtcaccaccccgctctcggcctttccgtttctgcctctgctgcccacagccaccttcctcccgtgcgttgtgttgtgcgtgccagattggtagtagtaggctggtagtagcgcagcggtagcctccttcgttatccccaaaccccgcgccgacgggcgtcctcctcgccgacatttcctcccacccccgcgcgcgccccgccgcctttctccaacctccgacgcattcttgtcaccttgttgattcttcattcttgatttgttctccttttttttttggtgattttgttgtttcttggcctgctactgttggcggcggcgagcggtggtcaccggccgtgcgttcccttctttctcctcagccctcggctcccccgccggccggacacgccgccggagctgagttgttgaggttttgcagggaagggatacactccgatccccaatgccccgcgtttggtccgcccctgcatcctcctccacagattgctaggcttcaccggagatgatggcggcgccgcagctaccgtgctgcactcgcctcgctcccccgtgtcccgggaaggcggcggcggaggcaagaaccctggcacgttcacggttcaggtgctgtgcgggggccgcgaggcctcgctcgttccagaagaaagactccttcctggacctccaccctgaggtgaccctcctccgcggcggcgacgaggcggccgtcgtcgccacgaggaaggggtctccgaacgggagcccgctggaggggctgggcgcgccgccggatcactgcgattacgacggggccaagatcaaggtagtcggggtcggcggaggaggctccaatgccgtcaacaggatgattgagagctccatgaacggcgtcgagttctggattgtgaataccgatgtgcaggcgataaggatgtcgccggtccttccgcagaacaggttgcagattgggcaggagctgactcggggtctaggcgcaggtggaaaccctgacattgggatgaatgcggcgaaagaaagtgtcgagtccattcaggaagctctttacggtgctgatatggtttttgtcacggctgggatgggtggaggcactggaactggaggtgcccctgtaatcgctggaattgccaagtccatgggtatactgacagttggcatcgtgacgacaccattctcatttgaagggaggagacgggcagttcaggctcaagaaggaatagcagccttgagaaatagtgtggacaccctcattgtcatcccaaatgacaagctgttgtctgctgtttctccaaatactccagtaaccgaagcattcaacttggctgatgatattcttcgacagggaattcgtggtatctctgatattatcacggttcctgggttggttaatgttgattttgctgatgttcgagccatcatgcaaaatgcaggctcatccttgatgggtattggaacggctacagggaagtcaagagcaagagatgctgctcttaatgccattcagtcaccactgctagacattggaattgaaagagctacaggcattgtgtggaatatcactgggggagctgatatgactttgtttgaggtgaattctgctgctgagatcatctatgaccttgttgatccaaatgctaatctgatatttggtgctgtcatagacccaacactcaatggccaagtgagcataaccttgattgccactggcttcaaacgtcaagatgaaccagaaggtcgcaccacaaagggtggccaacaaacgcaaggagacaatggtcgacgcccatcctctgcagaaggcagcatgattgagattcctgagttccttcggaggagaggaccttctcgcttcccgcgagtctgactgcccaggctcccttcccttgcccagtatctatgcttatcagcattctcctagatcagtcgcctcatgtaggataccaggcatgtacagtactgtagttgtttggttgttcagttttgtttactcccttatgttctatattttgagatcttactgttaataatttgtagcaatgagcttgctaatgctatagaaatcgttttatcccagtaggtcaaaatgatcatatgcccctactcaagttgtgttcatctcacgaggcttttactcggttgagagcctggaggttcctctgttttatcgacattgtgtgtgcattgcctgacaagcatggcaaatcgtatcccttaattttggtttc

SEQ ID NO: 322 - DNA, 2175 bp, Theobroma cacao
aaaaaggaaaaaaaaaaaaaaccttaatgtactctacgattgagttgtgagtttaatccaaatattccagaaaaaagaatatgatatttgtgtttgcagtatgcaaactcaggaatgatgatgactcagttgccatccccatcataaagcaccatgcttggagagaacctgtaatctaaggctttaacctatcctctgcaaaactgaaagtctgaaatctgatcaattttgaactgtcaagatatatgaaattaacttctgtatattgaaggaaacgaattacggtatgaccaaaaaaaaaaaaaggaaaaagcaacgatatatacaaacatttcacatgcactacatcactagaatccagatactggaacaagtgaaaatgaatagcttcaatgctttgcttgatattgaaaaagaaaagatataaaaatgaatcagctagcttagcagcctgcttggtgcacacaacaatgatcaatgatagtggtactggaaatttgggctgtgggagtgggggaacccactttcacatatcccttaaactaaacaggtgaaatacagtgcagcaaaattatcaaagggtctcttctattcttaccataaatgaacccaagaatagaagatgagcagaacttcacatgggagtcaccctcacttacgtcacaagctgtggctcacagcccttagcagacgcaataaaaattctaataatctttcaaccacggagtttcctaatcaagaaccggaaagctcttcccagaaaaaaatgggaagaggtaaaattgagattaagcggatcgagaacacgactaatcgacaagtcaccttctgcaagcgccgcaatggattgctcaaaaaggcctatgaactgtctgtgctttgtgatgctgaggttgctctcatagtcttctccagccgtggccgtctctatgaatatgctaacaacagtgtcagaacaacaattgacagatacaagaaagcatgtgcagatgcatcaaacccaggatctgttgctgaagctaacactcagttttaccaacaagaagcctccaaactccggcgacaaattcgcgatgtccagaacatgaacaggcatatccttggtgaggctcttagcactttgacttttaaggaactcaagaacctggagggaagactagagaaaggaattagtagaatcagatccaaaaagaacgaattactatttgcagaaatcgagttcatgcaaaagagggaagttgagctgcagaatgataacatgtacctgcgagcaaagatagctgaaaatgaaagagcgcaacaacagcagcagcaacaagcgaacctgatacaagggtctgtcttccaggctgtgacttcacaaccctataatcggaactttctccccgtaaacctcctggaacccagtaatgattactccagccaagaccaaactgctctccaacttgtataagatgacatacaagtaggtggccaagttctgccaactttatctctgcttaagcatataagcttggacgtatgtatagtttgtaaacagttaaaaactagttgttatcatgaaactaaggaacttagattatcatcagtactggactcccttttttaactattttattgcggaaaggattattcttgtattatgctcccaaacactagataacatggttgatttttcatcccttatcttctccttcgcttatttgttctacgaaaacgctagattgaatgctgtcacatgattagttatttgatttggcatagacttgttcaacctgcatatatatatatatagcaaagcttctctctgaaacagcaaatataaatcaatcacagttcaaggggaaccaatatcatattgttctcccctctgaatgcgtatatttgtgtaacaaaaatacttgaggaagtattatatcctgatgtaagcacatctttaacagattcattcatgacatttatggatacgcagttgacatgaatcatgatatgttcctcattttaggtttatgtttcatcaaagtctcagatattctactactaaaaggagtcaactagagattatgagaacaacccgtttctaatttatagacatttatatgttttagagagcaaaatttgatcaaaaaagaaaaagaacgactgcgggtatgcattggcaattgttcttcctgc

SEQ ID NO: 323 - DNA, 808 bp, Heritiera littoralis
ggtggctgctttttctccttattttctcgccataagaagtctcgctctttgccccttctctccaaaactccccatttcctttcttcatttgaagcagctatgtcttttagaggaggaaatgcatcatctggcatgggtgtggctgagcacactaaaagcacgtacctggagttgcagaggaagaaggtgttccgatatgtgatctttaagattgatgagaagaaaaaggaggttatggttgaaaagactggaggtccagctgagagctacgatgatttcactgcctccttacctgagaatgactgccgatatgcagtttatgactttgatttcgtgacttctgagaactgccagaagagcaagatcttttttattgcatggtctccttctgtttcaaggatccgagccaagatgctttatgcaacatccaaggacaggttcagaagggaattggagggcattcattatgaaatccaggcaactgacccaaccgagatggatcttgacgtgatcagagagcgtgcacattaagcgtccgctgccttcgtggatatcacatgcttagaaaactcgctagagtcgcatttaggatcgtttcctgattcaatttgttgccgagttaagtgcagttatctgtctctgacacagtacatatgtctattgttaaataacacctgcgaaggctgattaggagctcagggattcaaacatctggggtatgttgggactttgggcttctcattgccatgatgcttcacaggtgaaagtgggtgtgattatggatatttgactcttatcaatggaatgg

SEQ ID NO: 324 - DNA, 738 bp, Gossypium hirsutum
attttctaagcggctatgtcttcagaggaacaaatgcatcatctggcatgggagtggctgatcacagcaaaagcacttacctggagctgcaaagaaagaaagtgtttcgatacgtggtctttaagatcaatgagaagaaaaaggaggtagtagttgaaaaaacgggaggtccatctgagaactatgatgatctcactgcttcattgcccgagaatgattgccgctatgcagtttacgactttgattttgtgacttctgagaattgtcagaagagcaagatcttttttattacatggtcaccgtctgtttcaaggatccgtgccaagatgctgtatgcaacatccaaggaaaggttcataagcgaattagagggcattcattatgaaatccaggcaactgacccgactgggatggatctggaggtgattagagagcgtgcaagttaaaaatgttgaaatcccgtcatcaatgccgcatgcttaggaaactccggtgtttaattattgttaaatgacacctaggaaggctgattaggagctcagggtgttcaaaacatgtcgggactttatgctcctcattccacatgatgattctgaggtgacaatggatgtgttattattgaatagtttgacccttcgttaatgaaaattttcatttcaatcacttgtcatgatgccttttgctattaaatttttgtacttttatatgagctgttgaaatatataaatagtaatctcc

SEQ ID NO: 325 - DNA, 861 bp, Citrus clementina
ctctcgttagtgaatatttttcttttacttggtttttttgaaaaataaaaacaatttttaattttctctctttggtgggttttttatttttttcttcttacttgccccctccttcgttttctcgtacaatttgttcaaagcagccatgtctttcagagggacaaatgcatcttctggaatgggagttgctgatcacagcaagagcacatacctagagttgcagaggaagaaagtacatcggtatgtgatttttaagattgatgagaagaaaaaggaggtagtggttgaaaagactggaggcccagctgagagctatgacgatttcactgcatctttgccggataatgactgtcgttatgcagtttatgactttgattttgtgacctcagagaattgtcagaaaagcaagatctttttcattgcatggtctcctgacgtgtcccgaatccgagctaagatgctgtatgcaacatcaaaggacaggttcaggagggagctggacggcatccactatgaaattcaggcaactgacccaagtgagatggatcttgaggtgatcagagaccgtgcacgctgagaatgcactgaaggaaaagaatttgtttccttgagactgcatttgtggtctgaaggcacaaactgtcctccaattagttgccgtatttgtgtggcacatagtacatatagctattgttaaataatcagcacctgagaaggctgataacgagctcatggctgaggcactgcgatgccagaggacatgggctctctattgccatgatgcttctcaggtaaaattggacatagacatggatacttatgctgttcgactttgcttaatgaaatgggtattctaattag

SEQ ID NO: 326 - DNA, 1072 bp, Gossypium hirsutum
cttttctttcctatttctcctttttggtggctgctttttccccttattttctctccataagaagtctttttctcttcattctcccaatatcttcatttgaagcagctatgtcttttagaggaggaaatgcatcatcgggcatgggagtggctgaacacagcaaaagcacgtacctggaactgcagagaaagaaggtgttccgatatgttatcttcaagattgatgagaagaaaaaggaggtcatagttgaaaagactggaggtccgacagagagctatgatgatttcgcagcctcattgccggagagtgattgccgctatgcagtttatgacttcgattttgtgacttccgagaattgtcagaagagcaagatcttttttattgcgtggtctccttctgtttcgaggatccgttccaagatgctttatgcaacatcaaaggacaggttccgaagggaattggagggcatccattacgaaatccaggcaaccgacccgactgaaatggatcttgaggtgattagggagcgtgcacattaagtgtccgctcccagaattcacatgcttaggaaaacttcctagaggtacctttagggttgttttatggttcaattaaattgcagaattaagtcgagttacccgactctgacatagtatgtcgttatcattaaataacgcctgagaaggctgattaggaggaggatcagggttggaacatgggaggaatgttgggactttggacttctcatttccatgatgcttctcaggtgaaaaggagtgtgattattatggatattgactcttattcgtggaatggtttttcaatctcttgtgcttttcatctgaaacttttctaattaattgaatataaaagtttctaagggtgataatggtttggtgtgattaagatatgggtcttttgattttaaaatatagggtaaagtacgagaaatagtcactgaactttatttttatttggtctactaaatcaaatatcttcgtcaatgaaggttgagagcagtttgaatagatgggcttttttattggtctaatatcagttttagtcttttaag

SEQ ID NO: 327 - DNA, 914 bp, Gossypium hirsutum
attggggtaaaaattttctttcctatttctcctttttggtggctgctttttcccttatttctctccataagaactctttttctcttcattctcccaatatcttcatttgaagcaactatgtcttttagaggaggaaatgcatcgtcgggcatgggagtggctgaacacagcaaaagcacgtacctggaactgcagaggaagaaggtgttccgatatgttatcttcaagattgatgagaagaaaaaggaggtcatagttgaaaagactggaggtccgacagagagctatgatgatttcgcagcctcattgccggagagtgattgccgctatgcagtttatgacttcgattttgtgacttccgagaattgtcagaagagcaagatcttttttattgcatggtctccttctgtttcgaggatccgttccaagatgctctatgcaacatcaaaggacaggttccgaagggaattggagggcatccattacgaaatccaggcaaccgacccgactgaaatggatctcgaggtgattagggagcgtgcacattaagcgtccactcccggaattcacatgcttaggaaaacttcctagaggtacctttagggttgttttatggttcaattaaattgcagaattaagtcgagttacccgtctctgacatagtatgtcgttatcattattaaataacgcctgagaaggctgattaggaggaggatcagggttggaacatgggaggaatgttgggactttggacttctcattgccatgatgcttctcaggtgaaaaggagtgtgattattatggatattgactcttattcgtggaatggtatttcaatctcttgtgcttttcatctgaaacttttctaattaattgaaatataaaagtttctaagggtgataatggtttggttt

SEQ ID NO: 328 - DNA, 1499 bp, Gossypium raimondii
gttgatgcgtcattgtaagaaaagaatcgaacaccacgcgcctccttccttgcctctcaaaacacgcacagatactctttaattaccatatttatctcaaaagaatcagaataaaaaatccttattttttaattaaaaattcaaaatagtttcaaaaattttctttccatttctcctttttggtggctgctttttccccttattttctctccataagaactctttttctcttcattctcccaatatcttcatttgaagcaactatgtcttttagaggaggaaatgcatcgtcgggcatgggagtggctgaacacagcaaaagcacgtacctggaactgcagaggaagaaggtgttccgatatgttatcttcaagattgatgagaagaaaaaggaggtcatagttgaaaagactggaggtccgacagagagctatgatgatttcgcagcctcattgccggagagtgattgccgctatgcagtttatgacttcgattttgtgacttccgagaattgtcagaagagcaagatcttttttattgcatggtctccttctgtttcgaggatccgttccaagatgctctatgcaacatcaaaggacaggttccgaagggaattggagggcatccattacgaaatccaggcaaccgacccgactgaaatggatcttgaggtgattagggagcgtgcacattaagcgtccgctcccggaattcacatgcttaggaaaacttcctagaggtacctttagggttgttttatggttcaattaaattgcagaattaagtcgagttacccgtctctgacatagtatgtcgttatcattaaataacgcctgagaaggctgattaggaggaggatcagggttggaacatgggaggaatgttgggactttggacttctcattgccatgatgcttctcaggtctccttctgcttcgaggatccgtttcaagatgctctgtgcaacatcaaatgacaggtttcgaagggaattgaaggccatccattatgaaatccaggcaatcgaccctactgaaatggatctcgaggtgattagggagcgtgcacattaagcgttcactcacggaattcacatgcttaggagaacttcctagaggtacctttagggttgttttatggttcaattaaattgcagaattaagtcgagttacctgtctctgacatagtatgtcgttatcattaaataacgcctgagaaggctgattaggaggaggaacatgggaggaatgttgggactttggacttctcatttccatgatgcttctcaggtgaaaacgagtgcgattattatggatattgaatcttattcgtggaatggtatttcaatctcttgtgcttttcatctgaaacttttctaaataattgaaatataaaagtttctaagggtggtaatggtttggtttgtgattaattaatgggtcttttgattttaaaatatatgggtcccctcctattgcgctctgtctgatgacgaacaa

SEQ ID NO: 329 - DNA, 818 bp, Vitis vinifera
cttcaaattcgtttcaaattttcctccttcggtggctgctttttcttctttgtttccctgaaattctctctctgcagatcgcatcaggcagctatgtcgttcagagggtcaaatgcttcatctggcatgggtgttgctgatcactgcaaagccacatacctggaactacagaggaaaaaggtgcaccgttatgtgatttttaagattgatgagaagaaaaaggaagttgtggtggaaaagactggtggtccagctgagagctatgatgatttcactgcttccttacctgagaatgattgccgctatgcaatttatgactttgattttgttacttctgagaactgccaaaagagcaagatattcttcattgcatggtccccttcagtatctcgaatccgtgccaagatgctgtatgctacatccaaagatcggttcaggcgggagctagagggcatccattatgagattcaggctactgacccgaccgagatggatcttgaagtgcttagagagcgtgcaaactgaacgcttgtgaatcaaggaggtttcagatcttgaaaacccttctagggttttttggtggccttaaaggacaaactttcctacttaagttaatagttgattatgtgcaatatctgttcctggcacaaggatataatctatacacatatatatagacaaacattaaataacttcacagctgggaaggctgattaggggtgcattgccaggatatcccaagtgcaggggaatcagggcttccttattgccatgatgcttctcaggtggaaatgggtatgttatttatattgatgatc

SEQ ID NO: 330 - DNA, 779 bp, Actinidia deliciosa
aagattatctccaaaaaaaaaaaaaaaaaaatcgaatttctctctcttcggtgactgcttttcaccgtactttcctctccacaagaaaccccccctctctctctctctctagtcttctgatcagcattagctatgtctttcagagggacaaatgcatcatctggcatgggtgttgccgatcacagcaagagcacatatctggaactgcagaggaagaaggtgcaccgttatgtgatctttaagattgatgagaagaaaaaagaggtggtggttgaaaagactggaggtccggctgagagctatgatgattttactgcatctctgccggagagtgattgccgatatgcagtctatgactttgattttgtgacttctgagaactgccaaaagagcaagatctttttcattgcatggtctccttccgtgtcccggatccgttccaagatgctatatgccacatccaaggacagtttcagacgagagctgcagggcatccattacgagattcaggccaccgacccaaccgagatggatcttgaagtcctgcgagaacgcgcaaactagaccctttctgatatatggaggggttacgagaaaactactgttcgtttctaccgacttatttgtcactgccttattactgtttctgacacaaaatatatatatatatatattagcttaaacaataaaagatttgcacctgggaaggctgatcttggaactctagggttccttactgtcatgatgcttcccagatggaaaatgggcatgcttatggg

SEQ ID NO: 331 - DNA, 863 bp, Citrus sinensis
ctctcgttagtgaatatttttcttttacttggttttttttgaaaaaataaaaacaatttttaattttctctcattggtgggttttttattttttccttcttacttgccccctccttcgttttctcttgcaatttgttcaaagcagccatgtctttcagagggacaaatgcatcttctggaatgggagttgctgatcacagcaagagcacatacctagagttgcagaggaagaaagtacatcggtatgtgatttttaagattgatgagaagaaaaaggaggtagtggttgaaaagactggaggcccagctgagagctatgacgatttcactgcatctttgccggataatgactgtcgttatgcagtttatgactttgattttgtgacctcagagaattgtcagaaaagcaagatctttttcattgcatggtctcctgacgtgtcccgaatccgagctaagatgctgtatgcaacatcaaaggacaggttcaggagggagctggacggcatccactatgaaattcaggcaactgacccaagtgagatggatcttgaggtgatcagagaccgtgcacgctgagaattcaccgaaggaaaagaatttgtttccttgagactgcatttgtggtctgaaggcacaaactgtcctccaattagttgccgtatttgtgtggcacatagtacatatagctattgttaaataatcagcacctgagaaggctgataacgagctcatggctgaggcactgcgatgccagaggacacgggctctctattgccatgatgcttctcaggtaaaattggacatggtcatggatacttatgctgttcgacttttcttaatgaaatgggtattctaattag

SEQ ID NO: 332 - DNA, 794 bp, Camellia sinensis
tcctactttcctcttccttgatatccttttctctctaaaaattctctctctctctctctctctctctcgatcaccatcagcaatgtctttcagaggggcgaatgcatcatctggcatgggtgtcgctgatcacagcaagagcacatatctggaactgcagaggaaaaaggtataccgttacgtgatctttaagattgatgagaagaaaaaagaggttgtggttgaaaagactggaggtccagctgagagttatgacgattttactgcatctctgcctgagaatgattgccgatatgcagtctatgactacgattttgtgacttctgagaactgccaaaagagcaagatctttttcattgcatggtcgcctgctgtgtctcggatccgtgccaagatgctgtatgcgacatccaaggacaggttcagaagggagctggagggcatccattacgagattcaggccactgacccaacggagatggatcttgaagtgattcaagaccgcgctaactagacccttgctactgtatagagggggcttcgcatcgtaagcaaaactgctttcatttctatgcaacttattagttactgttcatgagcaatgcctgtttctgacacaaaaatacatatatagcttaatctataaataacaacgcctgggaacgctgatcttggagctctcggcttaataaaccataagatccgtggagtcttgggttccttattgtcatgatgcttcccagatggaaaatgggcctggttatgtatacagatgatttaactgctaattatat

SEQ ID NO: 333 - DNA, 940 bp, Fagus grandifolia
cactagaataatggcggtcctagaaaagaatagatgacgcggctcttttcttttcttttctttgaaaacacgaatcttgttccttctcaaccaaatcccacacaaacagaatatatatatatatatatatatatatatttatcttctacagttccttcttcactgtcctttctttttctccttctttcctctccatacattgcgaccgaagtagccatgtctttcagaggaacaaatgcttcgtctggcatgggcgttgctgagcacagcaagaccacataccttgaactgcagaggaagaaggtgcaccgctatgtgattttcaagatcgatgagaagaaaaaagaggttgtggttgaaaaaactggcggcccagctgagagctacgatgatttcactgcttctttgccagagaatgattgccgatatgcaatttatgactttgactttgtgacttctgagaactgccagaagagcaagattatttttatgcatggtctccttctgtatccaggatccgtgccaagatgctgtatgcaacatcaaaggataggttcagaagggagctggagggcatccattatgagatccaggcaactgacccaactgagatggatcttgaagtcatcagggaccgtgcaaactgagcacaaagggctcccttattagagaaacacccaggggtgacctaaagaaacgcattttcctctttcaattagttgctgattatgtgcactatctgttactgacacaaattacatatagcttaactattaaataatggcacctgggaaggctgattaggggctcgtggctatgataccccgtacaggagaatttgggctcccttattgccatgatgcttctcaggtgaaattgttatgttgtgtattgataacatgactaatgttctataatgtggatgttgtatcagtgggtc

SEQ ID NO: 334 - DNA, 925 bp, Castanea mollissima
cggtcctggttttatgagaaaagattagacggagattgatgacgcggcactctctttactttacttaactttcccttcaaaactcgaatcttttcttctttctctcccaaattcccaaaccacacaaacataaattttcttttatttattcgtttgtttcttctacaacttcttctccatacaatacattctctaaaatctctctccagccatgtctctcagaggaacaaatgcttcttctggcatgggtgttgctgagcaaagcaagaccacattccttgaactgcaaaggaagaaggtgcaccgctatgtgattttcaagattgatgagaagaaaaaagaggttgtggtcgaaaaaactgggggcccagctgagagctatgatgatttcactgcttctttgccagagaatgattgtcgatatgcagtttatgactttgactttgtgacttctgagaactgccagaagagcaagatattttttattgcatggtctccttctgtatccaggatccgtgccaagatgctgtatgcaacatcaaaggataggttcagaagggagctggagggcatccattatgagatccaggcaactgaccctactgagatggatcttgaagtccttagggaccgtgctaactgagcacttagagaaacacccaggggtgaccaagagaaacgcattttcctgcttcaattagttgctgattatgtgcactatctgttactgacacaagttacatatagcataactattaaataattggcacctgggaaggctgattaggggctcgtggtatgatacccagtacaggggaattttgggctcccttattgccatgatgcttctcaggtgttatatgggtatgttgtgtatggataacgtgactactgttctatggtatggatcttttatcaatgggtc

SEQ ID NO: 335 - DNA, 836 bp, Theobroma cacao
cttctttctggtggctgctttttctccttattttctctccataagaactctctctttgtccccttctctccaaaaatacccactttatttcttcatttgaagcagccatggcttttagaagagcaaatgcatcatctggcatgggagtggctgaacacagcaaaagcacatacatggagctgcagaggaagaaggtgttccgatatgtgatctttaagattgatgagaagaaaaatgaggttgtagtggaaaagactgggggtccagctgagagctatgatgatttcactgcctcaatgcctgagaatgattgccgatatgcagtttatgactttgattttgtgacttctgagaactgccagaagagcaagatctttttcattgcatggtctccttctgtttcaaggatccgttccaagatgctttacgcaacatcgaaggacaggttcaggagggaactggagggcattcattatgaaatccaggcaactgaccccactgaaatggatcttgaggtgatcagggagcgtgcacgttaagcattcactcccgttcatgggtttcacatgcttaggaaactccctagagttgcttttaggatcgtttcctgcttcagctagttgctgaattaagtgcggttatctgtctctcacagtacatatgtcgtgaatttgtcaacgttaaataacaccttgggaaggctgatttggagctcggggctcaaacatctgaggtatgttgggactttgggctcctcattgccatgatgcttctcaggtgaaaatgggtgtgattatggatacttgactcttattaatgaaatggtttttcaatca

SEQ ID NO: 336 - DNA, 1022 bp, Castanea mollissima
ctttactttacttaactttcccttcaaaactcgaatcttttcttctttctctcccaaattcccaaaccacacaaacataaattttcttttatttattcacttgtttcttctacaacttcttctccatacaatacattctctaaaatctctctccagccatgtctctcagaggaacaaatgcttcttctggcatgggtgttgctgagcaaagcaagaccacattccttgaactgcaaaggaagaaggtgcaccgctatgtgattttcaagattgatgagaagaaaaaagaggttgtggtcgaaaaaactgggggcccagctgagagctatgatgatttcactgcttctttgccagagaatgattgtcgatatgcagtttatgactttgactttgtgacttctgagaactgccagaagagcaagatattttttattgcatggtctccttctgtatccaggatccgtgccaagatgctgtatgcaacatcaaaggataggttcagaagggagctggagggcatccattatgagatccaggcaactgaccctactgagatggatcttgaagtccttagggaccgtgctaactgagcacttagagaaacacccaggggtgaccaagagaaacgcattttcctgcttcaattagttgctgattatgtgcactatctgttactgacacaagttacatatagcataactattaaataattggcacctgggaaggctgattaggggctcgtggtatgatacccagtacaggggaattttgggctcccttattgccatgatgcttctcaggtgttatatgggtatgttgtgtatggataacgtgactactgttctatggtatggatcttttatcaatgggtctcttgagttcattttatttcataatcttggaaatttatggcttttggaacatactatactggacctaggtggtgtccttactgacttacagattttagcaggggatctctagttttgtaggcaaattctagtactgcatatgatattgca

SEQ ID NO: 337 - DNA, 811 bp, Gossypium hirsutum
tggtggctgctttttccccttattttctctccataagaactctttttctcttcattctcccaatatcttcatttgaagcaactatgtcttttagaggaggaaatgcatcgtcgggcatgggagtggctgaacacagcaaaagcacgtacctggaactgcagaggaagaaggtgttccgatatgttatcttcaagattgatgagaagaaaaaggaggtcatagttgaaaagattggaggtccgacagagagctatgatgatttcgcagcctcattgccggagagtgattgccgctatgcagtttatgacttcgattttgtgacttccgagaattgtcagaagagcaagatcttttttattgcatggtctccttctgtttcgaggatccgttccaagatgctctatgcaacatcaaaggacaggttccgaagggaattggagggcatccattacgaaatccaggcaaccgacccgactgaaatggatctcgaggtgattagggagcgtgcacattaagcgtccactcccggaattcacatgcttaggaaaacttcctagaggctgattaggaggaggatcagggttggaacatgggaggaatgttgggactttggacttctcattgccatgatgcttctcaggtgaaaaggagtgtgattattatggatattgactcttattcgtggaatggtatttcaatctcttgtgcttttcatctgaaacttttctaattaattgaaatataaaagtttctaagggtgataatggtttggtttgtgattaatatatgggtcttttgattttaaaatata

SEQ ID NO: 338 - DNA, 1137 bp, Gossypium raimondii
gaagttgatgcgtcattgtaagaaaagaatcgaacaccacgcgcctccttccttgcctctcaaaacacgcacagatactctttaattaccatatttatctcaaaagaatcagaataaaaaatccttattttttaattaaaaattcaaaatagtttcaaaaattttctttccatttctcctttttggtggctgcttttttccccttattttctctccataagaactctttttctcttcattctcccaatatcttcatttgaagcaactatgtcttttagaggaggaaatgcatcgtcgggcatgggagtggctgaacacagcaaaagcacgtacctggaactgcagaggaagaaggtgttccgatatgttatcttcaagattgatgagaagaaaaaggaggtcatagttgaaaagactggaggtccgacagagagctatgatgatttcgcagcctcattgccggagagtgattgccgctatgcagtttatgacttcgattttgtgacttccgagaattgtcagaagagcaagatcttttttattgcatggtctccttctggttcgaggatccgttccaagatgctctatgcaacatcaaaggacaggttccgaagggaattggagggcatccattacgaaatccaggcaaccgacccgactgaaatggatctcgaggtgattagggagcgtgcacattaagcgtccactcccggaattcacatgcttaggaaaacttcctagaggctgattaggaggaggatcagggttggaacatgggaggaatgttgggactttggacttctcattgccatgatgcttctcaggtgaaaacgagtgtgattattatggatattgactcttattcgtggaatggtatttcaatctcttgtgcttttcatctgaaacttttctaattaattgaaatataaaagtttctaagggtgataatggtttggtttgtgattaatatatgggtcttttgattttaaaatatagggtaaggtaggagaaatagtcactgaacttttattttttattttggtcacaaaatcagtttgaatattaatagaagtttgatgtgggcttttttcattggtctaatatcagttttagtcttctaatgtttatacattttat

SEQ ID NO: 339 - DNA, 860 bp, Actinidia deliciosa
tataccccacgtctctctctaaaaagcagataatatttgtcaagattatctcccccaaaaaaattcgaatctctctcttctgtggctgcctttcaccctactttcctcttcgcaagaccctctctctctccacattcttctaatcagcattagctatgtctttcagagggacaaatgcatcatctggcatgggtgttgccgatcacagcaagagcacatatctggaactgcagaggaagaaggtgcaccgttatgtgatctttaagattgatgagaagaaaaaagaggttgtggttgaaaagactggatgtccagctgagagctatgatgattttactgcatctcttcctgagagtgattgtcgatacgcagtctatgactttgattatgtgacatctgagaactgccaaaagagcaagatctttttcattgcatggtctccttccgtgtcccggatccgtgccaagatgctgtatgccacatccaaggacaggttcagaagagagctgcagggcatccactacgagattcaggccaccgacccaaccgagatggatcttgaagtcctgcaagaacgggccaactagaccctttctgttgcatagaggggttacgcgaaaactactgttcggttctactgacttattagtcactgcttattactgtatctgacacgaaatatatatatgagcttaaaaaataaaatatttgcatctgggaaggctgatcttggagctctaggttgattgggttccttactttcatgatgtttcccagatggaaaatgggcatgcttatgggaaccgatgattatactattaataatatattctatataataaggtgtttaaaaaaaaaaa

SEQ ID NO: 340 - DNA, 1140 bp, Quercus alba
ggcactctctttactttacttaactttcccttcaaaactcgaatctttgttctttacacaaaacaaacacactaaatttttttttattttttttttatatttgtttctacaacttcttcttcttcttcttcttcttcttctccagacaatacattctctaaaatctctctctctccagccatgtctctcagaggaacaaatgcttcttctggcatgggtgtcgctgagcaaagcaagaccacattccttgaactgcaaaggaagaaggtgcaccgctatgtgattttcaagatcgatgagaagaaaaaagaggttgtggtcgaaaaaactgggggcccagctgagagctatgatgatttcactgcttctttgccagagaatgattgtcgatatgcagtttatgactttgactttgtgacttctgagaactgccagaagagcaagatattttttattgcatggtctccttctgtatccaggatccgtgccaagatgctgtatgcaacatcaaaggataggttcagaagggagctggagggcatccattatgagatccaggcaactgaccccactgagatggatcttgaagtccttagggaccgtgctaactgagcacttagagaaacacccaggggtgaccaaaagaaacgcattttcctgcttcaattagttgctgattatgtgcactatctgttactgacacaaattacatatagcttaactattaaataattggcacctgggaaggctgattaggggctcgtggtatgatacccagtacaggggaattttgggctcccttattgccatgatgcttctcaggtgttatatgggtatgttgtgtatggataacgtgactgctgttctatggtatggatattttatcagtgggtctcttgagttcattttatttcataatcttggaaattcatggctttttgaacagactatactggacctaggtggtttccttactgactgacagattttagccggggatctctagttttgtaggcaaattctagtaatgcatatgatattgcagttttggcttggaaagaacttgcttgctgccaatgttttttgccttttatgtgtattgttcaaatccagaactttcgattaatcaggacacgcgag

SEQ ID NO: 341 - DNA, 859 bp, Carica papaya
ctctttttctctccgtagatttctctggcctcttcctttctctcttcaatttcccttcgctctcaactgtttctgcacagcagccatgtctttcagagggacaaatgcttcatctgggatgggtgttgctgaacacagcaaaagcacattcttggagctgcagaggaaaaaggtgcatcgctatgtgatcttcaggattgatgagaagaaaaaagaggttgtagttgaaaagactggcggcccagctgagagctatgatgatttcactgcttcattgcctgacaatgactgtcgatatgcagtttatgactttgattttgtgacttcagagaattgccagaaaagcaagatctttttcattgcatggtctccttctgtgtctcggattcgtgcaaagatgctttacgcaacatccaaggacagatttcgaagggagctggatggcattcactatgaaatccaggccactgacccgactgaaatggacctcgaggtgctcagagaacgtgcacactgagtattgtacaacctaaaggaacaggtcctttgttgtttgggttagctgccaatcatatgtgtaggaattgtatccaacacagaatacatacataaatatatataaataggttaagtattaataatacttgggaaggctgatcaggagctcattgtgacacctggggttgtgggatggtgggctccttattgccatgatgcttctcaggtgataatgggtgtggctatggattgttaatggaattggcactttgtattacttgtgacttgctttccaacttgagtttccatcaggactcaacgagtgggagaccatgaaaaaatatattttattgtttcagct

SEQ ID NO: 342 - DNA, 855 bp, Sarracenia psittacina
ttttgttggtgccttttattctactttactctcagacagctcttttgtcgctttggctctccctctctctctagtcttttgatcggcatcagctatgtctttcagaggggcaaatgcatcatctggcatgggtgtcgataatcacagcaagagcacatatctggaactgcaaaggaagaaggtgcaccgttatgttatctttaagatcgatgagaagaaaaagaggttgttgttgaaaagactggaggcccagctgagagttatgatgattttactgcatcactgcctgaaaatgattgtcgatatgctgtctatgactttgattttgtgacttctgagaactgccaaaagagcaagatctttttcattacatggtctccttctgtgtcccggatccgtgccaagatgttgtatgcaacatccaaggacaggttcagaagggagctggagggcatccattacgagattcaagccactgatccgactgagatggatcttgaagtgctgcaagagcgtgcgaattagacctcctctctctctctcttccatggaagggttttgagtcgtaagagaatctgttttcctttctatgtagacttaaaaggattgcattttgcttcaactagttgctgtttatatgcagtttctgtttctgactaaaaatatggctaagtgatggatctttcccttaaatcatgtttctctggagcatgtattgaaggccatcggatatggccgttagatatgtctcaagactcatgtctcgagtattttacatgatccaactttatttactaatgctatttaaggcggttagatgtggccgttggatatgtctcgagatgtccatatctt

SEQ ID NO: 343 - DNA, 1132 bp, Eucalyptus grandis
gaaaaaactcgaatctctccccgctccccttttcctctcgcccacaccaccaccaccaccaccaccaccccaccttccaacgaatatatctctttcgcctttttctcattttcccgttgataatttctcgtcttcctggtggtcgctgatccgatcttcctccccatttctcctccatacgctctctctctctctctctctctctttctctctctatctctctgtagctacagtgtggtaagagatcagccatgtcgttcagagggagcaatgcttcatcgggaatgggtgttgctgaacacagcaaaaccacttatctggaactgcagaggaagaaggttcaccgctatgtgatttttaagatcgatgagaagaaaaaagaggttgtggttgagaagaccggaggtccagctgaaagctatgaagatttcacctccgctttgccggagaatgactgccgatatgctgtctatgacttcgactttgtaactgctgaaaactgtcaaaagagcaagatctttttcatcgcgtggtccccttctgtgtctcgtattcgtgccaagatgttgtacgcaacatccaaggacaggttccgaagggagctcgagggtatccattatgagatccaagcaaccgaccctactgaaatggatcttgaagttatcagagaacgggcgaactaggggtcgctttgctctcgtgcaaaagaaagaaaagtaaggggttattgtttactttctgcgagccttagtttctgatcatgtgggatatctctccgacactaaaagtatatgtaagacaaacaactaactctctaaataatcaccacccgggaagactgactaggtgctgctccacgatacacccttagttatgggggatgcgagcttctgtagccgtgatgcttctcgggtgaaaattggttgtgcggatattgttgatggcaaatgatatggctttgcttgatattgatgcaaaggaaatagtacattgtcattggctttgtgttaggtttttagtgattacgacagggacgtcctagaaactatagtttcttcaatggaagacatgcaacatctacaaccaccattcatccctgattccagaaacactagctcaatttttttgtgta

SEQ ID NO: 344 - DNA, 1075 bp, Panax ginseng
gaaaaaaagaagcagcagagaatattaattgaattattatctttgaaaacatttaactcccatttgtatttattctcttcggtggttgtcttttattctactttcctctccataaaaagtattttccctctctttatttctctgttttttcttcattatataaaaaactaagaacacaatctttgcaaccaaatccagtggctatgtctttcagagggacaaatgcatcatctggcatgggtgttgctgatcaaagtaaaagcacatacctggaactgcagaggaagaaggtgcaccgttatttaatttttaagattgatgagaagaagaaagaggtggtggtcgaaaagactggaggtccagctgagagctatgatgacttcactgcatctctacccgagaatgattgccgatatgcagtctatgactatgattttgtgacttctgagaattgccaaaagagcaagatcttctttattgcatggtctccttccgtgtcccgcattcgtgccaaaatgttgtacgccacatccaaggacaggtttagaagggagctgcagggcatccattatgagattcaagccactgacccaactgagatggagctcgaagtgctccaggagcgtgctaactaaacccttttcttgttaaaaggtgtttatggttttagtaatctatgtgctctaatggcaacctaaacgaatggttctttattcagcttgttactttttatgtgcagtacctgtttctgacaccaaatatgatatctaaataatttagaacctgggaaggctgatcaggagcacttgtctccttattgtcatgatgcttctcagatggtgaaaggaatgctgtatggataatgataattcgacttctaattatgtattgattcattggttcttctgtttgaaattttggattcttaatatacacctgaggcagctgcttgttgcaacaattattagctacaatgttatgtttggattgtatgaatcaagatggaagatgggaatagaatgtcttgtttctgtggaataataatttcattcttttaacttaatactatttctcc

SEQ ID NO: 345 - DNA, 838 bp, Tripterygium wilfordii
aatttctcgcctctcggtttcttttcttttcagtctcgagtctaaaataaaacgaaaagcgaattaaattaaatccaccttttgtttcttctggtttcgtggttgcgttttctcctctttcctctctccataaccataagagctctctctctcctgtctctgttgtttgattccgtcagccatgtctttccgaggggcaaatgcttcatctggcatgggtgttgctgaggacagcaaaagcacataccttgaactgcagaggaagaaagtacaccgctatgtaatctttaaaattgatgagaagaaaaatgaagtcgtggttgagaaaaccggcggcccagctgagacctatgatgattttactgcttcaatgcctgagaatgattgccgatatgctagtttatgacttcgactttgtgacttctgagaactgccaaaagagcaagattctttttcattgcatggtctccatctgtgtcccggattcgttccaaaatgctgtatgcaacatccaagggcaggttcagaagggaacttgagggcgttcattatgaaattcaggcaactgatccaaccgagatggagcttgaagttatcagagaacgtgcgaactgaacatatacttcatatcacacagcttaatatgttaaaagtatcagcacttgcgaagactgatgaggagctcatttctaatacgctggtgtgatggaatttgagctccttgctgccgtgatgcttcgctaggtgaagtttacgagtactagtataaattgttatggttgttccaacgttccaaggggtctttcttagtaaaggtcttaggtgacttggtgtggtt

SEQ ID NO: 346 - DNA, 425 bp, Aquilegia formosa
tcaaatgcttcttctggcatgggagtatctgatcaaagcaagagtacttttttggagctgaaaaggaagaaggtgcatcgctatgtgatttttaagatcgacgagaagaaaaaggaggttgtggtggagaagactggaggtccagctgagaactatgatgattttactgcctcgttgcccgaaaatgattgtcgctatgcagtctatgactttgactttgtaacttcagagaactgccaaaagagcaagatcttcttcattgcttggtctccttccgtctctcgcattcgagctaagatgttgtatgctacatccaaagagaggtttaggcgtgagcttgatggtatccattatgagattcaagccactgatcctactgagatggaccttgaagtgatcagagaccgtgcacactagacaatttc

SEQ ID NO: 347 - DNA, 957 bp, Manihot esculenta
tggtggctctttttttttttccccaatttcctcttcttctccaggctatttcttctcttaactctctactgttttgcgctccttaggaactctttctttttcttagcggctatggctttcagaggggcaaatgcttcttctggcatgggcgttgctgagcacagcaaagcgacatttctagaactgcagagaaagaaggtccaccgttatgttatctttaagattgatgagaagaaaaaagaggttgtggttgagaagactggagggccagctgagagttatgatgactttactgcttccttgcctgagaatgattgccgatatgctgtctacgactttgattttgtgacttctgagaactgccagaagagcaagatcttcttcattgcatggtctcctgctgtttctcgcattcgtgcaaaaatgctttatgcaacttcgaaggacaggttcagaagagaactggaaggcatccattatgcaatccaggcaactgatccaactgagatggatctcgaggtactcagagaccgtgcacactgagcgctcactgtggatctaagtgttccaaatcttcaggagttacacgtgcaacctggaggaaattcgtatattgctagttacttcagttagttgataattacgtgtcatgtgtctcaggcacaaatacataaatcttaattgtactaaataattgacgtctgagaaggctgatcgggagttcttgggcatggacaaatttgagctccttattgccatgatgcttctcagttgataattggacatggttttgcatattaatttttaatcttcaaagtactgttatactttgatatcaagtgttgctttcgagcatagatgaatagatgattgaatcctggattattttgtcattttgtttagaaagtgaccagataaaatactggattctagataaaggtagcgactgttggatgc

SEQ ID NO: 348 - DNA, 853 bp, Panax ginseng
aagcagtggtatcaacgcagagtacatggggactttcctctccataaaaagtattttccctctctttatttctctgttttttcttcattatataaaaaactaagaacacaatctttacaaccaaatccagtggctatgtctttcagagggacaaatgcatcatctggcatgggtgttactgatcaaagtaaaagcacatacctggaactgcagaggaagaaggtgcaccgttatttaatttttaagattgatgagaaaaagaaagaggtggtggtcgaaaagactggaggtccagctgagagctatgatgacttcactgcatccctacccgagaatgattgccgatatgcagtctatgactatgattttgtgacttctgagaattgccaaaagagcaagatcttctttattgcatggtctccttccgtgtcccgcattcgtgccaaaatgttgtacgccacatccaaggacaggtttagaagggagctgcagggcatccattatgagattcaagccactgacccaactgagatggagcttgaagtgctccaggagcgtgctaattaaacccttttcttgttaaaaggtgtttatggttttagtaatgtatgtgctctattcgcaacctaaacgaatggttctttattcagcttgttactttttatgtgcagtacctgtttctgacaccaaatatgatatataaatacaaagcttaatctaaataatttagaacctgggaaggctgatcaggagcacttgtctccttattgacatgatgcttctcagatggtgaaaggaatgctgtatggataatttcacataaaggtgaaattcactttatgtttatataaaa

SEQ ID NO: 349 - DNA, 813 bp, Platanus occidentalis
gcaaaccagtagctcgcccatctcgcggattttctttcttcatttgcttttgtcagagttctttctcttctttggtttcgattcaaagccatgtcgttcagagggacaaatgcttcttctggcatgggagtggctgatcacagtaaaagcacatttttggaactgaagagaaagaaggtgcaccgctatgtgatttttaagattgacgaaaagaaaaaggaagttgtggttgagaagactggaggtccagctgagagctatgatgatttcacagccgcgttgcctgagaatgattgccgatatgcagtctatgactttgattttgtgacttctgagaattgccaaaagagcaaaatcttcttcatcgcatggtcaccttcagtttctcgcatccgttccaagatgttgtatgccacatccaaggacaggatccggcgcgagctcgacggtatccactatgagattcaggctactgaccctacggagatggatatggaagtgatcagagaccgtgcacactgagcattctctgtagctcacagggttttgcatcataaacagcagctaggctttgggaatgaagaacaaaaaacgcttccctgcttcagttagttacagtatctgtttgactcaagacatatgactttatcattaaataaatccacaccctgggaaggctgatagggagcccttgtctaagatattttgagtattgggatctcgggcttccttgttatcatgatgcttctcagatgactgtgggtttagttatggatgttgatgaatcgactctgaaatatatattatataaaa

SEQ ID NO: 350 - DNA, 731 bp, Primula obconica
ggccattacggcaaaaagtctgatcagcatcatcagctatgtctttcagagggacaaatgcttcctctggcatgggagttgcagacctctgtaaaagcacatacttggaattgcagagaaaaaaagttcaccgttatgtgatctttaagattgatgagaagaaaaaagaggtggtggtcgataaaactggaactccagctgagagttacgatgattttactgcatctttgcctgaaaatgattgccgatttgctgtatacgattatgatttcgtgacgtctgagaactgccaaaagagcaaaatctttttcattgcgtggtctccttccgtgtcacgtatccgtgcgaaaatgctgtatgcgacatccaagcaaaggttcagaagggagttagaaggcattcattacgagatacaggccaccgatccctcggagatggaccttgaagtgatccaagagcgagctaactgaacctcgctcataaaaccactttactctttgttcacctttgttatatgtacgactgtttctgatgatacaaatacatatcatagcgtgcccgtaaataatttgacatctgtgtaatgctgatcaggaatcgctatatgcttctcagatgggatatggtgttgtttaatgcctaattactcgtattcagctactaaataccatatttactgtgcttatgttcttatgcttaactgcttattgatttctcaaatggggattttg

SEQ ID NO: 351 - DNA, 691 bp, Tabernaemontana elegans
actattctcttgtccaaaagcagacagcccacttacacacatctctctcgaaagagcagccatgtctttcagaggaacaaatgcgtcgtccggcatgggggtcgccgaacatagcaaaagcacatatatggaactgcaaaggaagaaggtgcatcgatatgtgatttttaagattgatgagaagaaaaaagaggtggtggtcgaaaagactggaagcccatctgagagctatgaagatttcactgcatctctgcctgagaatgattgccgatatgcagtctatgactacgattttgtaacttctgaaaattgtcaaaaaagcaagatcttttttatagcatggtctccttctgtctcccggattcgtgcaaaaatgctgtatgccacatccaaggataggttcagaagggagctgaacggaatccattacgagatacaggccactgacccaactgaaatggagcttgatgttctcagagagagggctaattgaagcattgctatctatcttgcaatggcttttttggtctctggaagaatgactcctatgtaatcttaacccaaaaatgtgcatcgtgcttcaaatattaggtctgtgcagaacctgtttctggcacaaaatatacatggcttattcataaataattttgttcctgggaaggctgattaggagctcttgccagaagtctcc

SEQ ID NO: 352 - DNA, 879 bp, Vaccinium corymbosum
ctcctaaaaaattctttctctctccctggtcttcttctgatcagcattagccatgtctttcagagggattggtcagacaaatgcatcatctggcatgggtgtcgcggatcactgcaagagcacatatctggaattgcagaggaagaaggtgcaccgctatgtgatctttaagattgatgagaagaaaaaagaggttgtggttgaaaagactggaggtccagctgagagctatgatgattttactgcatctttgcctgagaacgattgccgatatgcagtgtatgactatgactttgtgacgtctgagaactgccagaagagcaaaatatttttctttgcctggtctccttctgtgtcccggattcgtgccaagatgttgtatgccacatccaaggagcgattcaggagggagttcgagggcatccattatgagattcaggccactgacccaactgaaatggatctcgaagttctgcaagaccgtgcaaactagacccttttcgcttgtatagagggtttttgcatcgcaagagaagcttcttttcttttgcaacttactctttatgtaaaagtaatacatatagcttaaacaaataaatgacttggcatctggggttgctgatcttggagcctctgttggcgtttgcttcgtttagccctaaaaaagttctgggtgcccagcggggttctttatcatcatgatgcttcctagatgtaaaatgggcgcttaagagtactgttgtttgaccgcttactaatcacatatgctattattatttggatgaatcatgaggatcttgtgatcatttcattttcttactagaagagtccaacttgaggtccgaatcaatatgggcttccctacccttgaaatgttgg

SEQ ID NO: 353 - DNA, 849 bp, Vaccinium corymbosum
gatcagcattagccatgtctttcagagggattggtcagacaaatgcgtcatctggcatgggggtcgcagatcactgcaagagcacatatctggaactgcagaggaagaaggtgcaccgctacgtgatctttaagattgatgagaagaaaaaagaggttgtggttgaaaagactggaggtccagctgaaagctatgacgattttactgcatctttgcctgagaacgattgccgatacgcagtgtatgactatgactttgtgacatctgaaaactgccagaagagcaaaatattcttctttgcctggtctccttctgtgtcccggattcgtgccaagatgttgtatgccacatccaaggagcgattcaggagggagttcgagggcatccattatgagattcaggccactgacccgactgaaatggatctcgaagtgctgcaagaccgtgcaaactagacccttttcgcttgtatagagggttttcgcatcgcaagagaagcttcttttcttttgcaacttactctttatgtaaaagtaatacatatagcttaaacaaataaatgacttggcatctggggttgctgatcttggagcctctgttggcgtttgcttcgtttagccctaaaaaagttctgggtgcccagcggggttctttatcatcatgatgcttcccagatgtaaaatgggcgcttaagagtactgttgtttgaccgcttactaatcacatatgctattattatttggatgaatcatgaggatcttgtgatcatttcattttctactagaagagtccaatttgaggtccgaatcaatatgggcttccctacccttgaatgttggttttttgttg

SEQ ID NO: 354 - DNA, 873 bp, Platanus occidentalis
cgaagaaaatccagcattttatctctgctgttcttgcttatctgtttttgttttccttagttttgttgttctctcatctcttgttcggttcagattcgtagccatgtcgttcagagggacaaatgcttcttctggtatgggagtggctgatcacagtaaaaacacatttttggaactgaagagaaagaaggtgcaccgttatgtgattttcaaaattgatgaaaagaaaaaggaagttgtggttgagaagactggaggtccagctgagagctatgatgatttcactgcagctttgcctgagaatgattgccgatatgcaatctatgactttgattttgtgacttctgagaattgaccaaaagagcaagatcttctttattgcttggtcgccttcagtttctcgaatccgttccaagatgctgtatgcaacttctaaggacaggttccggcgggagcttgatggtatccactatgagattcaggctactgaccctacagagatggatctggaagtgctcagagagcgtgcaaactgagcagtctctgtagttctaagggggtgttctgtatcaatcgctggcttagattttaccgatgacggattccctgcttcaattaattactgattatgtgcagtatctatttctgacatgaaacatatggctctatctaaataattcagcacctgggaaggctgatgggaagcccttgtctgaagatatatcgagcaccgggaacttgggttctcttgttatcatgatgcttctcagatgaaagcgggtttggttatgggtatttatgaatcgactctggagtatatgttatataaaatgggtatttgattagtaagactatctgctcttttctgattac

SEQ ID NO: 355 - DNA, 874 bp, Amsonia hubrichtii
ttttctccattgttgcactctattattcttttgtccagaagcaaacagcccacttacacacaactctctcgacagacgacagcagcaaccatgtctttcagaggaacaaatgcatcatctggtatgggtgtcgctgaacatagcagaagcgcatatatggaactgcaaaggaagaaggtgcatcgctatgtgatttttaagattgatgagaagaaaaaagaggtggtggttgaaaagactggaagcccatctgagagctatgaagatttcactgcatctctgcctgagaatgattgccgatatgcagtctatgactatgattttgtaacttctgaaaactgtcaaaagagcaagatctttttcatagcatggtctccttctgtctcccgcattcgtgcaaaaatgctgtatgccacatccaaggataggttcagaagggagctggagggaatccattatgagatacaggccactgacccaactgaaatggagcttgatgttctcagagagcgagctaattaaccaactgcaatggtcttttgtctccggaagaatgaccttatgtaaacttgccaaaaaaaaaatgcatcttgcttcaaatattaggcctgttgcataacctgtttctggcacaaaatacatatggcttaatcataaataattttgttcctgggaaggctgattaggagctcatgccaaaagtctcccaacttttgggggttatccttccttctgatgatgcttcccagatgaaaaagggtatggttattatatggatgctgattatatgtcatatcaattacaatgtatctattatatcagtgacaatattctgcttattttcattttagtggtgtggtatcaatgacatacc

SEQ ID NO: 356 - DNA, 713 bp, Olea europaea
ggcaaatgcttcatctggcatgggcgttgctgatcacagcaaaagcacatacatggaattgcaaaggaagaaagtgtatcggtatgtgatctttaagattgatgagaagaaaaaggaggtcattgttgaaaagactggcagtccagctgagggctatgatgatttcactgcatcgctccctgggaatgattgtcgatatgcagtttatgactttgattacgtcacttctgagaactgccaaaaaagcaagatcttttttatagcatggtctccttctgtgtctcggatccgtgccaagatgctttatgccacatccaaggaaaggttccgcagggagctgcaaggtatacattatgagattcaggccaccgacccaactgagatggaccttgaagtgatcagagagcgtgctacttaagaacttttgccttgtgcaagatgatggtttcttttcttgggaaaaggtgctacactttagtatcaacataaacaaatatgtcttctattggtagtgttaatggcttaatcatgtataaataaatacgacactgggaaggctgattaggaattccgacatatatcccagattgtggggtttatgcaattcctcattctcatgatgcttcccagacagaaaaacgtgtgggattatggatgttaacagcttgatatatcagtaatcaaactgttaacggttattgttttgtgatttc

SEQ ID NO: 357 - DNA, 811 bp, Manihot esculenta
atggcgactacggctttcagaggggcaaatgcttcttctggcatgggcgttgctgaccacagcaaagccacatacctagaactgcagagaaagaaggtgcaccgttatgtggtctttaagattgatgagaagaaaaaagaggttgtggttgagaagactggagggccagctgagagctatgatgattttactgcttccttgcctgagaatgattgtcgatatgctgtctatgactttgattttgtgacttctgagaattgccagaagagcaagatcttcttcattgcatggtctccttctgtgtctcgcattcgtgcaaaaatgctttatgcaacgtccaaagacaggttccgaagagagctggaaggcatacattatgaaatccaggcaactgacccaactgagatggatcttgaggtgctcaaagaccgtgcaaactgagcactcatttggatcagaagtgtttcagatcttgaggagaagcgtgtgcagcctagaggaaattccttcaatcagttgttgattacgtcttatatttcactggcactaagtacatataattaattgtataaataatttccacctaagaagactgatcaggagcttatgaccatgggcaaatttgagctccttgttgccatgatgcttctcaggtgatgttggatgtggttattgccacctgagaaggctgatcgggagttcttgaccatgggaaaatttgagctccttattgcgatgatgcttctcaggtgatgttggatgtggttatgcatattaatggttaatgcatcttgttatcgattaagcattc

SEQ ID NO: 358 - DNA, 773 bp, Actinidia deliciosa
aaggattcttaattctctctctctctctgtctctctcttaaatccagatttaaattcgtacccatatgtgcatgcataaacgcacagttttctctagtcgcttccctttcttcctagattttgcaactctatttggtccgttcatcgattacacccacccaccatgtcgctcagaatcagggggacgaatgcttcttcaggcatgggcgttgctgaccacagcaaaaacacattcttggaactgcagaggaagaaggtctatcgatacgtgattttcaagatcgatgagaagaaaaaggaggttgtggttgagaagactggtggtcctgccgagagctatgatgatttcgctgcagccttgcccgaaaacgactgccgatatgctgtttatgacttcgatttcgtcacttctgagaattgccagaagagcaagatattcttcatcgcgtggtcacctgcagtctcccgaattcgtgccaaaatgttgtacgccacgtccaaagacaggttcagacgcgagcttgatggtatccactatgagattcaggctaccgacccaacagagatggatcttgaagttatcagagaccgcgcacactaaacccctcactgcttcggttttgccagcttatcgataagtaccttcattttctgtatttcatctgctgaacccatttccggtattagaaagtatcgcgtaaaataattaataacccgctaaggctgatgtgaagctctgggctaatgtttccaattgttgcaacgttctgttt

SEQ ID NO: 359 - DNA, 559 bp, Euphorbia peplus
gaattaacaaacagttccagttatatcctcgttctcttttaccggccatggctttcagaggaggaaatgcttcatctggcatgggtgttgctgagcactgcaaaagcacattcttagaattgcagaggaagaaggtgcatcgttatgtgatttttaagattgatgagaagaaaaaagaggttgtagttgagaaaactggaggggctgctgaaagctatgatgattttacagctgctatgcctgaaagtgattgccgatatgctgtatatgattttgatttcgtaacttcggagaattgtcagaaaagcaagatcttcttcattgcatggtctccttctgtctcccggattcgtgcaaagatgctttacgcaacttccaaagataggtttagaagagaactagaaggcatccattatgaaatccaagcaactgacccaaccgagatggatcttgaggtactcagagatcgcgcacactaagcttttctaaaatgcaagtattcagtatgtgccatttatgcaactggcctgaaagtatatatacatagctctagctcaat

SEQ ID NO: 360 - DNA, 936 bp, Euphorbia esula
caattttatcatagaggaaggaccactacaacgctatcagtaccgtatcccaccagataatctctccctgcagagaggacaagcacggcacgctacgacgcgctcctttttatttccttgttccccttctcttctcccttccagcccagagagaatctaaatctgtccatttaatttattattttttgaattaacaaaaaatttattattttttgaattaacaaacagttccagttatatcctcgttctcttttaccggccatggctttcagaggaggaaatgcttcatctggcatgggtgttgctgagcactgcaaaagcacattcttagaattgcagaggaagaaggtgcatcgttatgtgatttttaagattgatgagaagaaaaaagaggttgtagttgagaaaactggaggggctgctgaaagctatgatgattttacagctgctatgcctgaaagtgattgccgatatgctgtatatgattttgatttcgtaacttcggagaattgtcagaaaagcaagatcttcttcattgcatggtctccttctgtctcccggattcgtgcaaagatgctttacgcaacttccaaagataggtttagaagagaactagaaggcatccattatgaaatccaagcaactgacccaaccgagatggatcttgaggtactccgagatcgcgcacactaagctttttctaaaatgccagtattcactatgtgccatttatgcaactggcctgacagtatatatacatagctctagctcaatttgtaatgaataattgttgcctgtgaaggctgatcaggagctcataggtttagaggacattgagctccatattgccatgatgcttctcaggtgatatttgattgggttatgtaatgcatattaatggttaactatagtttaatgtgccactatttttagcga

SEQ ID NO: 361 - DNA, 1034 bp, Populus trichocarpa
ttaccattacagtatcacacaaggatctctctctctctctctctctctccccccctctctccctccctccttttgagtcttgtgtatttattccttttctattttttttcctgcctttccgtccaaaacctggccaccactggaaaccttttcttttttttatatagttcttgtaattaaagcagcttgtgctgtttgttgctgatcttcacgctgctacaattctcacagctctttctaagctgccatgtctttcaggggagcaagtcggcccaatgcatcatccggcatgggtgttgctgatcacagcaaaatagcattcgtggaacttcagaggaagaaggtccatcggtatgtgatcttcaaaattgatgaaaagaagaaggaggttgtggtggagaagactggtgggccagctgagagctatgaagatttcactgcatctttgcctgagaacgactgtcgatacgctgtttatgactttgactttgtgacgtctgagaattgtcaaaagagcaagatcttcttcattgcatggtctccttcaacctctcgaatccgtgcaaagatgctctatgccacatctaaagacagatttagaagggagctggatggtattcactatgagattcaggctactgaccctacagagatggatcttgaggtgatcagagaacgtgcaaattaaagagtctctgacattaatggtttcttccatggaaaacaaagttgtgaagctcttgccaacttacggattaaagccctcttgttcccttaagctatgcacaggatccttgtgtgaacaagataaactacctgttacttaaataactagcattgggaaatactgatagaagttctgtgctattattgtggaaattaaattcagtttccttaaagcatgtaagttggtggatacttggcaatcctacatatttgtatcctttaaatttcttctattagatactcttgtttccttgccctcgtttttccctgctgttgccgagaggtgagaaaattgaagtgttggaggc

SEQ ID NO: 362 - DNA, 627 bp, Acacia harpophylla
gctcggtggttgctacttgcttcactctctcgctggttctgtaactatggcgttccgagtaggagggggaaatgcctcttctggcatgggtgttgctgagcatagtgtaagcacatacttggaactgcagaggaagaaagtacaccgctatatcatttttaagattgacgagaaaaagaaagaagtggtggttgagaagacaggaggccctgctgagagctatgatgatttcgctgcctccttgcctgagaatgattgccgttatgcgatctatgactttgattttgtaaccgccgagaactgtcagaagagcaaaatcttctttatcgcatggtctccttctgtatcccggattcgtgcaaaaatgctgtatgcaacatccaaggacaggttcagacgggagttggagggcatacattatgagattcaggcaacagaccctacagagatggatcttgaagtcctcagggaccgtgcaaactgagaataagttgggctcaaaggcttgcatctggatgatgcccttaggatatatctcattatctctgaaacaacctgaaggattgctcgctatttgacctgttccttgaacttctattttactatgttctctgtctgttttgacgc

SEQ ID NO: 363 - DNA, 1022 bp, Tropaeolum majus
cttttacaacctttttcatcatcttcttcttgctttccatttctccaaagaaaaagtgagaatctcacaaaaattcaattcagtttatatatatcctccattgttgcttcctcttctgttcttcttcttcttattatctccacaaacctccttatccgcttcatcttccgttcttctccacactttgttcgcggcagccatgtctttcatcagaggaactaatgcgtcgtcgggcatgggcgttgctgaccacagcaaaagtacatatatggagctgcaaagaaaaaaggcccatcgctatgtgatcttcaagatagacgagaagaagaaagaggtggtggttgaaaagacaggaagcccagctgagagctatgaggatttcactgctgcattgcctgagaatgactgcagatatgctatttacgactatgattttgttacttctgagaattgccagaaaagcaagatctttttcgttgcatggtctccttctgtgtctcgtattcgtgcaaagatgctatatgcgacatcaaaagacaggttccgacgggagctgcacggcattcactatgaaattcaggctactgacccaacagagatggaccttgaagtgattcaagaacgtgctcactaagtttagactcaaaaggggttttgcataactcttgcagcccaatcgaaaatgaacacattcaccgctcttttttagatgtctatgataatgcagtatgctgacacgattaaagtacatatagcttgaatagtcgtgatagtcgataacgtttgagaaggttgattagtgactcgaggttcggcagaacttaggcacgttataccgtgatgcttctcaggttaagtcaggtacgggtttggatattgacgattcaactcttgttcaacgatattggtgcaactataataagagactatctcgttgtgctaatatgtatatctcaagttatttatttaatttataggttattatcttttcaaaaaatagataaaatcaataacatatttcc

SEQ ID NO: 364 - DNA, 789 bp, Vaccinium corymbosum
acagatataaaaagcaaacgcattgattctacagagtccgtttcctttcttcttaatttttggagctcttgtgtccattcacttatttccttccacctgcagccatgtccttcagaatcagggggccaaatgcttcttcaggcatgggcgttgctgaccacagcaaaaacacatttctagagctgcagaggaagaaggtccatcggtacgtgattttcaagatcgatgagaagaaaaaagaggtcgttgttgagaagactggcgatcctgctgagagttacgatgatttcactgcagccttgcctgagaatgattgccgatatgctgtatatgacttcgatttcgtgactcctgaaaattgccagaagagcaaagatattcttcatcgcgtggtcacctgcagtctctcgaattcgtgccaagatgctctacgccacatcaaagaccgtcaacgggaacttgacggtatccattacgagattcaagctactgatcctacagaaatggatcttgaagttatcagagaccgggcacactgacagttttcttttctcgaacgagaagaaatgttttgcgccaaacttatgaagaagcgatgatcgatttctggcatgacaaagtgttgcttaaataattggcattggggaaggctgatctgtgaagctataggctaaccgtatccgaaagctgtaaggttctgctaaaaatcattgcctaccagatagatctctgtattctgaatcacattactatgtgttttgttcctttcaataatactctctcttgttt

SEQ ID NO: 365 - DNA, 1251 bp, Cannabis sativa
gttgcttcatggtagaattttccaagattaattaaattaagcttattgggcctatctcgcgtttattgggccggaggaaacctctcttgttgtcaactccataggctcacgggcccaaaagaccgaaccaattcaatcctgtgatattcaagatcctgttttctcaggtgattatatcactccattcatggcagtctttgtcagacagcgaatatatatctttcattcatttcttactcaattttctcgcagactattctaattttttattattaattaatcattttttaatttcaattttcatatcctggtcgtggtcgctgatttctctctctctctctaaaactatttgtcggcgatcaaagcagcagccatggctttcagagggggaaatgcttcatctggaatgggtgtggatgagcatagtaagagcacattccttgaacttcagaggaagaaagtttaccgctatgtgattttcaagattgatgagaagaaaaaagaggttgtggttgaaaaaaccggaggccctgctgaaagctacagtgattttgtcgcctctatgcctgagaatgattgtcgatatgctgtttatgactttgatttcgtcacttccgagaattgtcaaaagagcaagattttttttattgcatggtcaccatctgtatcgagaattcgagcaaagatgctatatgcaacatcgaaagacaggtttagaagggagcttgaggggattcattacgagatccaggcaactgatcggagcgagatggatcttgatgttcttagagagcgtgcaaattgagcagttggtaacagggtttgaaaagaaatcggggagtttcttctacttatttagtattataatctgttccatgtttcatgtttcatgtatgtacaaattacatgttagcttaattactaaataaaataatggtttgagcttgggaaggctgataaggggggttctgtttaaggctttagctatattatctgtgcaggaagagacatttgagctttccctcattttcatgatgcttcccaggtgatgttgtgttctggtttgtccaattgaatacttaaaataataaaagaaaactctttatttcaagttttattttgttatattttcggagagggttttgtaatagggttagtcgccttttccatatccgttgtatggtatgattttgtttagtatgaattgctcgagaaatgcttcgaagccaatgtcgatatcactatttataa

SEQ ID NO: 366 - DNA, 810 bp, Ipomoea batatas
ccgtttctttacttttttctctcctgagtggctccttttaattcagattattctcctattttctttccttgtatttcctgcgtactcccccaaatctctcttctgtggttctgatttcagataacaaaaaaatgtcctccagaggggcaaatgcatcctccgggatgggagttgctgaacacagcaaaagcacgtacatggaattgcaaagaaagaaggtgcaccgttacgtgatctttaagatagatgagaagaagaaagaagtcgtggtcgagaaaaccggaggtccagctgaaagctacgacgattttaccgcatctttgcccgagactgattgccgctatgctgtctatgactttgattttgttacttccgagaactggcaaaagagcaagatatttttcatcgcatggtccccctcggtgtcgaggatccgttctaagatgctatatgcgacatccaaggacaggttcaggagggagctccaaggcatccactacgagatacaagccactgaagcaacggaggtggatcttgaggtgctccaggagcgtgctaattgatcgtatcgtgaaaggggttttcgatctacgttcatgacttatatgtatgtggaataataatgtggcatctggtaacgctgaacaggagctcattgttatgataaaagtatggttacaggcagggctccttattctcatgatggtttccagatgactagttgttttgactatcaactatgtgccctttataggcatatattatggacactactgaatactgatatgtatatgttgtcacctggctacc

SEQ ID NO: 367 - DNA, 830 bp, Vaccinium corymbosum
gcaaacgcattgattctacagagtccgtttcctttcttcttaatttttggagctcttgtgtccattcacttatttccttccacctgcagccatgtccttcagaatcagggggccaaatgcttcttcaggcatgggcgttgctgaccacagcaaaaacacatttctagagctgcagaggaagaaggtccatcggtacgtgattttcaagatcgatgagaagaaaaaagaggtcgttgttgagaagactggcgatcctgctgagagttacgatgatttcactgcagccttgcctgagaatgattgccgatatgctgtatatgacttcgatttcgtgactcctgaaaattgccagaagagcaagatattcttcatcgcgtggtcacctgcagtctctcgaattcgtgccaagatgctttacgccacgtccaaagaccggttcaaacgggagcttgacggtatccattatgagattcaagcaactgatcctacagaaatggatattgaagttatcagagaccgcgcacactaagagtttcctttctcgaacgagaagaaatgttttacgccgaactgatgatcgatttctggcatgacaaagtgttgcttaaataattggcattggggaaggctgatctgtgaagctataggctaaccgtatccgaaagctgtaaggttctgctaaaaatcattgcctaccagatagatctttgtattctgaatcacattactatgtattttgttcctttcaataatactctctcttgtttcgtttctgttactctctcttgtactttgaatggcaacaatgggaaatgataggatctggatac

SEQ ID NO: 368 - DNA, 891 bp, Amorphophallus konjac
gctctgctcgcttggatctcctccaccgtcgtctttttcttcttcttctactccgtctcctgctgttgctttgagcggtgcatctgacgccgccatgtcgttccgaacgtcgaatgcatcatctggcatgggagttgctgatcatagcaagagcactttccaggaacttaagaggaaaaaggtacatcgctatgtgatattcaagatcgatgaaaagaaaaaggaagttgtagttgagaagacagggggccctggggagagctatgatgattttacagccgctctgcccgagaatgactgccgatacgcagtctatgacttcgactttgtgactgtggaaaattgccagaagagcaagattttctttattgcatggtctccttctatctcccggattcgggctaagatgctgtatgctacgtccaaggacagatttcggcgtgagcttgacggcatccactatgagatccaggcgactgacccgacagagatggatctggacgtgcttagagaccgtgcacactgacgtgcttctagtcccccaggacatttgctgatgtggggagtgggcaatcccgccacccggattgtgtacccaaaccttgagcagcatttgtttctgggaaaaacaacctgcgcggcccattggaataaactgttacttgccctttggaaggctgatgggggagttcctgtctagatgatgaataatcgcgtgtgacagtagcagggactcttttcatgacgcttgcgaagggggacatgggctaggttatgatttgtggtgttgaataccccggttactactgtgcctatcctattgaagacttgatcgtactctatgagatagttaattatataccaatgatatccgtagttgtgtgtgtgtgt

SEQ ID NO: 369 - DNA, 1187 bp, Cannabis sativa
gcctatctcgtgtttattgggccggaggagacctctcttgttgtcaactccataggctcacgggcccaaaagaccgaaccaattcaatcctgtgatattcaagatcctgttttctcaggtgattatatcactccattcatggcagtctttgtcagacagcgaatatatatctttcattcatttcttactcaattttctcgcagactattctaattttttattattaattaatcattttttaatttcaattttcatatcctggtcgtggtcgctgatttctctctctctctctctaaaactatttgtcggcgatcaaagcagcagccatggctttcagagggggaaatgcttcatctggcatgggtgtggatgagcatagtaagagcacattccttgaacttcagaggaagaaattttaccgctatgtgattttcaagattgatgagaagaaaaaagaggttgtggttgaaaaaaccggaggccctgctgaaagctacagtgattttgtcgcctctatgcctgagaatgattgtcgatatgctgtttatgactttgatttcgtcacttccgagaattgtcaaaagagcaagattttttttattgcatggtcaccatctgtatcgagaattcgagcaaagatgctatatgcaacatcgaaagacaggtttagaagggagcttgaggggattcattacgagatccaggcaactgatcggagcgagatggatcttgatgttcttagagagcgtgcaaattgagcagttggtaacagggtttgaaaagaaatcggggagtttcttctacttatttagtattataatctgttccatgtttcatgtttcatgtatgtacaaattacatgttagcttaattactaaataaaataatggtttgagcttgggaaggctgataaggggggttctgtttaaggctttagctatattatctgtgcaggaagagacatttgagctttccctcattttcatgatgcttcccaggtgatgttgtgttctggtttgtccaattgaatacttaaaataataaaagaaaactctttatttcaagttttattttgttatattttcggagagtgtgttgtaatagggttagtcgccttttccatatcggctgtatggtatgattttgtttagtatgtatgaattgctcgagaaatgcttcgaagccaa

SEQ ID NO: 370 - DNA, 956 bp, Vitis vinifera
cagaaaatgaaagaaaaaagacagctcttttctctctttggcagctttccattattctgtgattctcaaacttttccgtgtctcacatttttccccattttgcctttccgtccaaacgcaaaccgccttgaatcccaaccccacctgcttttttgttttttgtttttttcttttctctcctctgcttaatttgaagctctcttggacattgctttcttcacatcttctcagtagtcatgtcgttcagagggctaaatgcttcatctggtatgggtgttgctgatcacagcaaaaacacatttttggaactgaagagaaagaaggttcatcggtatgtgatttttaagattgatgagaagaaaaaggaggttgtagttgagaagaccggtggtccagctgagagctttgatgaatttgcagctgctttgcctgagaatgattgccgatatgcggtttatgactttgattttgtgacttctgagaattgtcagaagagcaagatattcttcattgcatggtctcctgacagctcaagaatccgcgcaaagatgctctatgccacatccaaagagaggtttaggcgggagctagatggtgtccactatgagattcaggcgactgaccctacagaaatggaccttgaagttctgagagagcgggcacactaaacagtctctgctgtttagaattttcttccgtggggatgaaagaactgctaggggttttgccaatgtatgaaccagtgctttctgctttatgaagcaatttgcagagcccatctctgacagaaatagtattacataatgcttaaataaattggaatctggagaggctgtaatgaagctctgggctaaatgtaatcgggttgctatgcatctttcctgcttctacgtccaagataagtttgccttattatctgtatctatgctatatatgaattataacttaatttaagt

SEQ ID NO: 371 - DNA, 1211 bp, Prunus mume
accgagatacggaaaacacacatacgagacgcgcctcttttttactttcccctcctcaaaacgcgaatcttggttcttttcccttctctccttttgttcttcagtggctccctattctccttctttcttctccataagctccttcctctctctctatctgcctccgtaacagttatggctttcagaggaggaaatgcttcatcaggcatgggtgttgctgagcactgcaaaaacacattcttggaactgcagaggaagaaggcttatcgctatgtgatttttaaaattgacgagaagaaaaaagaggttgtggttgaaaagactggaggtccagctgaaagctatgatgatttcactgcttcaatgcctgagaatgactgccgatatgcaatttatgactttgattttgtcacttccgagaattgtcaaaagagcaagatctttttcattgcatggtcaccctctgtgtcacggatccgtgccaagatgctctatgcaacatcaaaggacaggttcaggagggagctggacggtatccattatgaaatccaggcaactgacccaaccgagatggaactagaagtccttagggaccgtgcacactgagcacttgttttaaaagggttaggtattttagagaagcacctaggcttctttgggaactcgagggaattacttttctggtctgaatatgtgcattatatgttcctggcagaaattaggtatagtttaatataattaataatcagcacctgggaaggctgattaggggctctgattatgatctcaatgacaccggaatatgagcttccttattaccatgatgcttctcaggtgacgttggatatggtaatggataatgataatttgactcatgttctatggaatagatattcatgctctatcggggatgtctctccttgcattgcatttaccacttttcatcatagtacgttttagttttgcaatgagtactaaaaagacgaatggatcggttatgaattttatgacctttgttcgtgatagttgaagggatccatttgctgctacagaaatttgcctttaggttattcatccgaaacaataataacccatttggtattgtttcattgctcttcgttaatcaatttaccttttgaatttgcggcaacttggtgcaagatgggtcacctaagagaaaccgacaacacgaaactgaatgttatagatgg

SEQ ID NO: 372 - DNA, 910 bp, Prunus persica
accgagatacgaaaaacacacatacgagacgcgcctcttttttactttcccctccctcaaaacgcgaatcttgttcttttcccttttctccttttgttcttcagtggctcctattctcctcctttcttctccatacgctcctccctctccctctctctctctctctatctgcctccgtaacagttatggctttcagaggaggaaatgcttcatcaggcatgggtgttgctgagcactgcaaaaacacgttcttggaactgcagaggaagaaggcttatcgctacgtgatttttaaaattgacgagaagaaaaaagaggttgtggttgaaaagactggaggtccagctgaaagctatgatgatttcactgcttcaatgcctgagaatgactgccgctatgcaatttatgactttgattttgtcacttcagagaattgtcaaaagagcaagatctttttcattgcatggtcaccctctgtgtcacggatccgtgccaagatgctgtatgcaacatcaaaggacaggttcaggagggagctggatggtatccattatgaaatccaggcaactgacccaaccgagatggaactagaagtccttagggaccgtgcacactgagcacttgttttaaaagggttaggtattttagagaagcacctaggcttcttttggaactcgagggaattacttttctggtctgaatatgtgcattatatgttcctggcagaaattaggtatagtttaatataattaataatcagcacctgggaaagctgattaggggctctgattatgatctcaatggcaccggaatatgagcttccttattaccatgatgcttctcaggtggaaattggatatggtaatgtataatgataatttgactcatgttctatggaatagatattcat

SEQ ID NO: 373 - DNA, 700 bp, Ipomoea batatas
ttacggcggagtcgagaaacatttcaataagtataaataaagcagcgatcttttatccttccgttgctgattcaagctcatcagccatggctttcagaactgcaagagggccaaatgcatcttctggcatgggtgttgctgatcacagcagaagtgcattcctggagctgcagaggaagaagatgcatcgatatgtgattttcaagattgatgagaagaaaaaggaggtggttgtggagaaaactggcggccctgctgagagctatgatgattttgctgcttcattgccggagaatgattgcagatatgcagtatatgacttcgactttgtgacatctgagaattgccaaaagagcaagatattcttcattgcttggtctccatcaacctcccgaattcgtgcaaaaatgctctatgctacctccaaagacaggttcaaaagagagctggatggcttccattacgagatccaagctaccgaccctactgaaatggacctcgaggtgatcagagaccgcgcaagttgaagaaagacgtaaaaagccttaccatctcatcatcaacacccttgtcaagcattctgcaggccatttctggcccagaaattgtgaatgctggtggttagtgtctagaaataaagaattcaaaacttgttttgaagaacttcttaatatattactaatacaaataacattcctaa

SEQ ID NO: 374 - DNA, 980 bp, Mimulus guttatus
ccaaaatagtaccctgtgccacattctccctgttacacgtccaactttgcctctgctttttcttcaccattctctctctctcttctcttctacccttctctttctctctctagaactggtttcgccatgtctttccgcggtggaggagggacgaatgcatcatcgggaatgggggtggccgatcagagcaacatcacctacacagagctgcagcggaagaaggtgcaccgctatgtgatattcaaaatcgacgagaagaaaaaagaagttgtggttgaaaagactggcggcccagccgagagttacgaagacttcactgcttctctacctgagagtgactgccgatatgcagtttacgacttcgactatgtcacctctgagaattgccaaaagagcaagatcttcttcattgcatggtctccttcgatttctcgtattcgagcaaagatgctatacgcaacatcaaaggaaaggtttaggagggagctgcagggtatacactacgaaattcaggccaccgatccaacagagatggatcttgaggtcattagagagcgcgcaaattgaaatctttctcggggcgcaactattatatatacgcatgcaaaatctataagaaattaagtcgatatatatatattaaataatttgagcatgatggggaaggctgattaggagctctcttgtattggaggtttccttcttctcgcgatgcttcctcaatgaaaatgtgtctcgtttatcgctattagcagttgaaattaatatatcgtataaactcgattatcagttgcgattatttttttcttatctgattttgtccatcttaccggggcttaatacccgagccccgaagtgttggtgccccgatgtcgatgaatagaaattagaggcgtaactattttgttttagttaaattttataaacatatacttattttagtgatttttttatggatagctaaaaaaaagaaagtcaaa

SEQ ID NO: 375 - DNA, 897 bp, Arachis hypogaea
cgctctctctctctctctcaacccaccttactttgttcttcctttctcgttcttgactgcgcaaccatggctttcaggatgggaggggggaatgcctcatccggcatgggcgttgctgaacatagtgtaagcacatttctggaactgcagaggaagaaagtgcaccgttatgtgatttttaaaattgacgagaataagaaagaggttgtggttgaaaagactggaggccctgctgagagctatgacgatttcaccgcatccttgcctgagaacgattgtcgatatgctgtgtacgacttcgattttgtgacagctgagaactgtcaaaagagcaaaatctttttcattgcatggtccccttcggtagctcgtattcgtgctaaaatgctttatgcaacatcgaaggacaggttcaggagggagctgaagggcgtccattacgagatacaagcaacggacccaacagagatggatcttgaaatccttagagagcgcgcgaactgagcatctacccaagcctagagcttgtcttgtgtctaggtgatgtagtttagggtatctgaagccttaagggaatgatattgactaattccctcaagtcactatggtctttgtttgttttgacacaattacttatcaagtaaataataacctacacctgtgaaggctgattagggtttcctttcttagaaacccccattgcaggggggaactagagctcttccttactacttccatgatgcttctcaggtgcagagttatacataccattatggatattgaaaatttgacttgtactctctatcaaagacttgtactctattcataaaaaaaaaaaaaaaaaaaaaaaaaaaaaaaaaaaaaaaaaaaaaaatgatggtgttgctttgcttctaa

SEQ ID NO: 376 - DNA, 763 bp, Valeriana officinalis
ttcttaatcaacttctgttcttctccaaaccaaaacctgttcttgatctagccagttatgtctttcagaggcggtgcaacaaatgcgtcatccggaatgggcgttgctgatcaaagcaaaaatacttatctggaactgcagagaaagaaagtgcaccgttatgtgattttcaaaattgacgagaagaaaaaagaggtggtggtcgagaaaactggtggtccagctgaaagctatgaagacttcacttccgccttgccggagaatgattgtcgatacgcggtgtatgactttgactttgtgactgccgaaaactgccaaaagagcaaaatcttctttattgcatggtctccttcagtctcccgaattcgttcaaaaatgctgtatgccacatcaaaagataggttcagaagggagctacaggggattcactacgagattcaagcaaccgattccaccgaaatggatcttgatgttatcaaagaacgcgctaattaactaacccatcaatgtttgatctcctatatatatacttatctaattcctatatgttgaaaaacttgtgtcgatcttcaaataatttgcggtatggaaggctgatttagaggggagggacgatttgtgtgtctctttgcccttccttcttgtcatgatgtttctcggacggaaatttaggaatatgtcgcgattgttaactttctatcaattatatatatatatatatatatacatgtatgttttatattggttgtatgtattttgatgg

SEQ ID NO: 377 - DNA, 353 bp, Arachis hypogaea
cagtggtatcaacgcagagtaagcagtggtatcaacgcagagtaagcagtggtatcaacgcagagtaagcagtggtatcaacgcagagtaagcagtggtatcaacgcagagtaagcagtggtatcaacgcagagtaagcagtggtatcaacgcagagtaagcagtggtatcaacgcagagttatacataccattatggatattgaaaatttgacttgtactctctatcaaagacttgtactctattcataaaaaaaaaaaaaaaaaaaaaaaaaaaaaaaaaaaaaaaaaaaaaaacgaccccgacctctctcgtcgtactacctactactctcttccgagacgacgacgacg

SEQ ID NO: 378 - DNA, 685 bp, Rosa hybrid cultivar
tatattccttctcttctctcttatctgccacccacaaacgctatggctttcagaggaggaaatgcttcctctggcatgggtgttgctgaggactgccgcaacacattcttggaactgcagagaaagaaggcctttcgctatgtgatttttaaaattgatgagaagaagaaagaggttgtggtagaaaagactggaggcccagctgaaagttatgctgatttcactggttcgttgcctgaaaatgattgccgatatgcaatctacgactttgattttgtcacttcagagaattgccagaagagcaagatcttcttcattgcatggtcgccttctgtgtcacggatccgtgccaagatgctctatgcaacatcaaaggacaggttcaggagggagctggagggtatccattatgagatccaggcaactgaccccactgagatggagcttgaagttcttcaggagcgtgcacactgagcgcttattttaaaatggtttggcatttctaagaagtactgaggtttctttcagaatatgtgcattatattttcctgagaagaaaaaaaataggtgtagtttaatatattaataattagcacctgggaaggctgattaggaggtcctggcaaagatctcttatgcacaggaatttgtgcttccttattaccatgatgcttctcaggtgaaa

SEQ ID NO: 379 - DNA, 1190 bp, Arachis hypogaea
ctctctctctctctctcaacccatcttactttgttcttcctttctcgttcttgactgcgcaaccatggctttcaggatgggaggggggaatgcctcatctggcatgggcgttgctgaacatagtgtaagcacatttctggaactgcagaggaagaaagtgcaccgttatgtgatttttaaaattgacgagaataagaaagaggttgtggttgaaaagactggaggccctgctgagagctatgacgatttcaccgcatccttgcctgagaacgattgtcgatatgctgtatacgacttcgattttgtgacagctgagaactgtcaaaagagcaaaatctttttcattgcatggtccccttcggtagctcgtattcgccctaaaatgctttatgcaacatcgaaggacaggttcaggagggagctgaagggcgtccattacgagatacaagcaacggacccaacagagatggatcttgaaatccttagagagcgcgcgaactgagcatctacccaagcctagagcttgtcttgtgtctaggtgatgtagtttagggtgtctgaagggaatgatattgactaattccctcaagtcactttggtctctgtttgttttgacacaattacttatcaagtaaataataacctacacctgtgaaggctgattagggtttcctttcttagaaacccccattgcaggggggaactagagctcttcctttctacttccatgatgcttctcaggtgcagagttatacataccattatggatattgaaaatttgacttgtactctatcaaagacttgtactctattcatcatgatggttttgctttgcttttagttccatcctggaacatttcatctttttgtaaagagtaaatgtctgttttggtccttcactatttttccgaatgacaaagtggcccttccaatttgaaaatccctaaccggtttttagctattcaagtaactcatctaagcaatttctgttattggtctaagcagttctagacacatcagcaggtcaccgtttacaagggttgcttagatcaattacttaaatggtgtgggactgattagagatttttgaattgtagagtgccgctttatcttttggacaaatggcctgggactagaaattgtatttatttatattttaaactatgaaggataaaattatcattttcgaa

SEQ ID NO: 380 - DNA, 1026 bp, Amborella trichopoda
ggcgccacctcccctttacttttccttttcttttttaaatttctttctctctctctttggcctttcgcctccaattttttttcacctttttttttggaatatattctcactcgtttatctcttcattctctccgcaccatatagaccagataagctctcttttgctggtcggaatttagggtttcttctccattgtttcagtcatgtctttccgatcgtccaatgcatcatctggtatgggagtggctgaccactgcatgcacacctttctggagctgaagaggaagaaggttcatcgctatgtgatattcaagatcgatgagaagaagaaggaggttgttgtggagaagacgggtggaccagctgagagctatgatgatttcacagctgctttgcctgaaaatgactgccgctatgctatatatgactttgatttcgtgacctctgagaattgccagaagagcaaaatattcttcattgcctggtctccctctatttctaggatccgagccaagatgctttatgcaacctccaaggatcgattccgacgagagcttgatggcatccacatgagattcaggccactgatcccactgagatggacttggaagtgctcagggaccgtgcacactaaactcaaagctttattcctctcaagaaacagggccatttataatacatttggagtaggagctacgcaaattcttatcatcatctgagggtggagtctatttgctgtactgctttgcttcgaggaaacgcttggtacgaaaaatattacagtaaatattttaaaaaaaggttgggtttgatattattaataagtgattccagtcttgatggcacaaaaattcactagtaatttgaatgacatattatggatgtttataatttatgctgttaatatgcatgtggtggttatttatgaaatatctgtctgtattatagcttttgaaatgtggagatggggattttacccttggtttagccatctatcaagaaatacttcagatgtggtttagttaa

SEQ ID NO: 381 - DNA, 900 bp, Amorphophallus konjac
gccgttcctatttctccccatttcccccactcgcgttctcctcctcctctgaggggagctgctgctgctgctggtggtgttcctggtgtgggtagaggatctgaggcggccgccatgtcgttccgctcggccaacgcttcctctggcatgggagttgctgatcacagcaagagcactttcctggaactgaagaggaagaaggtgcatcgctatgtgatattcaagatagatggaaagaaaaggaggttgtagtggagaagacagggggacctggggagagctatgatgattttgctgctgctttgccagagaatgattgccgatacgcggtctacgactttgactttgtgactgcagaaaattgccagaagagcaagattttctttattgcatggtccccctccgtcgcccgaattcgagccaagatgctgtatgctacatccaaggacaggtttcgacgtgagctcgacggcatccattacgaaatccaggcgacggaccccaccgagatggatctggatgtgctcagagaccgcgcgcgctgaggcgcccccattctgagcggactgacatggtaatatgctggatgcgacaggactccttgtacaaacgggggcacccaaatatctgaatctgggtcacaacgcaatatataagcatggagccccccctatttagagaataaattcttctccgtgcgaagggtactgggagagctcccttgtctggatggtaataccgagtgtcacatagacgagaccatgagcttgctgatggttttcctgttaaatcgagtgctgtgtactgtaatgaagacatgttactatatttgaagcttggcgaatgcattagaagccagtgtctcaaacaactaacgctagtttagacgactaactaacg

SEQ ID NO: 382 - DNA, 858 bp, Catharanthus roseus
ctgaaacccaaacagctcatttacacaccgctctcaagaacagtagcagcagcaaccatgtcttttagaggaacaaatgcatcatccggcatgggtgtcgctgagcatagcaaaagcacatatatggaactgcaaaggaagaaggtgcatcgctatgtgatttttaagattgatgagaagaaaaaggaggtggtggttgaaaagaccggaagcccatctgagagctatgaagatttcacttcatctctgcctgagaatgattgccgatatgcagtctatgactacgtattttgtaacttctgagaactgaccaaaagagcaagatcttttccattgcatggtctcctgctgtctctcgaattcgtgcaaaaatgctgtatgcaacatccaaggacaggttcagaagggagctgaacggaatccattatgagatacaggcaactgatccgactgaaatggagcttgatgttctcaaagagagagctaattagccatttaatttatgaaaggatgctccaatataatcttaaacgaagaaagttgtgcatctctggcttcaaatagtaggctgtgcagaacctgtgtttctgaatacatatggctttactcataaataattttgttcctgggaaagctgattaggagctcttgccaaaagtctcccaacttttgggggttatggagttccttctgttgatgatgcttcccagatgaaaaaaggggtatgcttataatgtggatgctgattataataagttaaaatcaattatagtgtatcttctcttctattttatatcagggatgacaatattatgctcgtctctttattggtagcaatggcaccatcccatttacgaa

SEQ ID NO: 383 - DNA, 673 bp, Cicer arietinum
agagacgccgaccacgccacgtagaaaaactttttactcttttctctctctacaaatccatctaatttcttgagtcttcactgtagcagcagctgcatagatatggctttcagagtcggaagcggagtcggcgtcggaggggggaaatgcatcttctggcatgggtgtcgctgagcatagcgtaagcacattccaggaattgcagaggaagaaagtacatcgctatgtgattttcaaaattgacgagaagaagcaagaggttgtggttgaaaaaactggaggccctgctgagagctatgatgatttcactgcatccttgcctgaaaatgattgccgatatgcagtctttgactttgattttgtgactgctgagaactgccaaaagagcaaaatcttttttattgcatggtctccttcggtagctcgcattcgccctaagatgctttatgcaacatcaaaggacaggttcagaagggagctgcagggcatccattatgagattcaggcaacagacccaacagagatggatctcgaagtcctccgagaccgtgcaaactgagcacctaaacaactgaaagggttgttgtgtctaagttatgtagttaggatttcttaggcctcaagaaatgttgttaactgatgcccttaagtattagtatggtcttgttctgac

SEQ ID NO: 384 - DNA, 1831 bp, Glycine max
tgacgatctaaatccaagccggcatcaattctaggtgaggtataatgttttttttcctgaatctctacaatagagcacaacctatatatttcttcaggctatttgtcctgatccattgggcatcatgcactttgataggatgtgttgtagagaaagaaatatcaatatgcacacagagcaaactgttcattcaaatcatatgtagatgcatttgagtttggcctggtatatgttatgttttcagtgtatgtttgttttgctatgggtacgccttagaaattgaaaatgagaaggtcttccgatctttttcccttgcattaaatttcaatgaatcaagctagctagatcatatgctatcaagtgaaagcttattgaatactttattccttcctcatgcatgaagttgctttgagttgcaattaactttagggttgcctctatcagaattttcttctaatccagggcaatggaggcatttgtcagttttgagatttttttacacacatactccatgtgtatcttgtgacctgaagtgaagtaagggaacttacatgagttaggagtgtgtgattgtatctcttattggattgttgtagtttgtttttgtgcagtgaaagaaaataacattttgtttttcctgattgattagattcattttgctggaagaacattatcattattattggaaatatggttaaagtattgattttgaaaatgactagtgtttagaatttgatgtgaggcttcaatgtagggaaatgcctcttctggcattggtgttgctgagcatagcgtaaacacgttcctggaattgcagaggaagaaagttcatcgctatgtgatttttaaaattgatgagaaaaagaaagaggttatcgttgaaaaaactggaggccctgctgagagctatgatgatttcactgcatccttgcctgaaaatgattgccgatacgctgtctttgactttgattttgtgacatctgagaactgccaaaagagcaaaatcttttttattgcatggtctccttcagtggcccgcattcgcccaaagatgctatatgcaacatccaaggacaggttcagaagggagctgcagggcatccattatgagattcaggcaacagacccaacagagatggatcttgaagtcctcagagaacgtgcaaactgagcagtcacctacacaagagggttgtgtctaggtgatgtagttacaacaaaagcagtgattatcgaaataaaatattgattttaatttaaaacaatatatatttttttaaaaaagcgagccctgacacaacggtaaagttgtgtcttgatgacttgttggtcatgggttcgaatccggaaacagcctctttgcatatacaagggtaaggttgcgtacaatttccctcccccttatctgcgcatagcgtggagcctctggacaatgggatacgaagtttttatatatttttttaagagccaaggaaaattttattcaaatagacttagtttggaacacaagctagcggtgaccaaaaccaagcccaagtttttcatccaattggcatggtgaattcattaacttatggccttattatcacttttcttattcttacactttacttcataggaatattgttcacaagggatttgtaagtatacccacttagcgtttaaaagagatatttcagtaggttagactttgaatatattttttaaaaaaaatcgaaactaaaactttctaaaatattcaacgaatgtacgttaataaattcttatccaaaatatatgggaagacttaatttggaaaaataatcatcagcatcaggaggactgggagcaa

SEQ ID NO: 385 - DNA, 841 bp, Fragaria vesca
cgcggctcaaaaacgcgaatcttttctcttttgttcttcagtggctgcctcttctcctccttccttctccatacattcctcctcttctttctatctgcgaacccacgaacgctatggctttcagaggagggaatgcttcctctggcatgggtgttgctgaggactgccggagcacattcttggaactgcagagaaagaaggccttccgctatgtggtttttaaaattgatgagaagaagaaagaggttgtggtagagaagacaggaagcccggctgaaagttatgatgatttcactgcttcgttgcctgaaaatgattgccgatatgcaatctacgactttgattttgtcacttcagagaattgccagaagagcaagatcttttttattgcatggtcaccttctgtgtcacggatccgtgctaagatgctctatgcgacttcaaaggacaggttcaggagggagctggatggtatccattatgagatccaggcaactgactccactgagatggagcttgaagtccttcaggagcgtgcgcactgagcacgtaaaatgggtttggcatttcaaaagaagtacggaggtttctttcagaatatgtgcattatatttgcctgaaaagaaaaataggtgtagtttaatatatttaataatcagcacccgggaaggctgattagggggtcctggctaagatttcttatgcacaggaattcgtgcttccttattaccatgatgcttctcaggtgaaattggatatggttatggttaatgctaatttgattcctatcatgttctatgaatgatctctcctttcatcacattttggtttgagatttctg

SEQ ID NO: 386 - DNA, 776 bp, Cleome gynandra
accacatatatcttttgagaatttcggtttgtttttgttctcttctctcttcgtttaaaccgaagggtttgtttcagtttcttcttgtgtctacgattctctcaaaaagctctttccttctcgaagaagaagacgaagaaaagttcatgtctttcagaggacttagcaggccgaatgcatcatccggaatgggtgttgcagaccacagcaagtccacattccaagaattacagaggaaaaaagttcatcgctatgtgatatttaagatcgatgagaacaaaaaggaggtagtggtggagaaaaccggtggtcctgctgagagctacgatgatttccttgcttctttgcctgagaatgactgtagatacgctgtttatgactttgatttcgtcacttctgagaattgccagaagagcaagatcttctttgttgcgtggtcgccgtcgacgtctcgaataagggcaaagatgttatatgcgacctccaaagacaggttcagacgggagctccaaggcattcattacgagatccaagccactgaccctacagaagtcgacctcgatgtgttacgcgaccgagcaaattgacagactgaaatgaaacatcttctgatgaaattatcataatgtaaggaataattatcatttggattctaaacttgtgtagcttctgttccaagtgctgtctgaaaattttgtcagcttgtggtttgtcattgtgaatgttcatatgaacatatatttgaagtatgatgaaaccattatgttgctatagtt

SEQ ID NO: 387 - DNA, 659 bp, Amborella trichopoda
atatagaccagataagctctcttttgctggtcggaatttagggtttcttctccattgtttcagtcatgtctttccgatcgtccaatgcatcatctggtatgggatggctgaccactgcatgcacacctttctggagctgaagaggaagaaggttcatcgctatgtgatattcaagatcgatgagaagaagaaggaggttgttgtggagaagacgggtggaccagctgagagctatgatgatttcacagctgctttgcctgaaaatgactgccgctatgctatatatgactttgatttcgtgacctctgagaattgccagaagagcaaaatattcttcattgcctggtctccctctatttctaggatccgagccaagatgctttatgcaacctccaaggatcgattccgacgagagcttgatggcatccactatgagattcaggccactgatcccactgagatggacttggaatgctcagggaccgtgcacactaaactcaaagcttatgctctcagaacagggccatttataatacatttgatagggctagcaatctatacaaataacatctgaggtgagtcatttgctgtactgctttgcttcgcgaacctgacaaactacacacataatagtccataataaaaaaaacaaaaaaata

SEQ ID NO: 388 - DNA, 1427 bp, Cicer arietinum
atttttttgaaccatatttttctagaattacggttgcattttctctcattttggcctccacaaaaacttttctctttctctctctacaaatccatctaatttcttgagtcttcactgtagcagcagctgcatagatatggctttcagagtcggaagcggagtcggcgtcggagggggaaatgcatcttctggcatgggtgtcgctgagcatagcgtaagcacattccaggaattgcagaggaagaaagtacatcgctatgtgattttcaaaattgacgagaagaagcaagaggttgtggttgaaaaaactggaggccctgctgagagctatgatgatttcactgcatccttgcctgaaaatgattgccgatatgcagtctttgactttgattttgtgactgctgagaactgccaaaagagcaaaatcttttttattgcatggtctccttcggtagctcgcattcgccctaagatgctttatgcaacatcaaaggacaggttcagaagggagctgcagggcatccattatgagattcaggcaacagacccaacagagatggatctcgaagtcctccgagaccgtgcaaactgagcacctaaacaaactgaaagggttgttgtgtctaagttatgtagttaggatttcttaggcctcaagaaatgttgttaactgatgcccttaagtattagtatggtcttgttctgacacatttcatataaatagcttacttcaagtaagtaacatatgcacctgtgaaggctgatctgggttcctgcctaagaaaccccactgcagaggaatttgagttgttccttactgttactgccatgatgcttctcaggtggaattaatatggttatggatattgaaaatttggctttaattgctgcaatataaagtcagtcattagctatgaaacactgatgcaaacatgaacatctgacacgacacttacatgcattgaagctcgtattcgtgtatgttaaagtgctgaagtatcaacattgggtacaagtgcacatacagtacatcttgtcccataccttctttttgtcggggggttgggtacgcgatggtggtacgaaagagtacgcatgccacaatgagtgggtttaataacacaacaaaatgggtcgccagacctgacctgggtctgattaatttagattttaggtttttatcgaactggaatgacaacaatttaacattcggccttttggttctctctcttgcctttctttaaaataccacaggtaattgcatcgcctttcagttgtctcattgttgtggtgagggaaccttttcagtcaaaataggaatactcatagtagttgtcaaaatgttgtgttttttagtttattttgtgaaaatactttttgtttttatttcttaaaatggatgtttagtttatttttgaataacaaaa

SEQ ID NO: 389 - DNA, 658 bp, Arachis hypogaea
gggaggggggaatgcctcatctggcatgggcgttgctgaacatagtgtaagcacatttctggaactgcaaaggaagaaagtgcaccgttatgtgatttttaaaattgacgagaataagaaagaggttgtggttgaaaagactggaggccctgctgagagctatgacgatttcaccgcatccttgcctgagaacgattgtcgatatgctgtatacgacttcgattttgtgacagctgagaactgtcaaaagagcaaaatctttttcattgcatggtccccttggtagctcgtattcgccctaaaatgctttatgcaacatcgaaggacaggttcaggagggagctgaagggcgtccattacgagatacaagcaacggacccaacagagatggatcttgaaatccttagagagcgcgcgaactgagcatctaccaagcctagggcttgtcttgtgtctaggtgatgtagttaggtgtctgaagggatgatattgactaattccctcaagtcacttcggtctctgtttgtttgacacaattacttatcaagtaaataataacctacacctgtgaaggctgtattagggttacctttcttacgaaacccctattacgcgaggggaactagacgctacttcctttctacttccatgatgcttc

SEQ ID NO: 390 - DNA, 616 bp, Musa acuminata
acatttcctcctgtttcccttctcactcccctctgtctctctcgggatcgaggcgccatgtctttccgaacgtcaaatgcatcatcgggcatgggagttgatgaacacagcaaaagcacttttctggaacttcagagaaagaaagtgcatcgatatgtcatattcaaaatagatgaaaagaaaaaggaggtagttgttgagaagacaggagccccaggagagagctatgacgatttcactgctgcccttcctgagaatgattgccgttatgctatttatgattttgattatgtgactgaagacaactgccaaaagagcaagatatttttcattgcatggtcaccttccatctctcgcatacgtgcaaagatgctttatgccacatcaaaggataggttcaggcgtgagcttgatggcattcattatgagattcaggctactgaccctactgagatggagttggaagtacttagagaccgtgcaagctaatgctctgaacttgcacaaacttcttccacaacaagactgcttattttgtgtgccatggcctagatgtattggttttgcagcgattggttgtgggatgactgttcactagaataagtgtctacacctg

SEQ ID NO: 391 - DNA, 1376 bp, Musa acuminata
atggaccggcaaccgttcgacctggtgagacagaattctcactttcctttttcctcgaccacttccaatataatcgcctctcctccctcatttccttccacaattcctccagtttcccttctcactcccctccgtctctctcgggatcgaggcgccatgtctttccgaacgtcaaatgcatcatcgggcatgggagttgatgaacacagcaaaagcacttttctggaacttcagagaaagaaagtgcatcgatatgtcatattcaaaatagatgaaaagaaaaaggaggtagttgttgagaagacaggagccccaggagagagctatgacgatttcactgctgcccttcccgagaatgattgccgttatgctatttatgattttgattatgtgactgaagacaactgccaaaagagcaagatatttttcattgcatggtcaccttccatctctcgcatacgtgcaaagatgctttatgccacatcaaaggataggttcaggcgtgagcttgatggcattcattatgagattcaggctactgaccctactgagatggagttggaagtgcttagagaccgtgcaagctaatgctctgaacttgcacaaacttcttccacaacaagactgcttattttgtgtgccatggcctagatgtattggttttgcagcgattggttgtgggatgactgttcactagaataagtgtctacacctgagaggctaatgtataagctgcttattctggatgataatgtttgaagactgggatcctcttctggatgataatgttaatgcattgcatctcagtaatgcaatggatgactgttctggatggtaatgttcactagaacattgcatctcatcgatgactacttggttctcatctcgatcagatcatattagatggagaaactttgcaagattctgtgatgaaattgtcgaatgctatctttgtggctgttgaaaattagatcatagcttttgctttaaagatatgattgttttagcatgattcttctctgattgcacatcgtgagcccatatcattgtggtgaggcaattctaccagtcatagcctccatgagccaaactgagagaccagattccaccccctatctgacttttgctctccttgtctattctcttgatctggtacacttatctctttccagttacaagttttttttttgttttctttatcagtagatgctcctcaagatctgctgttacgtcagaattgaagcaggggaaataagaaacgagtcctttccagttccagcagaaatccagagaggttgtacagaattttctcttcatattattctcttctctatctgcaatggtgcattcatgcatgatactactgtgttacttat

SEQ ID NO: 392 - DNA, 807 bp, Mesembryanthemum crystallinum
ctctctcctcctactcgctgcagagctaagcaaccatggctttcagaggggggaatgcttcatccggcatgggtgtcgctgaacacagcaaaaacacatatatggaactacagaggaagaaggtgcaccgttatgtggtgttcaagatcgacgagaaaaagaaggaagtagttgtagagaaaactggaggaccagcagaaagttatgatgattttctcgcgtccttgcctgagaatgattgccgttatgcaatttatgattatgactttgtgacctctgagaactgccaaaagagcaaaatctttttcttcgcatggtccccttcagtggcccgcattcgctccaagatgctctatgcaacatccaaggaccgattcaggagagagctgaatggaattcattatgagatccaggccactgatccgaccgaagtggatcttgaggtgcttcaagagcgagcaaactgacctgagttagttcctccagtcaactgaatattattatcaaggctcgaaaataactgctgaaaggccctgtttttttgctccaaatttatgttactgcttccttgtatcgcgagacaaaagatgcatatagcctactaatgtggatgtggtcggtcactaaataactcggtatctcggaactgggaaggctgattaggagctctttccttttgtcatgttgagagctcaaggggccagtggctccttgttaccatgatgcttcccagtttaagaattgttgcgttcctgttttagtcccatatataaatatatatcgggatgtactgtgttgttctttttt

SEQ ID NO: 393 - DNA, 703 bp, Cleome spinosa
atattatttttgaaatttcctgtttgttcccttgttcccttcctctcttcgtttaaaccgaagggtttgtttcaatttcttcctgcgtctacgattttctcagcaagctctcgccttgtcgtagaagaagaagaaaagtccatgtctttcagaggacttagcaggcccaatgcatcgtctggaatgggcgttgcagacaacagcaagtccacattccgtgagctgcagaggaagaaagtccaccggtacgtcgtctttaagattgatgagaacaaaaaggaggtggtggtggaaaaaaccggcggccctgctgagaactacgacgatttccttgcttctttgcccgagaacgactgcagatacgctgtttatgactacgatttcgttactcccgagaattgccagaagagcaagatcttcttcgtcgcttggtctccctcgacgtctcggataagggcaaagatgctatacgcaacctcgaaggacaggttcaggcgggagctggagggcattcactacgagatccaagccaccgaccctacagaagtcgacctcgacgtgctacgcgagcgagcaaactgaaccgagagctcatggcaagagcaaaacgatatctagtaatggacgaatgtaatgaataatcaatcattggacaacatgggatgtgttgggagttgaatcggtgcttatgtttcaaaaaaaa

SEQ ID NO: 394 - DNA, 631 bp, Catharanthus roseus
ggcacgaggttttgttcttgctgcttccccacacagtttcctttcctcaccacttcggttagccatgtccttcagaatcacaggaccaaatgcttcatcaggaatgggtgttgctgatcagagtaaagacacattcttggaactaaagaggaagaaagtacatcgttacataattttcaagattgatgagaagaaaaaggaggttgtggttgagaaaacaggcagccctgccgaaacctatgatgattttactgcctctttgcctgaggatgactgcagatatgctgtttatgacttcgattttgtcacctctgagaattgtcaaaagagcaagattttcttcattgcttggtctccttcaatatctcgaattcgtgccaggatgctttatgctacatcaaaagaccggtttagaagagaattggatggaattcattatgagattcaagctactgatcctactgaaatggatcttgaagttctccaggaccgtgcacactgaacctgctgttcgttcctgacttttccctcaaaagaaaaaagaacggaaaaggttatcaatcaatcaatgtttttcagcttctttaaatctgtgtacagattctattcccagaaagaactactaattaat

SEQ ID NO: 395 - DNA, 767 bp, Triphysaria pusilla
acacgaaaactgcttttattctctcatttagtggctgcaattttcatcatctcctcctcaaatcgccgtgctgaacttgtcgccatgtctttccgtggtggtggggcaaatgcatcatctggaatgggtgttgctgatcacagcaaggacacatacatggagctgcagcggaaaaaggtgtaccgttatgtgatatttaagattgatgagaagaaaaaggaaattgtggtcgaaaagactggcggcccagctgaaagctacgaagattttgctggatctctgccggagaatgactgtcgatatgcagtttacgactttgattatgtcacttctgagaattgccagaagagcaagattttcttcgtttcatggtctccatcaacctctcgaatccgttcgaagatgctttatgcgacatcaaagggaaggttcagtagagagctggtgggtatacattacgagattcaggctaccgacccgactgaaatggaccttgatgtcatcagagagcgtgctaattaaatcatatgcaagtggatagttgctctttatctgaacttggattgtttttgtgatgtgtatgcttctgttacatataagatatggttataaataatttcggcacagggtaggctgattaggagctcccgatggatcgggcgtctctgtatcatcgattataacagtgttcaatttgatcgtattatcgctgtggatgtaaaaatttgtggttttgtttggttagtgatgaaacttttgaaaaaggt

SEQ ID NO: 396 - DNA, 2646 bp, Cannabis sativa
tttcaactccaattcatgtttcgtttttgtatttgatttttgataacattttgttgtaacaaatagaaaaagaatggctaatgaagtgtttaacgcattagacattgctaaaacacaatgtatcattccacagccatattatgggatttttcacagatgcatacgacctcttttgcatctcactcgtcaccaaaatgctcggccgaatttactaccatgttgaaggttcaaccaatccaggcacactcccaccagaagtctctgctgctgtgaatggcgtcgcctttgttggtacctgagccggccaactcttctttggttggcttggtgacaagttggggcgaaagagagtctatggtatcacactcttgatcatggtcatttgctcagtttgttctggcctttcctttagtcatgaccccaaaactgtcatgacaacactatgtttctttagattttggcttgggtttggcattggtggcattggtgcccgaggagccttcatagccgcggtgtttgctattgtgttgtcaactttgtttgaaattaagttcaaagctccaacttatgaagttgatccaattggttcaactgttccacaagctgattatctatggagaattgttttaatggctggtgctttacctgctgctataacattttattggaggttgaaaatgcccaaaactgctcgttacactgctcttgtgggctgcttctgatatgtcaaaggttctcaaggttgatattgaagctggacctgagagtgttgatgagacaacaagtcagtatggtttttttctctaaagagttcctttttctacatgggcttcacttgcttggcaccacaagtacttggtttttgcttgacatagcgttttacagccaaaacttgttctatctttagcgtcattggatggattccgccagcaaagactatgaatgccttggagaaatgcacaaaatagcgcgagctcagacactcatcgcgatgtgtagtacagtccctaattactggtttaccgtcctattcatcgacagaataggacggtttgtaaatcagctgatgggtttctcattcatgacaattttcatgtttgcactcgctattccttacgattactaggctcaaaagaatcaccttttcgggtttgtagttctgtattcactgactttcttctttgcaaatttcgaacctaactcaacaacatttgttgtcccggcttagatcttcccggccaaatttcggtccacctgccacggcatctctgctacattaggaaagctcggggcaatcgtggtgccattcgggttcgtctacttggctcagaaccaagagtaggccaaggtggataaaggatttccagcaggtattggggtcaagaattcccttctggttttaggtggaaatggaatcaacttcttaggtgttcttttcacttttttagtccctgaatcaaatgggaaatctctggaggagatgtcaggagaaagcaatgaagaaaacaagtaacctttgttggtttgtagaaccctttagttggtaaccagtaacctttgtttcaatagaactgcttcttatcttaagatgtaaatcattattgaaacttcagaaattggttatttgagatggtttattgtgtgtgtgcgagtattttgagcttgttttttcatcaataaacttgagatttcaccataaatatatatccataaaaatactgatctacatctgagaagtaaaaagtaaccaatttttttttcagcaagtagataaacattaagcttagcccagcttttcacaccccaccaacattgccagtttattcatcagattggcaaaattacaagttagaaggtgttgtatttgattatggcagctgctgagagcattaactgacagaaaatagagaatccaacgcttgaaagtgagtaaattaagctcagttcgctcgctctttgattacttcaagatccatctctgttggatcggtagcctgaatctcgtagtgaatgccttccagctctcttcgaaacctgtctttggatgtggcatagagcatcttcgagcgaattcgagcagttgaaggagaccatgcaatgaagaaaatcttgctcttttgacagttatcagaggtgacaaaatcatagtcataaacagcatatctgcaatcattctcaggtaaagctgcagtgaaatcatcatagttctcagctgggccaccagtcttatcaaccaaaatttcccttttcttctcatcaaccttaaagatcacatagcggtgaaccttcttcctttgcaattccatgaaagcattcttgctgtgatcagcaactcccattccagatgaagcatttggccgactgaagcctctgaaagacatggcagcaaacaaagtgtttggctatggaaccaaagaaaaacagtgaaagaaagaagagaagagaagagaagagaagagaagaagattacaaaatattattgtaattagcttttgttaaattctgaagagaaagaaagaaagaaaaaaaaggtggaagattcttattgtaaggagaggaaatgaacatatatgaagaaagggtgccttaataccattcccatttctcttctctttatcttttctttcttatgtgtataactttctt

SEQ ID NO: 397 - DNA, 2343 bp, Panax ginseng
ccccgtcgtgccggaccctgtcgcaccacgaggcgctgtctacgagtcgggttgtttgggaatgcagccccaatcgggcggtaaattccgtccaaggctaaatactggcgagagaccgatagcaaacaagtaccgcgagggaaagatgaaaaggactttgaaaagagagtcaaagagtgcttgaaattgtcgggagggaagcggatgggggccggcgatgcgccccggtcggatgtggaacggtgatgagccggtctgccgatcgactcggggtgtggacctgtgcggattggtgcggcggccaaagcccgggctgttgatatgcccgtggagacgccgtcgcgccgatcgtggttggcagcacgcgcctcacggcgtgcttcggcatctgcgtgctcctggcactggcctgcgggtaccccattcggcccgtcttgaaacacggaccaaggagtctgacatgtgtgcgagtcaacgggcgagtaaacccgtaaggcgtaaggaagctgattggtgggatccccctgaggggtgcaccgccgaccgaccttgatcttctgagaagggttcgagtgtgagcatgcctgtcgggacccgaaagatggtgaactatgcctgagcggggcgaagccagaggaaactctggtggaggcccgcagcgatactgacgtgcaaatcgttcgtctgacttgggtataggggcgaaagactaatcgaaccgtctagtagctggttccctccgaagtttccctcaggatagctggagcccgggtgcgagttctatcaggtaaagccaatgattagaggcatcgggggcgcaacgccctcgacctattctcaaactttaaatgggtaggacggcgtggctgctttgttgagccgcgtcatggaatcgagagctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgcttaagcgcgcgacctatacccggccgtcggggcaagtgccaggccccgatgagtaggagggcgcggcggtcgctgcaaaaccttgggcgtgagcccgggcggagcggccgtcggtgcggatcttggtggtagtagcaaatattcaaatgagaactttgaaggccgaagggggaaaggttccatgtgaacggcacttgcacatgggttagtcgatcctaagagacgggggaagcccgtcagatagcgcgtttcgcgcgagcttcgaaagggaatcgggttaaaattcctgaaccgggacgtggcggctgacggcaacgttagggagtccggagacgtcgggcggggccccggaaagagttatcttttctgtttaacagcctgcccaccctggaaacggctcagccggaggtagggtccagcggctggaagagcaccgcacgtcgcgtggtgtccggtgcgcccccggcggcccttgaaaatccggaggaccgagtgtcctcccacgcccggtcgtactcataaccgcatcaggtctccaaggtgaacagcctctgatcggtggaacttgcaggcagtagccatgtcgttcagaatcagagggccaaatgcttcttcagggatgggtgttgctgatcactgcaaagatacatttttggcactgcagaggaagaaggttcatcgctatgtgatttttaagattgatgagaagaaaaatgaggttgttgtggagaagactggtggtcctgctgaaagctatgatgattttacctcatccttgcccgagaatgactgtcgatatgctgtctatgactttgattacgtgacctctgagaattgtcaaaagagcaagatatttttcatggcatggtctcctgcaacttctcgtatccgtgccaagatgctctatgccacatccaaagacaggtttagacgggagatggatggtattcattatgagattcaagctactgaccctacagagatggatcttgaagtgctcagagaccgcgcacactgaagaaaataaatatatctccgaaggttttgccaactcatggaccaccacttccagctttaaaaaaactatataaatattttagtcggagaggctgattgatcttgtcagctaggttttagcattatctggccgaggtccggttatcatatgattcttctccggttgtattaatatactttgaaacctatatatctatatatttgacttcttacgaaaa

SEQ ID NO: 398 - DNA, 807 bp, Cocos nucifera
tctctctcttgtctctgagatcgaggaggagccatgtcgttccgaatgtcgagtgcatcttctgggatgggagtggctgaccacagcaagaatacatttcttgaactgaaaaggaagaaagtgcatcgatatgtgatatttaagatagatgaaaagaaaaaggaggtggttgtcgagaagacaggagctccaggggagagctatgatgattttgctgctgcattgcctgagaatgattgccgatatgctgtctatgactttgattttgtcactgatgagaactgccagaagagcaagatattttttattgcatggtctccttccatctcccgcatccgtgcaaaaatgctgtatgccacatctaaggatagatttcggcaggagcttgatggcatccattacgagattcaggccaccgaccccacagagatggatttggatgtgctcagagaccgtgcaaactaagtctaccaagttgcgcaaacctttgttgcctcaaacagtttgatctgggcatcccgtccctggtgtagttgattatgtgcattgtctggttcagtgcacaattggttatttgaataaaatagatctctacacctgaaagggctgatggaaaagctcccttgattagatagatatcatcttatatgtctgaagtgtgtgctcctctatttgaaagatttttctcagttggaaggctttggttttgttaaatgactcgaacttggaagtatctggaaacaatcttgtccaacattttatgtttgctttgttgttgtgatggtgtattgcttattagcttctttt

SEQ ID NO: 399 - DNA, 745 bp, Chelidonium majus
ttggagccatcgccatgtctttcagaatgtcaaatgcctcttctggcatgggagtagctgatcacagcaaagacacatttttggaactgaagaggaagaaaatacatcgctatgtgatttttaagattgatgagaagaagaaagaagttgtggttgagaagactggaggtccagctgagagctacgatgatttcacggcttcgttgccagagaatgattgccgatatgcagtgtatgattttgattatgtgacttccgagaattgtcaaaagagcaagatcttcttcatagcttggtctccttcgatatctcgaatccgagccaaaatgctgtatgccacatccaaggacagtattcgacgggaacttgatggtgtccagtacgagattcaagccactgaccctactgagatggaatttgaagttctcagagaacgcgcacactgaggactttgtactaagtgcaaactgcaaagggatttccattaaaagcaacagcaatgattactgcttgctgtttttatatgtgctaactgtttgttctggtatgctggcttaatcactaaataaaaattcagaacctgagaaggctgatgggaaggcttttgtctaaagacaggtaggactattatgtaggaactgtggtcttcctaacttccatgatgcttctcaggtgtaggtggatgtcgttaaatgtcgtcggtatattgccagattaactctcaaaagtatataatagaaaacgg

SEQ ID NO: 400 - DNA, 734 bp, Trifolium pratense
ttcagaatgggtgtcggagggggaaatgcatcttctggcatgggtgttgctgagcatagcgtaaccacattccaggaattgcagaggaagaaagtacatcgctatgtgattttcaaaattgacgagaaaaagaaggaggttgtggttgaaaaaaccggaggccctgctgaaagctatgatgattttactgcatccttgcctgaaaatgattgccgatacgctgtctttgactttgatttcgtgactgctgaaaactgccaaaagagcaaaatcttttttattgcatggtctccttccgtagctcgcatccgccctaagatgctttatgcaacatcaaaggacagattcagaagggagctgcagggaatccattacgagattcaagcaaccgacccaaccgagatggaactcgaagtcctcatagaccgcgcaaactgaaaggaccgtccatgtctaagtaatgtagttagtatatcttagacctcaagaaatattgttgactatgccctttaagtattagtatggtcttatcttctctgatacatttaatataaaatagcttagtttaagtaaataacatatacacctctgaaagctgatatgggttcttgtctaagaaaaaccctctgcagaggaatttgagctgttccttattgccatgatgcttctcaggtggaattaatatgcttatttatggatattgaaatttaatctttgtcaatggaggcaaaaaa

SEQ ID NO: 401 - DNA, 715 bp, Eschscholzia californica
atgtctttcagaatgtcaaatgcttcttccggtatgggagtggctgatcacagcaagaacacatttatggaactgaaaagaaagaaggtgcatcgctatgttgtctttaagatcgatgagaaaaagaaggaagtagtggttgaaaaaactggaggtgcagctgagagttatgatgattttacagcagctttgccggagaatgattgccgatatgcgatctatgacttcgattatgtcacctctgagaattgccaaaagagcaagattttcttcattgcgtggtcaccttcagtatctcggatccgttccaagatgctttacgcgacatccaaagacaggttccgacgagagcttgatggtatccactacgagattcaagcaactgacccaacagagatggaacttgacgtgctcagagaacgagcccactgagcaatatttatattacagaaaggcatgaacaaccaaagaaattgattgatagagaaggaagtgagtgctcttcactcagtatatgttactgattctgaacaacttatggcttaatcactgaaataaaatcaacacccgagaaggctgataggaagcttgtctacttatatttctgacgagctttcttattgccatgatgcttctcaggtgaagatgggtttggttattattacaatatttgttcgaatgactctaaactttatatttatgaaattggtttgat

SEQ ID NO: 402 - DNA, 859 bp, Euonymus alatus
agcgaatttaattaaattcacttttttgtttcttctggttcagtggttgcgtttgagagcgctttctcttatttcgccgttgtttgattcgatcagccatgtctttccgagggacaaatgcttcgtctggcatgggtgttgctgaggacagcaaaagcacataccatgaactgcaaaggaagaaagtacaccgctttgtgatctttaaaattgacgagaagaaaaacaaagtcatggttgagaaaactggcggcccagctgagacctatgataatttcactgcttcattgcctgagaatgattgccgatatgcagtttatgacttcgattttgtgacttctgagaactgcaagaagagcaagatctttttcattgcatggtctccatccgtgtccgggattcgttccaagatgctttatgcatcatccaggaacagtttcagaagggagcttgagggcattcattatgaaattcaggcaactgatccaactgagatggagcttgaagttctcagagaacgtgcaaactgagcatatactttcatatcaaacattttcacaggtttgagaatccaacatatgttacgcgtgcaatcatacagaagccacattgttgttctgattgtgcagtatatctgacaaaaaaagtagatgtagcttaatatgttaaaagtaatcagcacatgcgaagactgattaggagctcatttgagctccttgctgccatgatgcttcgaaggtgaagtatatgagtactagcccccgttatggagacaattgttgcatatatgctatcttaaattgttctaatatcctaacgcatttgaaacaacatttggagtatcatttaaccccaagct

SEQ ID NO: 403 - DNA, 781 bp, Nuphar advena
ctctccatacccctctctctctctctctctgctgatcggccgccaatatgtctttcaggatgtcgagtgcttcttctgggatgggagtgtccgatcattgcaagaccaccttcctggagctgaagaggaagaaggtccatcgctatataatcttcaagattgatgagaagaaaaaagaggttgtggttgagaagaccggtggtcctgcagagagctatgccgattttgcggcctcacttcctgagaatgattgtcgatatgcagtgtacgactttgatttcgtgactgcagagaactgtcagaaaagcaaaatcttcttcattgcttggtctccttcagtatcgcgtattcgagccaagatgctctatgcaacttccaaggataggttccgcagggagctggacggtattcactatgagctccaggcgacagacgccactgagatggatcttgaagtgattcgagaccgagcaaattaacatctactatggcaagttagtatttaaaactgattgccaggtatgatcagaatgatattgggaggcgaccatctgaggaacttctctgctcagttactagctatatacatgaattttgttgagatccatactgttaaagaaggcaaaaagaaaaaaaattgttgaaaatatttgcttggtgtttgaattgtctaggtgtttctgctttacgccggtgggcttgactttaaataactccttttacacaaaaaacatcagacttggatacgtgtctttatgatactttgttctgttgtttgctt

SEQ ID NO: 404 - DNA, 1025 bp, Silene vulgaris
atcaaatcaagttctcaataaatttcaatcggcacttcctctgccctttaactctatcaattcatcatctttcttattttgtttctttaattttgatcttgatttcatttgagttggttgatgggtagtatttgattttgttgattttgttaaagggagatggagagggcaaaacggagacaagtatgagatcggaattactgctcaagcttatgaatttgcgatgatgattgactgaaattagcggcaaaactaagcaactatggctttcagaggggggaatgcttcatcaggcatgggagttgccgagcactgcaaaaacacatacatggaactacaaaggaagaaagtgcatcgatatgtggtgttcaagatcgatgagaaaaagaaggaagtagttgtcgaaaagactggaggacctgctgagagttatgatgatttccttgaatcgttgcctgataatgattgtcgctatgctgtttatgattatgactttgtgactgctgagaactgccagaagagcaaaatatttttcatagcctggtctccatcagtatcccgaatacgctccaagatgctctatgctacatccaaggacagattcaggagggagctccaaggaatccactacgagattcaggccactgatccaaccgaggtggatctcgaggtgctccaagaacgagccaactgacttaactgctgaagtaacgtcaatttaacattacttatgcatgcatctatattaccagtctgtcgtaaaataacacagtatcctagctcaagatgctaactttcctcgttactgtgacattttccattccgactaatgtttcagatagtccatttcgctgtatatggatttacgtgacttctatttgatcttcgttgaattatgtatcgccaattcgcagtacgtaacctgtccatgattgaattgtctggtttgttgatgccaattatggaaggggttggaagtaagtggacaataattgctgaaaagatgtaacatctagaattagtga

SEQ ID NO: 405 - DNA, 699 bp, Cyclamen graecum
tccttccgtggcttacttttattcccctttctttctctctctgatcatcggttgcagccatggctttcagagggatatttcaaagaaatgcatcctctggcatgggtgttgcagaccacagcaaaatcacatatacggaattgcagaggaaaaaggttcaccgttatgtgatctttaagattgatgaaactaaaaaggaggtagtggtcgaaaagactggaactccagccgagagttatgatgattttactgcatctctgcctgaaaatgattgccgatttgcagtatatgactatgattttgtgacttctgagaactgccaaaagagcaagatctttttcattgcatggtcaccttcagcgtcaagaatccgtgctaagatgctgtacgccacatccaaggtaaggttcagaagggagctagaaggcattcattacgagatacaggccaccgaccccacggagatgggccttgatgtgatccaagagcgtgctaactgaacctcttgatcaagtacagtcatgtactctaatatgcacctcttttatctgtttacatatagtttaatttccgtaaataatctgagatctggtgaaggctgattaggaaccggcttctgtggttccttattatcatgaagcttctcagatggaacatggtgctgtttaatgctaattattaagttcgtcgattggttga

SEQ ID NO: 406 - DNA, 968 bp, Cajanus cajan
atataatatcttttacacataaatgatttaaccaaatttgttcctatctgtgttttgttttctccacacaatctctctctctctctctctctacaaacccttctttcttctcttggctgctcactgtaacttggcgaagccatggctttcagagtcggagagggaaggggaaacgcctcctctggcatgggtgttgctgagcatagcgtaaacacattcctggagttacagaggaagaaagttcatcgctatgtgatttttaaaatcgatgagaaaaagaaagaggttgtggttgaaaaaactggaggtcctgctgagagctatgatgatttcactgcatccttgcctgaaaatgattgccgatatgctgtctttgactttgattttgtgacatctgagaactgccaaaagagcaagatcttttttatagcatggtctccttcagtagcccgcattcgccctaagatgctttatgcaacatccaaggacaggttcagaagggagctgcagggcatccattatgagattcaggcaacagacccaacagagatggatcttgaagtcctcagagaccgtgccaactgagcaccgttgtgtctaggtgatgtagttaggatatctgagtcctaagggaatgatgttgactgataccctttagttctactatggtctttgtttcaacataaatagctgacttgtcatttatcaagtaaataacctacacctgtgaaggctgattaggggttcctgcctaagaaaccccactgcgggggaatttgagctcttccttattgccatgatgcttctcaggtgcagattaatatatcaattactattgaaaattcgacttatcttctatgactttcaaatggaagcatttggtgaatctactttgtgacatgtcaattcatgtatggattcatttttgtgccttcagtagaaatgatggaaattatgcacggcaaaca

SEQ ID NO: 407 - DNA, 971 bp, Glycine max
tcctttgttctcctttttttctcctcttctgccctccacacaacttctctctcctctctctctctctacaaatccttctttcttctcttcgctgctcactgtagcgtagccatggctttcagagttggaggagcgggaggaggaaatgcctcttctggcatgggtgttgctgagcatagcgtaagcacgttcctggaattgcagaggaagaaagttcatcgctatgtgatttttaaaattgacgagaaaaagaaagaggttgttgttgaaaaaactggaggccctgctgagagctatgatgatttcactgcatccttgcctgaaaatgattgccgatatgctatctttgactttgattttgtgacatctgagaactgccaaaagagcaaaatcttttttattgcatggtctccttcggtagcccgcattcgccctaagatgctatatgcaacatccaaggacaggttcagaagggagctgcagggcatccattatgagattcaggcaacagacccaaccgagatggatcttgaagtcctcagagagcgtgcaaactgagcacctacacaagagggttgtgtctaggtgatgtagttaagatatctgaggcctcagggaatgatgttgactgataccctttagttgttctactatgatctctgtctgtttcgcgacatatttctcataaatagctgacttatcattttatcaagtaaataacctgcacctgtgaaggctgattaggggttcctgcctaagaaaccccactgcaggggaatttatgcttttccttattgccatgatggttctcgggtgcagatttatatagtaatggctattggaaattcgacttatattctatgaatttcaaatggacgcagctggtgagtctgctttgttacatgccaatccagtataggtttgtttttgtagcgaattccagcattggaatatttgctttctgaaccaag

SEQ ID NO: 408 - DNA, 746 bp, Glycyrrhiza uralensis
ggttgcattttctccttttttttcctctccacataatttctctctcctctctctttctctctctacaaatccatctcattcctttgctcctcactgtagcagctgcatagccatggctttcagaatgggagtcggaggtggaaatgcctcttctggcatgggtgttgctgagcatagcgtaagcacattcctggaactgcagaggaagaaagtacatcgctatgtgatttttaaaattgatgagaaaaagaaagaggttgtggttgaaaaaactggaggccctgccgagagctatgatgatttcgctgcatccttgcccgaaaatgattgccgatatgctgtctttgactttgattttgtgacatctgagaactgccaaaagagcaaaatcttttttattgcatggtctccttctgtagctcgcattcgccctaagatgctttatgcaacatcaaaggacaggttcagaagggagctgcagggcatccattatgagattcaggcaacagacccaacagagatggatctcgacgtcctcagagaccgtgcaaactgagcacctacacaaactgagaagggttgtttctaggtgatctagttagtatatctgaggcctcgaggaatgttgttgactgctacccttaagttttagtatgttcttgtctgttccgacatatgtcatataaatagcttacttttcaagtaaataacctacacctgtgaaggctgatttggggttcctgcct

SEQ ID NO: 409 - DNA, 787 bp, Nicotiana benthamiana
tctttctctctctctctctaaccatgtctttcagaatcaggggtgggacaaatgcatcctctggcatgggggttgctgatcaaagcaaagctacatacatggaactgcagaggaagaaggtgcatcgatatgtgatatttaagattgacgagaagaagaatgaggttgtggttgagaaaactggaggtccagctgagagctatgatgatttcactgcagctcttcctgagaatgactgccgatacgcggtgtatgattacgatttcgtgacatctgagaactgccaaaagagcaagattttcttctttgcctggtctccttctgtttcccgtatccgatccaagatgctgtatgccacatctaaggacagattcaggagggagctggaaggcatacactacgagattcaggctactgaccctactgaagtagaacttgaagtgctcaaagaacgcgctaactgattgaatatcccttaaatgaaacaaccattcgtaatatttttgtctaattgcaacctaaaaggcttgatttactttaactacccattgtgcaatacctccacatggcacaaattgcctatggggtaaataactcggcacttgggatactgattaccagactcatgataacgatatcgtgttttctggttatgggttctcatgcttcccagccgagaaacgggtatggttatgtatgtgaatgattcaaatatcaactacagtatgtctcagcaatgaatattatgtgttatttagcatctcattgatgattgattgttgttttt

SEQ ID NO: 410 - DNA, 961 bp, Amsonia hubrichtii
tccgtccaaaactttgaaaccaaacagccacacccaactgcatcattagagacgtaagctttgaggagttatataatcttgttccttccctatcttctctaactatttgaaagttcaatcttcttgctgtttcttcagttttctcaccccatccagccatgtccttcagaatcagaggaccaaatgcttcctcaggaatgggtgttgctgatcacagtaaagaggcattcatggagctcaagaggaaaaaagtttatcgctatgtgattttcaagattgatgagaagaagcaggagattgttgttgagaagactggcaatcctgcagaaagctatgatgattttactgccgccttgcccgagaatgactgcagatttgctgtgtatgactttgattttgttacctctgagaattgtcaaaagagcaagatattcttcattgcttggtctccttccatctctcgaattcgtgccaagatgctctatgctacatccaaggacaggtttagaagagaattggatggaattcattatgagattcaggctactgatcctacagaaatggatcttgaagtgctcagggaccgtgcacactgaagcttgagtggattccaggtttttccctctcgacaacaaaggactcaaagggttagctcactcatcaaatcactgctttgcggatcctttattcatgtacagatctatttccagcacaagtaattcaaaaataatgatgcccggaaaggcagaattcaagcctggcctgtggtttgttgttgtcatttgcttctcaaatggaactgactactggtattcgtgaacacttgctctctgaccccaggactcagattcttgggcttttattatatatttatatgatgaattcgtcttgacagttcatctatgcctctctgttgagctctcaattaccaaaaggatcgattctcaaaaagacactccgt

SEQ ID NO: 411 - DNA, 813 bp, Panax ginseng
ttttatcttgcttttcccatcaaaacatcatcccaccaaatttatttaattctatttctatttctgtttaaaaaagtaacaccccttcggtctcttcatcggtggaacttgcaggcagtagccatgtcgttcagaatcagagggccaaatgcttcttcagggatgggtgttgctgatcactgcaaagatacatttttggcactgcagaggaagaaggttcatcgctatgtgatttttaagattgatgagaagaaaaatgaggttgttgtggagaagactggtggtcctgctgaaagctatgatgattttacctcatccttgcccgagaatgactgtcgatatgctgtctatgactttgattacgtgacctctgagaattgtcaaaagagcaagatatttttcatggcatggtctcctgcaacttctcgtatccgtgccaagatgctctatgccacatccaaagacaggtttagacgggagatggatggtattcattatgagattcaagctactgaccctacagagatggatcttgaagtgctcagagaccgcgcacactgaagaaaataaatatatctccgaaggttttgccaactcatggaccaccacttccagctttaaattatctgcagaacctgttttagttttttttatttaaaaaaactatataaatattttagtcggagaggctgattgatcttgtcagctaggttttagcattatctggccgaggtccggttatcatatgattcttctccggttgtattaatatactttgaaacctatatatcatatattgacctattaaaacaa

SEQ ID NO: 412 - DNA, 1053 bp, Panax ginseng
tactcccctgtgtgccttggcagtctcagaagcagtggtatcaacgcagagtacatggggaattctatttctatttttatttctgtttaaaaaagtaacacccctttggtctcttcatcggtggaacttgcaggcagtagccatgtcgttcagaatcagagggccaaatgcttcttcagggatgggtgttgctgatcactgcaaagatacatttttggcactgcagaggaagaaggttcatcgctatgtgatttttaagattgatgagaagaaaaatgaggttgttgtggagaagactggtggtcctgctgaaagctatgatgattttacctcatccttgcctgagaatgactgtcgatatgctgtctatgactttgattacgtgacctctgagaattgtcaaaagagcaagatatttttcatggcatggtctcctgcaacttctcgtattcgtgccaagatgctctatgccacatccaaagacaggtttagacgggagatggatggtattcattatgagattcaagctactgaccctacagagatggaccttgaagtgctcagagaccgcgcacactgaagaaaataaatatatctccgaaggttttgccaactcatggaccacttccagctttaaattatctgcagaacctgttttagttttttttttaaaaaaaaactatataaatattttagtcggagaggctgattgatcttgtcagctaggtctagcattatctggccgaggtccggttatcatatgattcttctccgattgtattaatatactttgaaacctatatatctatatatttgacttcttacaaaaaaaaaagaaaaaactgcactctgcgttgataccactgcttcgtgagattcaatgtgttggaggtgatcccagctgggtcttctggtggtggtggtggaaagaaggtcttttacgggcatttgagtttgagttttctggtcagtgttataatagtttggggaggactgtttgtttttactactttggctaggtaggacttacccgttgactttgaaccttgaatg

SEQ ID NO: 413 - DNA, 905 bp, Panax ginseng
gaaattaaaaagagggaaaaaggaagtggaaaagagaatatttattttcctcgattaatttggttggttgtatttttcttctctctttcatcatctttttatcttgcttttcccatcaaaacatcatcccaccaaatttatttatttctatttctattttatttctgtttaaaaaagtaacaccccttcggtctcttcatcggtggaacttgcaggcagtagccatgtcgttcagaatcagagggccaaatgcttcttcagggatgggtgttgctgatcactgcaaagatacatttttggcactgcagaggaagaaggttcatcgctatgtgatttttaagattgatgagaagaaaaatgaggttgttgtggagaagactggtggtcctgctgaaagctatgatgattttacctcatccttgcctgagaatgactgtcgatatgctgtctatgactttgattacgtgacctctgagaattgtcaaaagagcaagatatttttcatggcatggtctcctgcaacttctcgtattcgtgccaagatgctctatgccacatccaaagacaggtttagacgggagatggatggtattcattatgagattcaagctactgaccctacagagatggaccttgaagtgctcagagaccgcgcacactgaagaaaataatatatctccgaaggttttgccaactcatggaccacttccagctttaaattatctgcagaacctgtttttagttttttttaaaaaaaaactatataaatattttagtcggagaggctgattgatcttgtcagctaggtctagcattatctggccgaggtccggttatcatatgattcttctccgattgtattaatatactttgaaacctatatatctatatatttgacttcttac

SEQ ID NO: 414 - DNA, 755 bp, Solanum tuberosum
tctttctatagtctctctctctctaggtcgctgctgatcgctttaaccatgtctttcagaatcagagggacaaatgcatcctctggcatgggggttgctgatcaaagcaaagctacttatatggaactgcaaaggaagaaggtgcatcgatatgtgatatttatgattgatgagaagaaaaatgaggttgtggttgagaaaactggaggtccagctgagagctatgatgatttcactgcagctcttcctgagaatgactgccgatatgcagtatacgattatgacttcgtgacacctgacaactgccaaaagagcaaaattttcttctttgcctggtctccgtctgtttcccgaatccgatcgaagatgctgtatgccacatctaaggacaggttcaggagggagctggaaggcatacactatgagattcaagctactgaccctactgaagtagaacttgaagtgctcaaagaacgcgcttactgattgatcaaacatcctactatgaaccaaccattcataatatttctgtgtaatcgcgtcttacaaggctcgatctacttaactatatggcataaataactcggcgcttgggttgctgattaccagactcctcatgatagtatatatatcatgttttctggttatgagctcgctcattctcatgatgcttcccagtcgagaaacgagtatggtgttctgtatgtgaatggttatcaaattcttcagtatgtctacgcaatgaatattatgtg

SEQ ID NO: 415 - DNA, 871 bp, Sarracenia psittacina
ccgtccaaaaattcgaaacctcattttatttcataggtgtttgtaggttctcatagaccgattttatatagagtcctctctgtgttgttttggatttctctttgggactgttcacgccagccatgtcgttcagaattagggggcaaaatgcatcttcaggcatgggtgttgctgatcacagcaaagaaacattcttggaactgaagaggaagaaggtttatcgctacgtgattttcaagattgatgaggccaaaaaggaagttattgttgagaagaccgggagtcctgctgagagttatgatgattttgctgcagccttgcctgaggatgattgccgatatgccttgtatgacttcgattttgtgacttctgagaattgccagaagagcaagatattcttcatcgcatggtcacctgcagtctcccgaattcgtgccaagatgctgtatgccacatccaaagaccggtttagacgagagctcgatggtatccattatgaaattcaagctacggaccctacagagatggatcttgaagttctcagagaccgtgcacgttaaattggctgctgttcaattttctttcttggaaaagaggaaattgaagtttgtttgggttttctttgccaagttatggatcggtgttgcctgtttcttttatctcatttgcttcacccatttctggcacaagaaaagtatttgcttaaataattggcacccaggaaggctggtatgaagctctggtctaatgtcatctgtgcttgttgtatgacttctgttatggttgttgcttctcagatagtatctgtgtactcgggaaaaaaacataattatgtattctgtttcttacaataatactcaatcctcttaag

SEQ ID NO: 416 - DNA, 772 bp, Sarracenia psittacina
accgattttatatagagtcccttctctgtgttgttttggatttctctcttggactgttcacgccagccatgtcgttcagaattagggggccaaatgcatcttcaggcatgggtgttgctgatcacagcaaagaaacattcttggaactgaagaggaagaaggtttatcgctacgtgattttcaagattgatgaggccaaaaaggaagttattgttgagaagaccgggagtcctgctgagagttatgatgattttgctgcagccttgcctgaggatgattgccgatatgccttgtatgacttcgattttgtgacttctgagaattgccagaagagcaagatattcttcatcgcatggtcacctgcagtctcccgaattcgtgccaagatgctgtatgccacatccaaagaccggtttagacgagagctcgatggtatccattatgaaattcaagctacggaccctacagagatggatcttgaagttctcagagaccgtgcacgctaaattggctgcagttcaattttcttcttggaaaagaggaaattgaagtttgtttgggttttctcgtcctaagttatggatcggtgttgccttgtttctttatctcatttgcttcacctatttctggctacaagtaaagtatttgacttaaataattggacacccaggaaggctggtatgaagctctggtctaatgtcatctgtgcttgttgtatgactctgttatggttgttgcttctcagatagtatctgtgtactcgggaaaaaaa

SEQ ID NO: 417 - DNA, 863 bp, Solanum phureja
cgaaccaatgagtcatgctgcattagattgttgtacgtagtgcttatccacttgtacactatcgtttatttttccttcggtggctgcttttgattctacttcaaatttcaaacaattctctttctatagtctctctctaggtcgctgctgatcgctttaaccatgtctttcagaatcagagggacaaatgcatcctctggcatgggggttgctgatcaaagcaaagctacttatatggaactgcaaaggaagaaggtgcatcgatatgtgatatttatgattgatgagaagaaaaatgaggttgtggttgagaaaactggaggtccagctgagagctatgatgatttcactgcagctcttcctgagaacgactgccgatatgcagtatacgattatgacttcgtgacacctgacaactgccaaaagagcaaaattttcttctttgcctggtctccgtctgtttcccgaatccgatcgaagatgctgtatgccacatctaaggacaggttcaggagggagctggaaggcatacactatgagattcaagctactgaccctactgaagtagaacttgaagtgctcaaagaacgcgcttactgattgatcaaacatcctactatgaaccaaccattcataatatttctgtgtaatcgcgtcttacaaggctcgatctacttaactatatggcataaataactcggcgcttgggttgctgattaccagactcatgatagtatatatatcatgttttctggttatgagctcgctcattctcatgatgcttcccagtatggtgttctctatgtgaatggttatcaaattcttcagtatgtctacgcaatgaatattatgtggtgttagta

SEQ ID NO: 418 - DNA, 933 bp, Coffea canephora
ggggtatgcatcatattcattctctaagaaaaaacaattcttgggtgggtactttttattctctttttcttcacaatacatgtaactctcacttattctctggtctgaagctacacaaatccatcagcgcatctgctcatcatcttctctcttcggtagccatgtctttcagcagagccacgtctttcagcagggggcccaatgcatcatctggcatgggtgttgctgaacattgcaaaagcacatacctcgaattgcagaggaaaaaggtgcaccgctatgtgattttcaagattgatgagatgaaaaaagaagtggtggttgaaaaaactgggagcccatctgagagctatgaagatttcactgcatctctacctgagaatgattgccgatatgcagtatacgactttgattatgttactgctgagaactgtcaaaagagcaagatctttttcattgcatggtctccatctgtgtccaggatccgtccgaaaatgctgtatgccacatctaaggataggttccgaagggagctgcagggtatccattatgagatccaggccactgatcctactgaaatggagcttgatgttctcagagaacgagcaaattaaaccacaccctttctatttctcaagggcttctttctacctctgggaaaattactcatgtcattttaactgtaagacgggttgggctttaatcattaatgttgtgcagaacctgtttctgacaacatataggctcatcataaataatcgtttccctgggaaggctgattaggagctcttgcatattgtatcccaacctatggggattattggggttcctcattttcatgatgcttctcagatggaagatgggtatggttactgattatataatattactagcattactttgtattttatgaacggcgttggcttgtttaat

SEQ ID NO: 419 - DNA, 1000 bp, Elaeis guineensis
ccccattcctctcttcattcatccatccatccatccctctctctctctctctctctctgcctgcctctgagatcgaggagcagccatgtcgttccgaatgtcaagtgcatcttctgggatgggagtagctgaccacagcaagaatacatttcttgaactgaaaaggaagaaagtgcatcgatatgtgatatttaagattgatgaaaagaaaaggaggtggttgttgagaagacaggagctccaggggagagctatgatgattttgcggctgcattgccggagaatgattgccgatatgctgtctatgattttgattttgtcactgatgagaactgccagaagagcaagatattttttattgcatggtctccttccatctcccgcatccgtgctaagatgctgtatgccacatctaaggatagattccgacaggagcttgatggcatccattacgagattcaggccactgaccccacagagatggatttggatgtgctcagagaccgtgcaaactaagtcgatccagttgcgcaaacttttgttgcgacaaacagtttgatctgggcatcccatcctcaggtgtggttgattatgtgcattgtctcgttcaatgcacaattggttatttgaataaatagatctctacacctggaagggctgatggaagagctaccttggttaaatagatattatcttagatgtctgaagtgtgtgctcctctatttgaaagatttttctcagttagagggctttggttttgttaaatgactcgtgctcagaagtatctggaaacaatcttgtccaacatttcatgtttgctttgttgctgtggtggtggtttgcttattagcttctttcttttcaccatttcgcttgagggtgatcatcatttgctttggcattatgtagtagaatagagggacgtttccctggttagtggattgatgcatatcatctcttcaacagcaatatcgaagctgtttcccggaaaaaaaaaaaa

SEQ ID NO: 420 - DNA, 990 bp, Amorphophallus konjac
gaagccccaaaggtatttccttcaagagcaccagggttggactgaaggccccaaccccaccacttccccatccgtgatttggaaggatggctttcagaacatcaactgcatcctctgggatgggtgttgctgatcactgcaagcacacctacctggagctccagaggaagaaggtgcaccgttatgtcatcttcaaaattgatgaaaagcgaaaggaggttattgttgagaagacaggaggtgcagcagagatctatgatgattttctagcttctttaccagaaaatgactgccgctacgcaatctatgattttgactttgtcactgaggagaactgtcagaaaagcaaaatattttttattgcttggtccccatcaacctcccgaatcagagcaaagatgttgtatgcaacctcgaaggaccggttcaggcgagagctggatgggatccactatgagattcaggccactgacccctcagagttggacatagaagtcctcagagagcgtgcaaattgaactttggtagagaagtgattgagatgcaaaaatatgatgccagtttgctggctttcttttaaatgtgtaagacagttctcttcttttatgttatcttctgcataggaacagataagacttgttgatgactgctttctatggaccggggaagagacctataaaatactagtacctttgagaaggtatggatgcttgtttcatgagatgcaattcccttgctcggtgtcttgagcagatctcttcttccctatcttcctatgaattcaattacgcctccttttggtaggaagaattcgggaatgaaaggacaagctcaacagtgttcgggataaaagtctaacccccaggttatgacaactgctggtgctgcctaaatgcagcagttgggttttcaccctatgtatccttcctgatatatacaagagaggtacccttttgtgtttgttttttctcttattcctcaatactattg

SEQ ID NO: 421 - DNA, 864 bp, Euonymus alatus
aaagaagaagcgaatttaattaaattcacttttttgtttcttctggttcagtggttgcgtttgagagcgctttctcttatttcgccgttgtttgattcgatcagccatgtctttccgaaggacaaatgcttcgtctggcatgggtgttgctgaggacagcaaaagcacataccatgaactgcaaaggaagaaagtacaccgctttgtgatctttaaaattgacgagaagaaaaacaaagtcatggttgagaaaactggcggcctagctgagacctatgataatttcaccgcttcattgcctgagaatgattgccgatatgcagtttatgacttcgattttgtgacttctgagaactgcaaaaagagcaagatctttttcattgcatggtctccatccgtgtcccggattcgttccaagatgctttatgcatcatccaggaacagtttcagaagggagcttgagggcattcattatgaaattcaggcaactgatccaactgagatggagcttgaagttctcagagaacgtgcaaactgagcatatactttcatatcaaacattttcacaggtttgagaatccaacatatgttacgcgtgcaatcatacagaagccacattgttgttctgattgtgcagtatatctgacaaaaaaagtacatgtagcttaatatgttagaagaaatcagcacatgcgaagactgattaggagctcgttttagctccttgctgccatgatgcttcgcaggtgaagtatatgagtactagcccccgttatggagacaattgtagcatatatgctatcttaaattgttcttatatcctaacgcatttgaaacaacatttggagtagcatataaggagca

SEQ ID NO: 422 - DNA, 1101 bp, Papaver somniferum
cattctcacttgctttcacagtaaacacacctctttccctgtaacttcatttctcatctcacgaagagacagccttatcatccatctctctctctctttcagccatgtctatcagaatgtcaaatgcttcatctggtatgggagtatctgatcacagtaaggatatattcatggaactaaagagaaagaaagtacatagatatgtggtgtttaagattgatgagaagaaaaaagaggttgtagttgaaaaaactggaggtccagctgaaagttatgatgatttcactgcatctttaccagagaatgattgccgttatgccgtttatgatttcgattatgtcacctctgagaattgccagaagagcaagattttcttcattgcatggtctccctcagttgctcgtattcgatccaagatgctttacgctacatccaaagacaggttccgacgagaacttgacggtattcactacgaaattcaagcaactgaccctgatgaaatggaacttgaagcactgagagaacgtgctcattgaggatctatcttaaaatttcaattgtaaaatggtattgtggtgacgaattaaattgaggttaggcattatctgatggatgcaaatggaagtgacatttcacattagttgataatgaatgacagggtcagtatagaagctaataggaagtggttccggaagtcatggtattgagttttcttactgccatgaagtcttatcgatttattactgttgaaatgaatctacaatatatagttatctattttctaaataaaaacagtgggttggcagactaactagatacgattatttccttactatatttgtatactgggtgtaatgttgagtttgaattgaaatttgagatatggcagggttcgtgtgatccatttaaggcctaatggcctataatgtagttttctttagccatgccttgtataagactccatagtccatatgcttatcaagtcctacatcactataaattgaataaagagtttcctttggcacttgggataaagcagcttcaatgtagcttttgtacttcttttacttcagtagattaaagtgtatcactcgtctctaa

SEQ ID NO: 423 - DNA, 901 bp, Papaver somniferum
tctcatctaaccaagagccagccttatcatccttcactctttcagctatgtctaccagaatgtcaaatgcttcatctggtatgggagtatctgatcacagtaaggatatcttcatggaactaaagagaaagaaagtacatagatatgtggtgtttaagattgatgagaagaaaaaagaggttgtagttgaaaaaactggaggtccagctgaaagttatgatgatttcactgcatctttgcctgagaatgattgccgttacgctgtttatgatttcgattatgtcacctctgagaattgccagaagagcaagatattcttcattgcatggtctccctcagttgctcgtattcgatccaagatgctttacgctacatccaaagacagattccgacgagaacttgacggtatccactatgaaattcaagcaactgaccctgatgaaatggaacttgaagcgctgagagaacgtgctcattaaggatctatcttaagatttcaattgtaaaatggtgttgtggtgacgaattaaattgaggtaaggcattgtctgatggatgcaaagggttgtgacatttcgtattagttactgcagtatagataagtttaactagcatagaaaagccaaggggattagtcattaaaataaaattcaacagctgggaaggcaaataggaaattgttcaggaggtcatggcattgagttctcttggcatgaagtcttatcaattcattattactgttgaaatgaacctacaatatacagtcatctattttcttaaaaacaaaaaaaatgggttaccagactcgatggttatggggtgtaatgttttgtttgaattgaaatttatcactcgcgtctcaaatataattttgtgtttctttcttttcctttgtcgaata

SEQ ID NO: 424 - DNA, 744 bp, Papaver somniferum
gatctaaccaagagccagccttatcatccctctctctctttcagctatgtctatcagaatgtcaaatgcttcatctggtatgggagtatctgatcacagtaaggatatattcatggaactcaagagaaagaaagtacatagatatgtggtgtttaagattgatgagaagaaaaaagaggttgtagttgaaaaaactggaggtcctgctgaaagttacgatgatttcactgcatctttaccagagaatgattgccgttatgctgtttatgatttcgattatgtcacctctgagaattgccagaagagcaagattttcttcattgcatggtctccctcagttgctcgtattcgatccaagatgctgtacgctacatccaaagacaggttccgacgagaacttgacggtatccactatgagattcaagcaactgaccctgatgaaatggaacttgaagctctgagagaacgtgctcattgaggatctatcttaagatttcaattgtaaatggtgttgtggtgacgaattaaaatgaggcaagacattatctgatggttgcaaatggaagtgacatttcgcattagttgagttctctccgcagtatatgataagtttaaccagcatggaagctagtaggaagttgttcagaaagtcatgatattgagttttcttactgccatgaagtctaatggatttattactgttgaaatgaatctgcaatatatagttatctattttctaaataa

SEQ ID NO: 425 - DNA, 929 bp, Glycine max
attttctttacacataaaaaatatttttaaccatttttctcctgccagtgttttctccttttcttctctccacacaatttctctctcctctctctctctacaaatccttctttctttcttctcttcgctgctcactgtagccatggctttcagagtaggaggagcgggagggggaaatgcctcttctggcatgggtgttgctgagcatagtgtaaacaccttcctggaattgcagaggaagaaagttcatcgctatgtgatttttaaaattgatgagaaaaagaaagaggttatcgttgaaaaaactggaggccctgctgagagctatgatgatttcactgcatccttgcctgaaaatgattgccgatacgctgtctttgactttgattttgtgacatctgagaactgccaaaagagcaaaatcttttttattgcatggtctccttcagtggcccgcattcgcccgaagatgctatatgcaacatccaaggacaggttcagaagggagctgcagggcatccattatgagattcaggcaacagacccaacagagatggatcttgaagtcctcagagaacgtgcaaactgagcagtcacctacacaagaggcttgtgtctaggtgatgtagttagaatatctgaggcctcagggaatgatgttgactgatgataccctttagtttttctactatgatccctgtctgtttcgacctatttctcgtaaattagctgacttgtcatttatcaagtaaataacctgcacctgtgaaggctgatcaggggttcctgcctaagaaaccccactgcaggggaatttatgcttttccttattgccatgatgcttctcaggtgcagattaatacagtaatcgctattggaaattcgacttatattatatgaatttcaaatagacgcaattggtgagtcta

SEQ ID NO: 426 - DNA, 853 bp, Vigna unguiculata
agggtgacacaatttctctcacctttctctctctccgcaaaacccatctttcatctcactgtacccatggctttcagagtaggagggggagggggaaatgcctcttctggaatgggtgttgctgagcatagcgtaaacacgttcctagaattacagaggaagaaagttcatcgctatgtggtttttaaaattgatgagaaaaagcaagaagttgtggtggagaaaaccggaggccctgctgagagctatgatgatttcactgcatccttgcctgaaagtgattgccgatatgctgtctatgactttgattttgtgacatctgagaactgccagaagagcaaaatctttttcgtggcatggtctccttcagtatcccgcattcgctctaagatgctttatgcaacatcgaaggacaggttcagaagggaactacagggcatccattacgagattcaggcaacagacccaacagagatggatcttgaagtcctcagagagcgtgcaaactgagcagctacacaagatggtcgtgtttttaggtgatctagttaggatgtatgagaccttgagggaatgatgttgattgataccctttagttctaccatgttctatgtctgtttcgatatatttcacttaaactgctgacttatcatttatcaagtgaataacctgcacctgtgaaagctgattaggggttcctgcctaagaaactccactgcagagaaatttcaacatttccttattgccatgatgcttcataggtgcagattaatatattaatggctattgaaaaatgaacttatattctatgaatttcaagtggaagttggtgaatctactttgttacttttt

SEQ ID NO: 427 - DNA, 910 bp, Medicago truncatula
tttttgtcgaatttagcttaggtgactggtcgcattttctcctttttcatctccacacaattctctctctcctctcactttctctctctacaaatccatctaaattcttgactcttcactgtagcagcttcatagctatggctttcagaatgggagttggagggggaaatgcatcttctgggatgggtgttgctgagcagagcgtaagcacatttcaggaattgcagaggaagaaagtatatcgctatgtgattttcaaaattgatgagaaaaagaaagaggttgtggtcgaaaaaactggaggcccttctgagagctatgatgatttcactgcatccttgcctgaaaatgattgtagatatgcagtctttgactttgatttcgtgactgctgagaactgccaaaagagcaaaatcttttttatcgcatggtctccttccgtagctcgtattcgtccgaagatgctttatgcaacatcaaaggacaggttcagaagggagctgcagggaatccactatgagattcaggcaacagacccaacagagatggaactcgaagtcctccaggagcgtgcaaactaagcacctaaacaaactgaaagggttatgtctaagtggtgtagttaggatatcttagacctcaagaaatgttttcaacaaataccctttaagtagtattattatggtcttgtcttctctgacatatttcatataagtagcttagttcaactattcaagtaaataacattcacctgtgaaggctgatactgatatgggttcttgcctaagagacccctctgcagaggaattttagctgttccttattgccatatgatggttctcaggtggaattaatatgcttattttatggatatttgaacttaaagtatgtatttggtgtgtcatatttg

SEQ ID NO: 428 - DNA, 841 bp, Euonymus alatus
tttcttttctttctggttactttgtttttgaacaccctctgctgttcaacaatcaacactcagtagtctgcacattcagaggagttggtcatggcttttcgaggatttggtcggcccaatgcttcatcaggcatgggcgttgctgatcacagcaaaaatgcatttacggaactgcagaggaagaaggtatatcgctatgtgatctttaagattgatgagaagaagagagaggtcgtggtagagaagactggcggccctgctgaaagctatgaggattttacagctgctttacccgagaatgattgccgatacgctgtttatgactttgattttgtgacctctgaaaattgtcaaaagagcaagatattcttcattgcctggtctccttcaagctctgggatccgtgccaagatgctctatgccacaactaaagacacgtttagaagggagctggatggtatccactatgagattcaggctactgaccctacagagatggatcttgatgtgatcagagaccgtgcaaactgaatatctgcaacatataatggtgtcctggaaaaaatatctctgccttacctttgaaacttaatcagtactcgttgtttcatcaagcactgtgcagaatcattttctggttacatgccagtattgcataatccttgaataactagcacttgaaaaggcagataagaagccgttggctagcattatcttgttgctctaattccagtttcttctagcatttgctgtctctcaggttaagtttgttgtctgatatcgaatcaaaattactatatgaactttcttcagtgatggaaacttccacactccttttgac

SEQ ID NO: 429 - DNA, 737 bp, Glycyrrhiza uralensis
gatactctccaattcaataccctttctttttctttgttagagtttctccaactcctagaattgcccatgtctttcagaggtctcaaccggccaaatgcctcatcaggcatgggtgttgctgagcacagcaaaaacaccttcatggaattgaagcagaagaaggtccatcgttatgtgatctttaaggttgatgaaaagaagagggaggttgtggttgagaagactggtggccctgctgagagctatgacgatttcactgcatctttgcctgagaacgattgcagatatgctgtgtttgacttcgattttgtcacttctgagaactgtcaaaagagcaaaatcttcttcattgcatggtctccttcaacatctcgaatccgtgccaagatgctctatgccacaactaaagacaggtttagacgtgagctagatggtgtccattatgaaatccaggctactgaccccacagaaatggatcttgaagtgatcagggaccgagcacattgagatgtttatgcagttattcatttcctcattaaaatctactaggttgtacttttaatgaattacctctacttggttttatcctctgcagagcccatcttgctacaaaaaatatagctccaaataatatgaatctgaagactgatgggattaagctttaagcagctactgttgtaaattccagtttgcttgactgtattgtatgagcatgactctatggaaccacatgtctt

SEQ ID NO: 430 - DNA, 963 bp, Lotus japonicus
ctctgttactgttagcgttgccaccacgcaccgccctcgtttccttttctttctacaaaaccaccctcttctcttcttcactcttcaccttcctcctctcttcttcaacattctccatgtctttcagaggattcggccgggcgaatgcttcatcaggcatgggtgttgctgatcacagcaagaacaccttcatggagttgaagcaaaagaaggttcatcggtatgtgatctttaaggttgatgagaagaaaagggaggttgtggttgagaagactggtggcccggctgagagctatgacgatttcgcggcgtctttgcctgagaatgattgtagatatgctgtgtttgactttgattttgttacttctgagaattgtcaaaagagcaaaatcttcttcattgcatggtctccttcaacatctcgaatccgagccaagatgctctatgccactactaaagaaaggttcagacgtgagctagatggtgttcattatgaaatccaggctactgaccccacagaaatggatcttgaagtgatcaaagaccgagcacattgaaatgtttatgcagttattagcttctttttttgttgtcaaaatctactagtatataggtttaatgaatcacctctccatgctctatcatctgcaaagccgatcttgtcaccgaaatataactccaataatttgaatctgaaggcttgtgggtttaagctcttggcagctactgtcttaatttccaatttgctttgactgtattgtatgagcatgaccttatggacccatatatcttagatattaaaaccccttgccataactttaacagggtaactgcataattttatctttatttgctttgaaagctaatttatcatgagcagttcagtgaggcaaaagaactgacagagatcagcaaccaagtaatgaatgttgagccaattagaacagacacaacagtaaagca

SEQ ID NO: 431 - DNA, 1333 bp, Cajanus cajan
acgcggcgaatggatggggtgagtattgaagaaagtgggtcccatggggcgatgggcggtggaaattgatggtccagattccacttagcgttgctgcaacgcaccgccccctatcattctcctttcttcactcttttcttaactatttattgtaacttctcttctcttctcttctcttacattgccatccttattcacttccaaccttcctcatcatgtctttcagaggcctcactcggccaaatgcttcatcaggcatgggtgttgctgatcacagcaaaaataccttcatggaattgaagcaaaagaaggttcatcgttatgtgatctttaaggttgatgaaaagaaaagggaagttgtggttgagaagactggtggcccggctgagagctatgatgattttactgcatctttgcctgaaaatgattgcagatatgctgtgtttgactttgatttcgtcacttctgagaactgtcaaaagagcaaaatcttcttcattgcatggtccccttcaacatctcgaatccgtgctaagatgctctatgccacaactaaagacaggtttagacgggagctagatggtgttcattatgaaatccaggctactgaccccacagaaatggatcttgaagtgctgagagaccgtgcacattgaaatgtttatgctgttatattattcactttcttatcagaatctactaggacttacttttaatgaattacctcttcatgctttatcatccgaagagcccattttgctaaagaaatatacctccaataatatgaatctgaatgctgatgggtttaaagctttaggcagttattgctgtaaatcccaatttgctggactcatattgtatgagatgatgaacgtgagactctatggatccagatctcttgggtataaaagtcccttgttatagaaaattttcaaaacttgcgtttatcaatatttgccttttggaagctatctgtgaagctcaacaggcactagtaacttaacattccctcgttcttgcattgcatatgctcttcataaacaaggtaaaagaaaatgaggatcgtgtgtggaaaatacagagatggaatcttgtgtaatttgatagaggccaattaaactaaaatgaaaagttcgtattttatcagcttctggctgttcctaaatcctctggcttctcgttcactccagaatctagacattacctctgaaagttttcctttctattcaggcaccatggaggtgctgacgaaatgtaactactttatcacacaccatgtacaattgagtgaattctaaatgccagtgtcataggtaatagattctatgctaaa

SEQ ID NO: 432 - DNA, 1390 bp, Populus trichocarpa
actcgattttaactcttagtttgtttttgtaaatgtctcaagatgtaagaaacctgaagagatataaataaaaatataaaataaattattttttaaaattatttttaaatgaatttctttactttaatgaaaggacacacagaagaaagaaaagaaaagggaaaccgcagccacacctgcagacggtggacaccttagctatccggtaacaacatccatgtccttttttttttgtttaactttctgcacgaggaagagtagaaaagcccatacgcgcctctcctcgcatttcagaatctttcacacccttcataaatctctttccctttcactcttcttacatcacacccaaaaaagagagagcaacagaagacatattcttttgtcttgaaagcactgaatttcctttttctgtatttcttttaacttctctataacttggccactaccttcctttttttgttctttatagatttcttagaattgaagcggctgtgctgtttgttgctctccttcatttaccttataactcagctacaattctctcaactctttataagctgccatgaatttcagaggtgcaagtcgggccaatgcatcatccggcatgggggttgctgatcacagcaaaaatacatttattgaacttcagaggaagaaggcacaccgatatgtgatcttcaaaattgaagagaagaagatggaagttgtggtcgagaagaccggggagccagctgagagctatgaagatttcgctgcatctttgcctgacaatgattgtcgatatgctgtttatgacttcgatttcgtgacttctgagaattgtcaaaagagcaaaatcttcttcattgcatggtctccttcaacctctcgaatccgtgctaaggtgctctatgccacatctaaagagagatttagaagggaactgaatggtatccactatgatattcaggctactgaccctacagagatggatcttgaagtgattagagaccgtgcaaattaaagagtctataccattaatggtttcttctgaggaaaacaagtttgtcaagctcttgccaacttgcgaattaatgcctccttgttccattaatctacgtacaggatccttatgtgaacaagataaactgcatgttacttaaataactagcattgcggaagtgtgataagcagctctgtgctattatattggaaattcctgctaaattcagcttcctcaatgtcctcttgtttccctaaattcctgctaaattcagcttctgcactggaagctgtagcagataaacatcagcaaatcgaatttcatttacatatgtactccaatgaactaacgaatcaaatacaaaaataaatgagaggggttttttttccagaccacatttactgc

SEQ ID NO: 433 - DNA, 967 bp, Tripterygium wilfordii
ttaacacatcaggtacaggtttggctactttgttttcgaacaccatctgctcttcaaccctcagtagcccgcatttccagaggagttggtcatgtcttttcgaggatttggccggcccaatgcttcatcgggcatgggtgttgctgatcacagcaaaaatgcatttacagaactgcagaggaagaaggtctatcgctacgtgatctttaagattgatgagaagaagagagaggttgtggttgagaagactggcggccctgctgaaagctatgaggattttgctgctgctttacccgagaatgattgccgatacgctgtttatgacttcgattttgtgacctctgaaaattgtcaaaagagcaagatattcttcgttgcctggtctccttcaagctctaggatccgtgccaagatgctctatgccacatctaaagacaggtttaggagggagctggatggtatccactatgagattcaggctactgaccctacagagatggatcttgatgtgatcaaagaccgtgcaaactgaatgtctgcaacatagtggtggcctggaaaattgatatctgctataccttgaaacttaatcagtactttgtagtttcatcaagcaatgtgcagaatcactttctgttacataccagtattgcataatccttgaataactagcacttgaaaaggcagataagaagcggtgggctagcattatattgttgctctgattccagtttcttctagcatttgctgcctcgaaggttaagtttgttgtctgataatgcataattactcttaagactttattccatattactggttctggttctgagtatatgatctcagccgttcgttttatgaccttcgtttaatgggattgacaaatcatcgtattacaaagtttctgcctattcaattgtacatgtgtgatttctggttctacttggtgggcttgccccaacccacaagt

SEQ ID NO: 434 - DNA, 772 bp, Olea europaea
tatctgctcacatatataattttgctaatttttcagatttctctctgggtttttcgtccagaatttccagacaacagtcatgtcgttcagaatcagagggcaaaatgcttcttctggtatgggtgttgctgatcacagcaaacatacattcttggaattgaagaggaaaaaggtttatcgctatgtgatctttatgattgatgaaaagaaatcagaggtggttgttgagaagactggtggtcctgctgaaagctacagtgattttaccgcatccttaccggagaatgattgtcgatacgctgtctatgactttgattttgtgacttctgagaattgtcaaaagagcaaaatattcttcatttcttggtctcctgaaacctctcggattcgtgcaaagatgctatattctacatccaaagataggttaagacgagaattagacggtgttcattatgagattcaagcaaccgaccctacagaaatggaccttgaagtgattaaagaccgtgcccactgaggtctcgacatttagaggattcacccttcgaagaaaaagaacaaaatgaccaggtattgccaacttgtcgatctatgcttctggcttcctgatctacagtatatttctggagcaagaaagctgctactaaaataacttgctcgtaaagttgatgattcaatgttttatggtgctattagtttctgttaaagtttgccttttcttgcttcgatgttatttaaaaactatcgaatgacaacttaatgacatatttgg

SEQ ID NO: 435 - DNA, 867 bp, Solanum lycopersicum
attttcttgtacactatcgtttatttctccttcggtggctgcctttgattcaacttcaaacaattctctttctctagagtctctctctaggtctctgttgatcgctttaaccatgtctttcagaatcagagggacaaatgcatcctctggcatgggggttgctgatcaaagcaaagctacttatatggaactgcaaaggaagaaggtgcatcgatatgtgatatttatgattgatgagaagaaaaatgaggttgtggttgagaaaactggaggtccagctgagagctatgatgatttcactgcagctcttcctgagaatgactgccgatatgcagtatacgattatgactttgtgacacctgacaactgccaaaagagcaaaattttcttctttgcctggtctccatctgtttcccgaatccgatcgaagatgctgtatgccacatctaaggacaggttcaggagggagctgcaaggcatacactatgagattcaagctactgaccctactgaagtagaacttgaagtgctcaaagaacgcgcttactgattgatcaaacatcctactatgaaacaaccattcataatatttctgtgtaatcgcgtcttacaagactcgatctacttaactatgacataaataactcgacgcttgggttgctgattaccggacgactcatgatagttagtatatcatgttttctggttatgagctcgctcattctcatgatgcttcctagtcgagaaacgagtatggtgttctgtatgtgaatggttatcaacttctctatgtctacgcaatgaatattatgtgttattagtatctgactgataaatttctgttgttcttttcctgtctatctgttt

SEQ ID NO: 436 - DNA, 719 bp, Cannabis sativa
tgaattttgccttgattttgtttcttgaagccaaatgcttcatctggaatgggagttgctgatcacagcaagaatgctttcatggaattgcaaaggaagaaggttcaccgctatgtgatctttaaggttgatgagaagaaaagggaaattttggttgataagactggtggcccagctgagaactatgatgatttcactgcagctttacctgagaatgattgcagatatgctgtttatgactatgattttgtcacctctgataactgtcaaaagagcaagattttcttcattgcatggtctccttcaactgctcgaattcgctcgaagatgctctatgccacatccaaagacaggtttcgaagagagctggaaggcattcactacgagattcaggctaccgatccaacagagatggatcttgaagtaatcaaagagcgagcgaactgagcttaatttactcactttcaagcgttggattctctattttctgtcagttaatgctctcagcagctgccataatcaaatacaacaccttctaacttgtaattttgccaatctgatgaataaactggcaatgttggtggggtgtgaaaagctgggctaagcttaatgtttatctacttgctgaaaaaaaaattggttactttttacttctcagatgtagatcagtatttttatggatatatatttatggtgaaatctcaagtttattgatgaaa

SEQ ID NO: 437 - DNA, 1238 bp, Quercus alba
tccatcttataaaaagactttttgccttttcctttccttgtccttccaaaactctttcatccgcgggggtatacgtgctataagagtatacccatcggctttagcttcctctcttcttcttcttcttcttcttccatagtattattattatactttcttcgttaccatgtcttacagatggctcagcaggccaaatgcttcgtccggcatgggcgttgctgatcacaccaaaaacacgtttttggaattgaagaggaagaaggttcaccgttatgtgattttcaaggttgatgagggtaaaaaggaggtagtggttgagaagaccggtggtccagccgagagctatgatgatttcactgcagctttgcctgagaatgattgccgatatgctgtatatgactatgattttgtgacttctgataactgtcaaaagagcaagatatttttcattgcatgggctccatcatcctctcgaatccgtgccaagatgctctatgctacatctagagacaggtttagacgggagctggatggtgtccactatgagattcaggctactgaccccacagagatggatcttgaagtgatcaaagaccgagcacactgaataatctctgcagttattgagttttgttcagtggggaaaagatctgatatcactatgccaacttatgaattagttatccctgtgcagaacccattttagaaacaagatagtattgcatgatccgtgaataaactaacatctgggaggctcaaggtttaggctaatattttctggaaactgagagtgtcaatttccttattgattactgcttctcaggtgaagatggctttgttaaagggtatctagaaactctaaatgtaagtcattatattgatttcatctttaaaggattgtcctgtaaaaggatatttacaaactcttgttgtatatcatcttataaatttggtttcaggggatgcatttgatactgccaagtgctgttacttaactctatttccattattgtttatttgttttcacctgacatctccgaaggatattttcactttgattcaggcaccatgtaaacaacataattgagaaattgatttcacccaacacagaaaaattctagtccaacattggccttatttttattgttttcgagaaagacattggtctttattttttttttttgtaagagaaaataatattgcattgcaaataaaataagacattggtcttattttgg

SEQ ID NO: 438 - DNA, 985 bp, Elaeis guineensis
cttctcggagctcaatattctatctttttatttttgactttgacaaagattaaaaacgaataaaatatagctaaaataaagggagatattccattcttttctttttccatgttttgccccattattgttcctttcttatattctattgtcattcgtttcttgtagccgagaatctccatccggctcattctcctctcctcgtttctctggatctccatccgtcttctctgagatcgggaaggagcagccatgtcgttcagatctctatcgttgcgatcgtcgaatgcatcttctgggatgggagtggctgacgatagcaagagcactttcctggaactgaagaggaagaaggtgcatcgctatgtgatattcatgatcgacgaaaagaaaaaagaggttgtggtcgagaagacaggtggtccgggggagagttatgatgatttcacggctgctctgcctgtgaatgattgccgctatgctgtgtatgatttcgattttgtgactgaagacaattgtcagaagagcaagattttctttatttcatggtctccatctgtctcccgcatccgttctaagatgttgtatgccacatccaaagacagatttcgccatgagcttgatggcgtccattacgagattcaggccaccgaccctacagagatggatctcgaagttcttagggaccgtgctaattaggcatgtagagcccccaaaactaacttcatctcaacgaatagctgggtttctgccaacagatgtgtcctgaggcatctgattatgagaacatatatgggattctgaataaccgtagctgagagggctggtggaatagctgaactctaccttaatgacacttctcagttagagagatgggctgtactaagagtagttgatcaaagacctgggtgcttttatgagttggaaacgtctttaaacatataccgtaagtggggacaatataatatattaaaatctcatctcttct

SEQ ID NO: 439 - DNA, 860 bp, Trigonella foenum-graecum
gaatgtatcgattcagccggccgggggaccgacaattctctctctcctctcactttctctctctacaaatccatccaaattcttgactcttcactgtatcagctgcatagctatggctttcagactgggagttggagggggaaatgcatcttctggcatgggtgttgctgagcatagcgtaagcacattccaggaattgcagaggaagaaagtataccgctatgtgattttcaaaattgatgagaaaaagaaagaggttgtggtcgaaaaaactggtggccctgctgagagctatgatgatctcactgcatccttgcctgaaaatgattgcagatacgcagtctttgactttgattttgtgaccgctgagaactgccagaagagcaaaatcttttttattgcatggtctccttcggtagctcgcattcgccctaagatgctatatgcaacatcaaaggacaggttcagaagggagctgcagggagtccattatgagattcaggcaacagacccaacagagatggaactcgaagtcctccaagaacgtgtgaactaagcacctaaacaaactgaaagggtcatgtctaagtgatgtagttaggatatcttaggcctcaagaaatgtttttgattaatgcccttaagtattagtatggtcttgtctactctgctacatttcatataactagcttcaagtaaataacattcacctgtgaaggctgatacgggttcttgcctaagaaacccctctgcataggaatttgagctgttccttattgccatatgatgcttctcaggtcgaattaatatgcttatctatggatattgaaatttaaaatatgtcaatggaggcatttggt

SEQ ID NO: 440 - DNA, 639 bp, Valeriana officinalis
gaaaaaaacaaagcaggtgaatcgatgtcgttcagattcagagggcaaaatgcgagttcgggcatgggtgttgctgatgacagtctaaaaacattcatggagctaaagaggaagaaagttcaccggtacgtgatttttaaggtgatgagaagaaaaatgaggttgtcgtcgaaaaaaccggcagtccagctgaaagctacgatgattttcctcagcattacctgaaaacgattgtcgatatgctgtctatgactttgatttcgtcacttcagaaaattgtcaaaagagcaagatattcttcattgcatggtctcctgaagtatcaagaattagatcaaagatgttgtacgttacgtcgaaagaaagattcaaaagggaactagacggtatccattatgagattcaagctaccgatccaacagaaatggatcttgaagttattaaagagcgcgcccactaattttgctcaatggatctacacataattctattcttacctgaaatcctgaataccgaaattaagtatgtactaatttgttgtgaaaataactgcgtagattggcgcaagtttcagtcgctattaaacttcagttgtatatagaatttatgagttgcaaattaatggttatttcagaagtt

SEQ ID NO: 441 - DNA, 421 bp, Aquilegia formosa
gtcgtcgaatgcttcttcaggtatgggagtgtctgatcatagcacaaccacatttatggaactgcagaggaagaaggtgcaccgttatgtcatctttaagattgatgagaagaagaaagaggttgtagttgacaagactggtggtccagctgagagctatgatgattttacatcatctttgcccgagaatgattgccgatatgcagtttatgatttcgattatgtgacttctgataactgtcagaagagcaagatttttttcattgcttggtctcctgcaacctctagaatccgagccaagatgttgtatgccacatctaaggacaggttcaggcgggtgcttgatggtatccactatgagattcaagcaactgaccctacagagatggatcttgaagtgattcgagaccgtgctaattga

SEQ ID NO: 442 - DNA, 792 bp, Vigna unguiculata
acttcactttctccttcttcaactccaacttcactcgtcatcatgtctttcagaggcctcagcaggccaaatgcttcatcgggcatgggtgttgctgatcacagcaaaaacaccttcatggaactgaagcagaagaaggtccatcgttatgtgatctttaaggttgatgagaagaaaagggaggttgtggttgagaagaccggtggccccgctgagagctatgatgatttcgctgcatctttgcctgagaatgattgcagatatgctgtctttgactttgatttcgtcacttctgagaattgtcaaaagagcaaaatcttcttcattgcatggtctccttcaacttctcggatccgtgccaagatgctctacgccacaactaaagacaggtttagacgtgagctagatggtgttcattatgaaatccaggctactgaccccactgaaatggatcttgaagtgctgagagaccgtgcacattgaaatgtttatgtactcattcattttcttttcagattctactaggtttttactttcaatgaattgcagagcccatcttgccacagaaatatgcctccaataatatgaatctgaagggggatgggtttaaagctctgagctgtcattactgtaaatcccccaatttactggtcctgtattatagagcgtgactttatgataatgtggtggatatacaagtctttgcttgtagctctagcaaagaatctctagaaagtttcaaaacttgcatttatcaatattttcttcttaaaattaaaaaaaaaaaaaaaa

SEQ ID NO: 443 - DNA, 920 bp, Cyamopsis tetragonoloba
cacgagggcaccgcccctgtttcttctttatcttttttctcttaacttgtttataaaaatcatatactatataatctcttctcttcatttacactccatacttccttccattctctcttcttcctttctcccattaattacagaacccatgtctttcagaggcctcacccggccaaatgcttcatcaggcatgggagttgctgatcacagcaaaaataccttcttggaattgaagcaaaagaaggtttatcgttatgtcatctttaaggtcgatgaaaagaaaagggaggttgtggttgagaagactggtggccctgctgagagctatgacgatttcactgcatctttgcctgagaatgattgcagatacgctgtgtttgattttgattttgtcactgctgagaactgccaaaagagcaaaatcttcttcattgcttggtctccttcaacatctcgaatccgtgccaagatgctctatgctacaactaaagatacgattaaacgagagctagatggcatccattatgaaatccaggctactgaccccacagaaatggatcttgaagtgctgagagaccgcgcacattgaaatgtttatgcagttattcattttcctataaaaaattactaggtgttacttttaaagaattgcctcttcttgcttttccatcggcacagcacattttacaacaaaagtatacctccaataatatgaatctgcaggctgatgggtgaaaagcttttggcagttactgttgtaaatttcagtttgcttgactgaattgtatgatgagcttgactctatggatccagaaatgccttggatataaaactcccttgttaactcttgacaaggttctgtagaaattttcgatacttgcattttatcaacagtttcttttagaaatctaaccctcgtg

SEQ ID NO: 444 - DNA, 683 bp, Euonymus alatus
ggcctttcttttctctctggttactttgtttttgaacacccactgctattcaacaatcaacactcagtagtctgcacattcagaggagttggtcatggcttttcgaggatttggtcggcccaatgcttcatcgggcatgggtgttgctgatcacagcaaaaatgcatttatggaactgcagaggaagaaggtatatcgctatgtgatctttaagattgatgagaagaagagagaggttgtggtagagaagactggccgccctgctgaaagctatgaggattttacagctgctttacccgagaatgattgccgatatgctgtttatgactttgattttgtgacctctgaaaattgtcaaaagagcaagatattcttcattgcctggtctccttcaagctctatgatccgtgccaagatgctctatgccacaactaaagacacgtttagaagggagctggatggtatccactatgagattcaggctactgaccctacagagatggatcttgatgtgatcagagaccgtgcaaactgaatatctgctacatataatggtgtcctgggaaaaagatctctgccttccctttgaaacttaatcagtacttgttgtttcatcaagcactgtgcagaatcattttctggttacatgccagtattgcataatccttgaataactagcacac

SEQ ID NO: 445 - DNA, 863 bp, Elaeis guineensis
ccccaccaacaaaattttggtacagaggggccgcagaataccgccgatcgccgaacccatctgcttcccgtccacagcttttctcactttttaatcttataaaaaaaaaggagaagagattcggatgtgagccaatccttttggaaaatcgcctcccagttctttgaaaccgtagatagttttttattttgctgccccagtttcttcggtcaaatggctttgcttcgaagttattcaaatgcatcctctgggatgggtgttgcagaccattgcaaggatacattcttagaccttcagaggaagaagacgcaccgttatgtgattttcaaaatcaatgagaagcaaaaggaggttgttgtagaaaagactggaggtccagctgagagctatgatgatttcatggcttctctaccagaaaatgattgccgatatgccgtctatgatttcgactttgtgactgatgagaactgccagaaaagcaagattttctttattgcctggtcaccttctgtatctcgaatccgagctaagatgctgtatgcaacctccaaggatcggttcaggcgagagctggatggaattcactatgagattcaggcaactgacccctcggagatggaccttgaggttcttagggacagggcacattaaatcacagttcattgggtcgtgcaaactaaaaccagtgatgggtgtactcagtcatgcccctttgaaaatagattcttatgaactatatacaactttagcatgctggttgatattaatgttgttggaaaaccgatatttataaattatggaaagagcttgtaaacaagtacaactatggtgtgattaatattgttgtgcgtgattggtgcctg

SEQ ID NO: 446 - DNA, 868 bp, Ambrosia trifida
tttacgtattttcattcctaactaatattctagtctttctctctatccgttctatcttttattcttattttgtggtttaccttcttaataatattaatccacccaacttatacccactttatatatatatcaacttctgctttgtcttttaaacttttaataattaatttatattcatcatttgatttgatcatgtcgttcagatttcgaggagggaagaatgcttcttctggaatgggtgttgctgatcattgtaaaggcaccttcttggagctacaaagaaaaaaggcgcaccgttatgtgatttttaaaattgatgagaagaaaaatgaagttgttgtagagaagactggcaatcctgctgaaagttacgacgattttacatctgcgttgcccgaaaatgattgcagatacgccgtctttgactttgactttgtcacctctgagaactgtcaaaagagcaagattttcttcatcgcttggtctcctgcaacctctaggattcgagccaagatgttgtatgcaacatcaaaagacagactcagacacgagctcgatggggttcactatgagattcaagctaccgaccctacggaaatggatcttgaagtgctgagggagcgcgtatactaatcggttagctttcttgaaccactgtttctagcttcctgaagctgcaaactagtttctgcttctttctagcgaaagaagttatcttttataaaaatggcactcggatgacaaataagcttgtttaacactttcatccgattattgtaacaactgtcctatcatttatacttgcaaatctttcttatgtatctagtgacccatcatcatatctatatagtttatgttcatcgaaaaa

SEQ ID NO: 447 - DNA, 893 bp, Trifolium pratense
cagtctccacacaatttcctctctctacaaatccgtataatttcttgactcttcgcactgtagctgctgctgctgcatagctatggctttcagaatgggtgtcggagggggaaatgcatcttctggcatgggtgttgctgagcatagcgtaaccacattccaggaattgcagaggaagaaagtacatcgctatgtgattttcaaaattgacgagaaaaagaaggaggttgtggttgaaaaaaccggaggccctgctgaaagctatgatgattttactgcatccttgcctgaaaatgattgccgatacgctgtctttgactttgatttcgtgactgctgaaaactgccaaaagagcaaaatcttttttattgcatggtctccttccgtagctcgcatccgccctaagatgctttatgcaacatcaaaggacagattcagaagggagctgcagggaatccattacgagattcaagcaaccgacccaaccgagatggaactcgaagtcctcatagaccgcgcaaactgaaaggaccgtccatgtctaagtaatgtagttagtatatcttagacctcaagaaatattgttgactatgccctttaagtattagtatggtcttatcttctctgatacatttaatataaaatagcttagtttaagtaaataacatatacacctctgaaagctgatatgggttcttgtctaagaaaaaccctctgcagaggaatttgagctgttccttattgccatgatgcttctcaggtggaattaatatgcttatttatggatattgaaatttaatctttgtcaatggaggcatttggtgtgtctaatatattcattcgccggtttgttggtgtatgaaatttgtttcagatttttctttaagctattt

SEQ ID NO: 448 - DNA, 715 bp, Trifolium pratense
aaaacattttttgttttcattttatagagtatccattcattataattcttgatcactataaaatttaatttattttatttgaagcattttttctcgcctggggggtggcttgcattttctcattttcagtctccagtctccacacaaatttcatctctctacaaatccgtataatttattgactcttcacactgtagcagactagcagctgcatacctatggctttcagagtgggagttggagggggaaatgcatcttctggcatgggtgttgcggagcatagcgtaagcacattccaggaattgcagaggaagaaagtacatcgctacgtgattttcaaaattgatgagaaaaagaaagaggttgtggttgaaaaaacaggaggccctgctgaaagctatgatgattttactgcatccttgcctgaaaatgattgccgatacgctgtctttgactttgattttgtgactgctgagaactgccaaaagagcaaaatcttttttatttcatggtctccttccgtagctcgcattcgccctaagatgctttatgcaacatcaaaagacagattcagaagggagctgcagggaatccattacgagattcaagcaaccgacccaaccgagatggaactcgaagtcctcatagaacgcgcaaactgaaagaaccgtgtctaagtaaagtagttagtttaagtaaataacatatacacctc

SEQ ID NO: 449 - DNA, 898 bp, Phaseolus vulgaris
cttcacaatttttctcttctcctctccacacaagttctctcacctttctctctgcgcaaaacccatctttcatctcactgtatccatggctttcagagtaggagggggagggggaaatgcctcttctggaatgggtgttgatgagcatagcgtaaacacgttcctggaattgcagaggaagaaagtccatcgctatgtggtttttaaaattgacgagaaaaagcaagaagttgtggtagagaaaaccggaggccctgctgagagctatgatgatttcactgcatccttgcctgagagtgattgccgatatgctgtctatgactttgattttgtgacatctgagaactgccaaaagagcaaaatctttttcgttgcatggtctccttcagtagcccgcattcgctctaagatgctttatgcaacatccaaggacaggttcagaagggagctgcagggcatccattacgagattcaggcaacggacccaacagagatggatcttgaagtcctcagagagcgtgcaaactgaggagctacccaagagggtcgtgtttttaggtgtagttagggtatatgaggccctgagggaatgatgttgactgataccctttagttctactatggtctttctctgttttgatatatttcacttaaacagctgacagctgacttatcatttatcaaatgaataacgtgcacctgtgaaagctgattaggggttcctgcctatgaaactccactgcaggggaatttcagcatttccttattgccatgatgcttcacagttgcagattaatatattaatggctattgaaaaatcaactgatattctatgaatttcaagtggatgttggcgaatctacttttttactttttaattcacgcaggggtttagttt

SEQ ID NO: 450 - DNA, 802 bp, Phaseolus vulgaris
tataataatttctcttcactcctaaccttccatacttcactttctccttcttcaactccactcctcatcatgtctttcagaggcctaagcaggccaaatgcttcatcaggcatgggtgttgctgatgacagcaaaaacaccttcatggaactgaagcagaagaaggtccatcgctatgtgatctttaaggttgatgaaaagaaaagggaggttgtggttgagaagatcggtggccccgctgagagctatgatgatttcgctgcatctttgcctgagaatgattgcagatatgctgtctttgactttgatttcgtcacttctgagaactgtcaaaagagcaaaatcttcttcattgcatggtccccttcaacgtctcggatccgtgcgaagatgctctacgccacaacaaaagagaggtttaggcgtgagctagatggtgttcattatgaaatccaggctactgaccctactgaaatggatcttgaagtgctgagagatcgtgcacattgaaatgtttatgtacttgaaattcattttcttttcagaatctactaggattttactttcaatgaattacctacttcatgctttatcatctgcagagcccatcttgccacataattatgcttccaataatatgaatctgaagggcgatgggttttgaagctgagttgttattgatgtaaatcccaatttgctaaacctgtgttatagagcgtgactttatggatccagataaatgtggtgggtataaaagtatatgttcgtagagttagcaaagaatatctagaaaatttcacaa

SEQ ID NO: 451 - DNA, 759 bp, Lupinus angustifolius
gataagatatttgttattataaagtactctgaattgcgttgctccaacgcaccaccccttatcttctcttgattcataatttgagaaacttatttattacattgaattgaattatcaatatcaatcattcatcttccaagttttctcatgtctttcagagggatcactaggccaaatgcatcatcgggcatgggtgttgctgatcacagcaaaaatgtgttcatggaattgaagcaaaagaaggtgtatcgttatgtgatctttaaggtagatgagaagaaaaaggagattgttgttgaaaagactggtggtgtggctgagagctatgatgatttcactgcatctttgcctgagaatgattgcagatatgctgtctatgactttgattttgtcacttctgagaactgtcaaaagagcaaaatcttcttcattgcatggtctccttcaacatctcgaattcgtgccaagatgctctatgccacaagtaaagacaggattaaacatgagctagatggtttccattatgaaatccaagccactgatcccacagaaatggatcttgaagtgctcagagaccgtgcacattgaaatgctaccttgtgcagttatatttattattgtgttaccgaaatctactaagtttaacctttaaatttccatttcatgctaaatcatatgcaaagcctatcttgtcacaaaaatattctccaataatatgaatctgaagtttgattttgtgtttaagcttttatcagttct

SEQ ID NO: 452 - DNA, 977 bp, Trigonella foenum-graecum
cttaactttgtgatgtggttcattcattctttcagcttagcgttgcctcgacgcaccgccccaccattctattcattttaattaactattttcagttataaaaccaaaccaatttgtcttctctagttacgttccatttcattacattacttcaactcctacattttccatgtctttcagaggtctcagccggccaaatgcttcatcaggcatgggtgttgatgagaacagcaaaaacaccttcatggaactgaagcaaaagaaggtccatcgttatgtcatctttaaggttgatgaaaagaaaagggaggttgtagttgagaagaccggtggtcctgctgagagctatgacgatttcgttgcatctttgcctgagaatgattgcagatatgctgtgtttgactttgattttgtcacttctgagaactgtcaaaagagcaaaatattcttcattgcatggtctccttcaacatctcgaatccgtgccaagatgctctatgccacatctaaagaaaggtttagacgcgagctagatggtgtccattatgaaatccaggctaccgaccccacagaaatggatcttgaagtgctgagggaccgagcacactgatattttaatgaaattattgatgctctcatcaaaatctactaaggttttacttttaatgaattactcctagcttacaaaacccatcttgccacaaaaatgtacctccaataatatgaatctggattctggaggctgatgatgggtttaagctttagcagctactgatgtaaattccagtctgcttgaatgtattgtatgaacatgattttatggatcaagatgtcttgaatgctaaaatcctttgttattaatctgatgacttatcatgtcctggtatctttagaaagtttttgaaggaaggatctttagaaagttttgaaacttaatttatcaatggtcgcttttgaaagacctaaaaaaaaagaaa

SEQ ID NO: 453 - DNA, 1402 bp, Cocos nucifera
gtttcttacctcagagaacaaagcttgtgaagtcaaggaaacccgccgcggccacgctaagcagtcggttcggtttatttaaccatagtttttctggtggttttggaattaactaccctccaaacccttctccttctcggagctcaatattttatcttttaattttttgtctttaacgaagattaaagacgaataaaatatagataaaataaagggagatattccgctcttccctttttccgtgttttgttctattatggttcctcttatattctattgttattcgtttcttgtagctgagaatctcaatccggctcgcactcctctcctcgtttctcttgatctccatccgtctttctttgagatcgagaaggagcagccatgtcgttcagatctctgtcgttgcgatcgtcgaatgcatcttctgggatgggagtggctgaggatagcaagagcactttcctggaactgaagaggaagaaggtgcatcgctatgtgatattcatgatcgatgaaaagaaaaaagaggtcgtggtcgagaagacaggtggtccgggggagagttatgatgatttcaccgcagctctgcctgtgaatgattgccgctatgctgtgtatgatttcgattttgtgaccgaagacaattgtcagaagagcaagattttctttatttcatggtctccatctgtctcccgcatccgttctaagatgttgtatgccacatccaaagacagatttcgccatgaacttgatggcgtccattacgagattcaggccaccgacccttcagagatggatctcgaagttcttagagatcgtgctaattaggcatgtagaacccacaaaactaacttcatctcaacgaatagctgggtttctgccaagagatgtcatctggtgacttgtcctgaggcatctgattatgagagcatatatgggatcctgaataaccgtatctgagaaggctggtggtagtgctgaactctgacacctctcagttagagagacgggttgtactaagagtggtttatcaaagacctgggtgcccttatgaagtggaaacgtttttaaacatataccgtaagttggggacgatataatatatttaaatttcatctcctctcttatttgctgtgccctgtgttaaccgtgttgcctcacctgcattcacgcggccaccatatcgatggacgtcggcaaagtcgacacgctctgcaaaggtgctcgactgcttttcctgagatcgggaggtaaaagtcaaaagagagtaaaaaggagaagggtacctgttccgatttaggatggagttggctgctggagttgagtctatgttagttttgatacatgcgctatgatgttcgagttgtgtggaaggagcctgtccatgcttgttttttcattt

SEQ ID NO: 454 - DNA, 862 bp, Nicotiana benthamiana
acatagaataatacgctattttcttcattttggcagtatcttcttttttccctcttatcttaataaaacaacaacaccaccttcaaaccatattccccattttctctgaagggtagttcagtttttttgctctccagtttctttagacgttaatcatgtctttcagattcagagggccaaatgcctcttctggcatgggtgtagctgatcacggcaaaaatgcattcttggagctgaagaggaagaaggttcatcgatatgtgatattcaagattgatgaaaagaaaaaggaggttattgttgagaaaactggaagccctgctgaaaactttgatgattttactgcttctttgccagaaaatgattgtcgatatgcagtctatgactttgattttgtgacttcagagaattgccaaaagagcaagattttctttgttcattggtctcctgcaacatctcgtattcgtgcaaagatgctttatgccacttccaaagacgcatttagaagagagctggatggttttcattatgagattcaggctactgatcccacagaagttgatcttgaagtgctgaaagaccgcgctcactgagccctcttgcatcaaaagctatcttcctcagaataagggaagagaattagcagggccataccatcataatgattagtgcttatagcttatctttggccccatttcttacacaggaaaaattcttcttaaataatagggcatctgggaaagctgatttcaggttacgcattctagcttgttagtgtatatggtgttgctattgttttgctttttctcatatgtttgaacacttaggaaattgcataataatatgaatggttctcaagcaa

SEQ ID NO: 455 - DNA, 846 bp, Elaeis guineensis
agcttttcctcggttgtcctgtgacatcatctctccctccaattttggtaccgaggggccggagctgccaacagatcgtcgaacccgtctgcttcggcgcttccccacaattgtgagctagtcccttcggtaaccagttccactagagagcttttaggtgccccaattccttcggtcaaatggctttgcttcgatcgtcttccagtgcatcctctgggatgggtgttgctgaccattgcaaggacacattcttagagcttcagaggaagaagacacaccgatacgtgattttcaaaatcgatgaaaagcgaaaggaggttgttgtagataagactggaggtgcagctgagagctatgatgatttcatggcttctctaccggaaaatgattgccgatatgccatctatgattttgactttgttactgatgagaactgtcagaaaagcaagattttccttattgcctggtccccatctgtttctcgtatccgagctaagatgctgtatgcaacctccaaggatcgattcaggcgagagctggatggaattcactatgagattcaggcaaccgaccccacagaactcgaccttgaggttctcagagaccgggcacattaaatcagagttcatacggatatgcaaattaaaatcagtgatggatatattcggtcatgccccctggaaaatacagtggtgaagggatcatcaggtttctatgaactatatgtaactggattatgctggttgaatataataatgttgttggaaaatcaatatctataaattatgggcagagcttgtaaacttatactactaagactatttgcatgattaatatctgttgtgt

SEQ ID NO: 456 - DNA, 710 bp, Papaver somniferum
ggaatctcgccattaaagctgactttagaagctttcctactccttatttagctttaattttgtttagtcaaatgcttcttctggtatgggagttgctgatcacttcaaggatacatttttggaattgaaaaggaagaaggtgcaccgatacgtggtctttaagatagatgagaagaaaaaggaggttgttgttgagaagactggaggtccagctgaaagttatgatgatttcacagaggctttgccagagaatgattgccgatatgcggtttatgacttcgattatgtgacctctgagaattgaccaaaagagcgaagattttcttcattgcatggtctacttcagtctctcgaattcgatccaagatgctgtatgctacatcaagacaggttcagacgggagcttggcggtattgcctatgagattcaagcaactgaccctacagagatggaacttgaagttctcagagaacgtgcccattgagcattttgtttctttatagtgcaaaagggtttcttggcacatatgaattcaagatttgatgaatggagaaggaagcaagtgtacttcgctacttcggctagttactgatttacatgcagtatctgtttctaatacactaatacagagacgtatggcttaatcatttaaataaaatcaacatctgggaaggctgataggaagcgtttgtctaagataattgaggtgc

SEQ ID NO: 457 - DNA, 725 bp, Trifolium pratense
tcattctccatgtctttcagaggtctcagccggccaaatgcttcatcaggcatgggtgttgatgagaacagcaaaaacactttcatggaattgaagcaaaagaaggtccatcgttatgtgatctttaaggttgatgaaaagaaaagggaggttgtggttgagaagactggtggtcctgctgagagctatgatgatttcgctgcatctttgcctgagaatgattgcagatatgctgtgtttgactttgattttgtcacttctgagaactgtcaaaagagcaaaatcttcttcattgcatggtctccttcaacatcacgaatccgtgccaagatgctctatgccacaactaaagaaaggtttagacgcgagctagatggtgtccattatgaaattcaggctactgaccctacagaaatggatctcgaagtgctgagggaccgagcacattaagatgataatgaaattattgatgttctcatcaaatctactagattttactttcaatgaattacctgtccttgctttatcagttacaaaacccatcttttcacaaaaatgtatctccagtaatatgaatctggattctggatacttatgatgggttaagcttttaacagctactgatgtaaattccagtatgcttgactgtattgtatgaacatgattttatggatcaagatgtcttgaatactaaaatccttgttattaatttgataacttatcat

SEQ ID NO: 458 - DNA, 1047 bp, Prunus mume
gcttctcacctctccttttacaatccgaatcttcccccttttttttcttctctcatttgcctctgctttcttttcctggcctcagaaaaaggaagagaatattattaactttgattttcttttttgttaatcggtttcattcccaattgcccatttgtttatctttcttctgcatgcctcatttgcccatatctcttcgccttctctaaatctgttctccttattgttgatcgactctctcttgttctcacgactttcgtggctgcaatgtctttcagagggcttagccggccaaatgcttcgtgtgccatgggagtttctgatgacagcaagaaaactttcatggaactgcagaggaagaaggttcaccgctatgtgatattcaaggttgatgagaagaagagggaggttgtggttgaaaagattggcggcccagctgagagctatgatgattttgtggcagctttgcctgaaaatgattgcagatatgcagtttatgactttgattttgtgacttctgagaactgtcaaaagagcaagatcttcttcattgcatggtccccttcaacctctcgaatccgtgcgaagatgctgtatgcaacatctaaagacaggtttcggcgtgagctggatggtattcactatgagattcaggctactgacccatcagagatggatctggaggtgctcagagaccgtgcacactgaacagtctctgcagcactaaaacatgtcttccttggtcggtcaaaaatctctggggttctgtaagtttgttatgctggcttcattatgtgcagaacccattactggcacaagactcactgtattactgttccttgaataaattggcgtatcagctggcttgtatgaaaagtatggtctgatgttatctgcttgctgcagaattcagttaccttgaggtaagcttacttcctagaggaaaatgaacttgtcattaggtgatgtaaaccctgaaaattgttgttatataaatttggttggcttcttatggttttttatctttggggaaaaagaaaagggcac

SEQ ID NO: 459 - DNA, 1006 bp, Prunus persica
tcacctctcctttacaatccgaatcttccaccttttttttcttctctcattttcctctgctttcttttcctggccttagaaaaaggaagagaatattattaacttggattttcttttttgttaatcggtttcattcccaattgcccatttgtttatctttcttctgcatgcctcatttgcccatatctcttcgccttctctaagtctgttcttcttatagttgatcgactctctcttgttctcaagactttcgtggctgcaatgtctttcagagggcttagcaggccaaatgcttcgtgtgccatgggagtttctgatgacagcaagaacactttcatggaactgcagaggaagaaggttcaccgctatgtgatattcaaggttgatgagaagaagagggaggttgtagttgaaaagattggcggcccagctgagagctatgatgattttgcggcagctttgcctgaaaatgattgcagatatgcagtttatgacttcgattttgtgacttctgagaactgtcaaaagagcaagatcttcttcattgcatggtccccttcaacctctcgaatccgtgcaaagatgctgtatgcaacatctaaagataggtttcggcgtgagctggatggtattcactatgagattcaggctactgacccatcagagatggatctggaggtgctcagagaccgtgcacactgaacagtctctgcagcactaaaacatgtcttccttggtcagtcaaaaatctctggggttctgtaagtttattatgctggcttcattatgtgcagaacccattactggcacaagactcactgtatcactattccttgaataaattggcatatcagctggcttgtatgaaaagtatggtctgatgttatctgcttgctgcagaattcagttaccttgaggtaagcttacttcctagaggaaaatgaacttgtcattaggtgatgtaaaccctgaaaattgttgttatataaatttggttggcttctta

SEQ ID NO: 460 - DNA, 999 bp, Solanum lycopersicum
ggaaagggcaataatgttgaaaaggaatgcatggtcaaattggcgtttggcatcgcaaaaagtatgggtagcgttcaatcaacgcaccgaccctgagttgagaaggtttgttgggggatcccattttttgatagagacataaaagaaaattactattatgcaaaacaaccagaataaaaatactatttgcttcattttggcagtatcttttcttttcttctcttatcgtagtataattattatctaatctattcaaccaactcatattcctctttttttcttcctctcaaggctcattttaatttttattttgctcttctcatgtctttcaaattcagagggccaaatgcttcttctggaatgggtgtggctgatcacggcaaaaatgcattcttggagttgaagaggaagaaagttcatagatacgtgattttcaaaatcgatgaaaagaaaaaggaggttgttgttgagaaaactggcagccctgctgaaacctttgatgactttactgcttctttgccagaaaatgattgccgatatgcggtgtatgactttgattttgtgacttctgagaattgccaaaagagcaagatattctttgttcattggtctcctgcaacatctcgtattcgtgcaaagatgctttacgccacctctaaagacgcatttaaaagagagctcgatggttttcattatgagattcaggctactgatccaacagaagttgatcttgaagtgctgaaagaccgtgctcactgagccatcttgcaataaacactatgtttccagctaagcatttagcttgttagtgtatatggtgttggtatttgttttgcttttttctcagatgtttgaacacttgggaacctgcataataatataatatcagtggttgccaattttctaattgtggactatacaagtgtagaattcatgatttgtcctctcttatcctatttcagctaaggattatgaatataaatatgtctttcgttagaa

SEQ ID NO: 461 - DNA, 2975 bp, Oryza sativa
cttgttcccccaaccaaaaccctcgcgcccccgccgcaccacccgcgcagccgcacagcgcaaatcccccccaccccgcgcaaggtttcgagaggtctcgtcggagatggaggcgttcggcgggttcttcgtggacgagaaggcggcgcgggtggagaacatcttcctcgagttcctcaggcggttcaaggaggcggatgcggcggaggcgttctacgagacggagctggaggcgatgcggtcgcgggagtccaccaccatgtacgtcgacttcgcccacgtcatgcgattcaacgacgtcctccagaaggccatctccgaggagtatctcaggttcgagccgtacctccggaatgcgtgcaagaggtttgtgatggagcagaggactggcgagaaccgtgcaccaatcatctctgatgatagccctaacaaggacattaacattgccttctacaacataccaatgctgaagaggttgagggagcttggaacagcagagattggtaagctcacggctgtaatgggggtggttacacggacaagtgaggtccggcctgagttactgcaaggcaccttcaagtgccttgactgtggaaatgttgtaaagaatgttgagcagcagttcaagtatactgagccaataatatgtgtcaatgcaacatgccaaaatcgatcaaaatgggcccttctccgacaagagagcaagttcacagattggcagcgggtcaggatgcaggagacatcaaaagaaatacctgctggttcactaccacgctccctggatgtcattctgaggcatgagattgttgagaaggctagagctggagacacggtcatatttactggaactgttgctgctgttcctgatgttatggctctaacttcacctggtgagagagcagagtgtcgccgggaggctcctcagcgaaagaatgggtctggtgtccaagaaggtgtcaagggcttgaaatcactaggagtacgagatctgtcatatcgccttgcttttgtagcaaactcagtgcaggtggcggatggaaggagagaagtcgacatccgggacagggacatagatggagatgacagcgaaagacagaagttcactgaagaagaggaagatgaagttgttaggatgaggaacgttcctgattttttcaataagatagttgatagcatatgtcccactgtctttgggcatcaagaaattaagagagcaatccttctcatgcttttgggtggtgttcacaagataacacatgaagggataaaccttagaggtgacatcaatgtctgtattgttggtgatccaagttgtgcgaagtctcagttcttaaaatataccgctggtattgttccacgatctgtttacacatcagggaagtcctcatctgctgctggtttgacagcaactgttgctaaagaaccagagactggcgaattttgcattgaggcaggagcactcatgttagctgataatggcatctgctgcattgatgaatttgataaaatggacatcaaagatcaggttgctatacatgaagcaatggaacagcaaaccattagcataacaaaagcaggaatacaagcaactttgaatgcaaggacttcaattttggcagcagcaaatcccacaggagggcgttatgacaagtcaaaaccactcaagtataacgtggcattgcctccagctattctttcaagatttgatctggtatacataatgatcgatgagcctgatgaaaacactgactaccacattgctcatcacattgtgagggtccatcagaaacgtgaagaagcacttgcccctgcatttagcacggcagaattgaaacgttacattgcttttgcgaagtccttgaaacctcagctgagttctgaagcaaagaaagttctggttgaatcatatgttacccttcgtagaggagatagtacccctggtactagggttgcttataggatgacagttaggcaactagaggcattaatcaggctttcagaagctattgcccgaagtcatttggaaagagttgttctcccagcccatgttcgcatggcagttaaattgctcaagacatccatcatcagcgtggaatcaagtgaagttgatctctctgatttccaagatgctgatgatggcacaaatgtaccagccgataatgatgctggtcagccaacagaaatggatgctgctcctcaacaagacggtccagaaaatgagcaagcggcagatactggtaagaagaagttggttataaccgaagaacatttccagagagtcacgcaagctttagttatgagactacggcagcatgaagagtctgtcacgaaagatggagatggtctggctggcatgaagcaaggggatctgataatttggtatgttgagcagcagaatgcccaaggagcctatagttctacagcagaggtgaaggaagaagtgaagtgcatcaaggccatcatagagaggttaatacagagggatggccatctcatagtgatagacgaaggagcagccccagcggctgacgacggtgctgcacgaagaacatcagagagcagaatcctggcagttaatccgaactatgtcatcgattaaccatctgaattatgatacgcagctaacacaatccaatcgatgtggttaaccgatagaaccaagagtagattctagtgagaacccctggtgggttatgctatgcactagacatgtaccatttccaactgtggtagtctttgcaattgagtatatgatctcttgacaaattgtacaattaattcttggaagcaaaggtgtagtcagagttatagttgatgataactataatcggtagtgtgcctgtgtacattttcttagagttggttgaactatgtgagggctttggagtttggagaagcttgaattttcaagtgcttgctgtgcttctaacgtgtatcattcagattcagatgattcgagaaacgtacctttggct

SEQ ID NO: 462 - DNA, 4092 bp, Brachypodium distachyon
ggccgccatggcctccggcctgcgcctgcggtgctgcaaggcaaggcggccggcgctgctacgcgccatggccgccggcgagcggtgttgcaaaggaggtggcggtgctgcaaccggcgaggcgtaaagctgcaagctgacgccgcctcccgccggcgaggtgatgctgcgactggtgctgcaaggcaagccggacagcgctgctacgagccatggccgccggccaccggtgctgcgaccggcgagccggaaaataagcgccgatgttgcaaagcaacgccggctcccgccttcaaggcggtgcggcgaccggtgcgtcgtggcgcttcgactggtgtgcggcagtgcttcaacacctcgctgtcgctgttgcaaggcggcgggatggtgctgcgtccggtgtgtggcgagctttgacctgtgtacggcggtgctgcgactggtgcacggaggtgcttcgacgctcgccatcactgctgcaaagggggcgtcgcctctagtcggtggggcggtgctgcgacgggcacgcagcgatgcttcgtccgttgtacggtgattatacgaaacgatgctgcaacgatgtgctgtgaccgaagagttgtggaatccaacggcagggagttccaatcggacggacagctagcgcgccctaatttcttgggttctcaaagaatacaacctgagcttataaaacgctcgaggactcacccgtttcgctccatgattttttttttgagcgacgctccctgatattctgctcacgtggccccacatgtagagagggcccaaggcagcctgtcaggcggagcacacggcccaggtcaaaaaccaagtctgtccactacagcccagtctatcccaacacgagcccaagaacgaagcatcccctaaaaaaccaactaaccaggccaccggggtcgcggtacctgccctcatgcacctggtccacaatgtttggcgctgcttccgactccgcgtacgtagccccacaagccagggagacaggagcagcacccctgcacggacccggtccatacgccacccgtccaagctccagccctttttggcgcgaagaattggcgccaagccgccgccaccttcccgccaataacacccctgcaccgcttccctttcccccccaacccaaaacccttgcatctcaccttgcgaccacacgcagtcagacgctgtgagccaccccaaatctacaccctcgtcggagatccaggagaggttcgtcggtcatggaggcgttcggtggattcttcgtggacgagaaggcggcgagggtggagaacatcttcctcgagttcctcaagcggttcaaggagccggatgcggccgagccgttctacgatatggagatggagcagatgcggtcgcgggagtccaccaccatgtacgttgacttcgcgcacgtcatgcgcttcaatgatgttctccagaaggccatctccgaggagtacctcaggtttgagccctaccttcggaatgcgtgcaaaaggtttgtgatggagcaaagggctggggagaaccgtgcgccaataatctcggatgatagccccaacaaggatattaatatttctttctacaacatcccgatgttgaaaaggttgagagagcttgggacagcggagattggtaagctcacagctgtaatgggggttgtgacaaggacgagtgaggtccgacctgagttattgcaaggcaccttcaagtgccttgattgcggaaatgttgtaaagaatgtagaccagcagttcaagtatactgagccaataatatgcgttaatgcaacatgccaaaaccgaaccaaatgggcccttctccggcaagatagtaaatttacagattggcaacgggtcaggatgcaggagacatcaaaagagatacctgctgggtcactacctcgttccttggatgtcattctgcggcatgagattgtcgagaaggctagagctggggacacagtcatttttactggaacagttgttgctgttccagatgttatggcattaacttcacctggcgagagagcagagtgtcgccgagaaggtcctcagagaaagaatgggtcaggtgtccaagaaggtgtaaagggcttgaagtctcttggagtaagagatctctcctatcgccttgcttttgtggcaaactcagtgcaggtggcagatggcaggagagaagtggacatcagggatcgtgacatagatggtgatgacagtgaaagacagaagttcactgaagaggaggaggatgaggttgttaggatgagaaacactcctgattttttcaataagatagttgatagcatatgtcctacagtctttggtcatcaagaaataaagagagcactcctccttatgcttttgggtggtgttcacaagataacacatgaaggcataaaccttagaggcgacatcaatgtctgtattgttggagatccaagttgtgcaaagtcacagtttttaaaatatactgctggtattgttccgcgatctgtctacacatcaggaaagtcctcatctgctgctggtttgacagcaactgttgctaaagaacccgagactggtgaattttgtattgaggcaggtgcactcatgttagctgataatggcatctgttgcattgatgaatttgataagatggatattaaggatcaggttgctatacatgaagcaatggagcagcaaaccattagcataacaaaagcaggaatacaagcaacattgaatgcacgaacttcaatattggcagcagcaaatcccacaggagggcgttatgacaagtcaaaaccacttaaatacaatgtggcattgcctccagctatcctttcaagatttgatctggtatacatcatgatcgatgaacctgatgaaaacactgactaccacattgcccatcacattgtgagggtccatcaaaaacgtgaagaagcactttcccctgcatttagcactgcagaattaaagcgctactttgcttttgcaaagtctttaaaaccgcagttgagttcagaagcaaagaaagttctggtggaatcatatgttgtcctccgtagaggtgacagtactcctggtactagggtcgcttacaggatgactgttaggcaactagaggcattaattaggctgtcagaagcaattgccagaagccatttggaaagaattgttcttccagctcatgtccgcatggcagttaaattgctcaagacatccataataagtgtggaatcaagtgaagttgatctctctgattttcaagatgcggaggatggcacaaatgtacctgctgataatgatcctgaacagccagaagaacctcatcaaccagaagaacctcaacaaatggatgcagcagatgctggtaagaagaaattggttataaccgaggaacatttccagagagttacacaagctttggttatgagactgcggcagcatgaagaatcaatcatgaaagacggggatggtctggctggcatgaagcaaggggatctaatcatttggtatgttgagcagcagaatgcccaaggcgcatatagttctacagaagaggtgaaggaagaagtgaagtgcatcaaggccattatagagaggctgatacagagggaaggacatcttatagtcatagatgaaggagcggcaggcgatggtgtggcagcccaacgaagaccatcggagaacagaatattggcagttaacccaaattatgttattgactaaccatccttcgcaaggaggcactggatctccagaattgtattattgtttcttgctctcaaggtataagcatgatgattctcacctgtagtctgcctatgtaatttttacgctgtgatagggttatgtaaactgtcatggtaagagaagatcattttagtttaagagcctgtgaattctcggtttctaatatactgttgtgccagtttctaaaagaatttatgcgcagtgcaacgcttcattttctttcgtgttgttttgacttattcttgaaaactgataagtctgaaacacatatcagggatgtacatgttcttttcttattgccccaaaagtatacccaaaaatcgaaggatggcaaggaagacct

SEQ ID NO: 463 - DNA, 4100 bp, Brachypodium distachyon
ggtgctgcaaggcaagccggacagcgctgctacgagccatggccgccggccaccggtgctgcgaccggcgagccggaaaataagcgccgatgttgcaaagcaacgccggctcccgccttcaaggcggtgcggcgaccggtgcgtcgtggcgcttcgactggtgtgcggcagtgcttcaacacctcgctgtcgctgttgcaaggcggcgggatggtgctgcgtccggtgtgtggcgagctttgacctgtgtacggcggtgctgcgactggtgcacggaggtgcttcgacgctcgccatcactgctgcaaagggggcgtcgcctctagtcggtggggcggtgctgcgacgggcacgcagcgatgcttcgtccgttgtacggtgattatacgaaacgatgctgcaacgatgtgctgtgaccgaagagttgtggaatccaacggcagggagttccaatcggacggacagctagcgcgccctaatttcttgggttctcaaagaatacaacctgagcttataaaacgctcgaggactcacccgtttcgctccatgattttttttttgagcgacgctccctgatattctgctcacgtggccccacatgtagagagggcccaaggcagcctgtcaggcggagcacacggcccaggtcaaaaaccaagtctgtccactacagcccagtctatcccaacacgagcccaagaacgaagcatcccctaaaaaaccaactaaccaggccaccggggtcgcggtacctgccctcatgcacctggtccacaatgtttggcgctgcttccgactccgcgtacgtagccccacaagccagggagacaggagcagcacccctgcacggacccggtccatacgccacccgtccaagctccagccctttttggcgcgaagaattggcgccaagccgccgccaccttcccgccaataacacccctgcaccgcttccctttcccccccaacccaaaacccttgcatctcaccttgcgaccacacgcagtcagacgctgtgagccaccccaaatctacaccctcgtcggagatccaggagaggttcgtcggtcatggaggcgttcggtggattcttcgtggacgagaaggcggcgagggtggagaacatcttcctcgagttcctcaagcggttcaaggagccggatgcggccgagccgttctacgatatggagatggagcagatgcggtcgcgggagtccaccaccatgtacgttgacttcgcgcacgtcatgcgcttcaatgatgttctccagaaggccatctccgaggagtacctcaggtttgagccctaccttcggaatgcgtgcaaaaggtttgtgatggagcaaagggctggggagaaccgtgcgccaataatctcggatgatagccccaacaaggatattaatatttctttctacaacatcccgatgttgaaaaggttgagagagcttgggacagcggagattggtaagctcacagctgtaatgggggttgtgacaaggacgagtgaggtccgacctgagttattgcaaggcaccttcaagtgccttgattgcggaaatgttgtaaagaatgtagaccagcagttcaagtatactgagccaataatatgcgttaatgcaacatgccaaaaccgaaccaaatgggcccttctccggcaagatagtaaatttacagattggcaacgggtcaggatgcaggagacatcaaaagagatacctgctgggtcactacctcgttccttggatgtcattctgcggcatgagattgtcgagaaggctagagctggggacacagtcatttttactggaacagttgttgctgttccagatgttatggcattaacttcacctggcgagagagcagagtgtcgccgagaaggtcctcagagaaagaatgggtcaggtgtccaagaaggtgtaaagggcttgaagtctcttggagtaagagatctctcctatcgccttgcttttgtggcaaactcagtgcaggtggcagatggcaggagagaagtggacatcagggatcgtgacatagatggtgatgacagtgaaagacagaagttcactgaagaggaggaggatgaggttgttaggatgagaaacactcctgattttttcaataagatagttgatagcatatgtcctacagtctttggtcatcaagaaataaagagagcactcctccttatgcttttgggtggtgttcacaagataacacatgaaggcataaaccttagaggcgacatcaatgtctgtattgttggagatccaagttgtgcaaagtcacagtttttaaaatatactgctggtattgttccgcgatctgtctacacatcaggaaagtcctcatctgctgctggtttgacagcaactgttgctaaagaacccgagactggtgaattttgtattgaggcaggtgcactcatgttagctgataatggcatctgttgcattgatgaatttgataagatggatattaaggatcaggttgctatacatgaagcaatggagcagcaaaccattagcataacaaaagcaggaatacaagcaacattgaatgcacgaacttcaatattggcagcagcaaatcccacaggagggcgttatgacaagtcaaaaccacttaaatacaatgtggcattgcctccagctatcctttcaagatttgatctggtatacatcatgatcgatgaacctgatgaaaacactgactaccacattgcccatcacattgtgagggtccatcaaaaacgtgaagaagcactttcccctgcatttagcactgcagaattaaagcgctactttgcttttgcaaagtctttaaaaccgcagttgagttcagaagcaaagaaagttctggtggaatcatatgttgtcctccgtagaggtgacagtactcctggtactagggtcgcttacaggatgactgttaggcaactagaggcattaattaggctgtcagaagcaattgccagaagccatttggaaagaattgttcttccagctcatgtccgcatggcagttaaattgctcaagacatccataataagtgtggaatcaagtgaagttgatctctctgattttcaagatgcggaggatggcacaaatgtacctgctgataatgatcctgaacagccagaagaacctcatcaaccagaagaacctcaacaaatggatgcagcagatgctggtaagaagaaattggttataaccgaggaacatttccagagagttacacaagctttggttatgagactgcggcagcatgaagaatcaatcatgaaagacggggatggtctggctggcatgaagcaaggggatctaatcatttggtatgttgagcagcagaatgcccaaggcgcatatagttctacagaagaggtgaaggaagaagtgaagtgcatcaaggccattatagagaggctgatacagagggaaggacatcttatagtcatagatgaaggagcggcaggcgatggtgtggcagcccaacgaagaccatcggagaacagaatattggcagttaacccaaattatgttattgactaaccatccttcgcaaggaggcactggatctccagaattgtattattgtttcttgctctcaaggtataagcatgatgattctcacctgtagtctgcctatgtaatttttacgctgtgatagggttatgtaaactgtcatggtaagagaagatcattttagtttaagagcctgtgaattctcggtttctaatatactgttgtgccagtttctaaaagaatttatgcgcagtgcaacgcttcattttctttcgtgttgttttgacttattcttgaaaactgataagtctgaaacacatatcagggatgtacatgttcttttcttattgccccaaaagtatacccaaaaatcgaaggatggcaaggaagaccttatttgaattcaagtttcaaatagaacagttgcccttttttttcctgaaagggaagggcaagctcctcctggcaattgtccatttggtttgtaatttatatgatacaaactcacagccatgtctgaatacttttggatctattgacacaaacctatgccacataattgcatccaaataacgc

SEQ ID NO: 464 - DNA, 2970 bp, Hordeum vulgare
cccgcccgaaacccttgcctcccaccgcgcactcgcacgccagagccatcccctaatccccagacactcgtctagatccagaaggtgccagaaggttcgccggccatggaggcgttcggcggcttcttcgtggacgagaaggcggcgcgggtggagaacatcttcgtcgagttccttaagcggttcaaggagccggatgcggcggagccgttctacgatgtagagatggaggcgatgcggtcgcgggagtccaccaccatgtacgtcgatttcgcgcacgttatgcgcttcaacgacgtcctccagaaggccatctccgaggagtaccttaggtttgagccgtaccttcgcaatgcgtgcaagaggtttgtgatggagcacagagctggcgagaaccgcgcgccaataatctctgacgacagccccaacaaggatattaatattgccttctacaacattcctatgctgaaaaggttgagagagctggggacagcagagattggtaagctcacagctgtaacaggggttgtaacaaggacgagtgaggtccgacctgagttattgcagggcaccttcaagtgccttgattgcggaaatgttgttaaaaatgtagaccagcagttcaagtatactgagcctataatatgcgttaatgcaacatgccaaaaccggtcaagatgggccctcctccgtcaggatagcaaatttacagattggcagcgggtcaggatgcaagagacatcaaaagagatacctgctgggtcattacctcgttccttagatgtcattctgcggcatgagattgttgagaaggctagagctggggacacggtcatatttaccggaacggtcgttgctgttccagatgttatggcattaacttcacctggtgagagagcagagtgccgcagggaaggtcctcagcggaagaatgggtcaggtgtccaagaaggtgtaaagggcctgaagtcccttggagtacgagatctctcatatcgccttgcttttgtggccaactcagtgcaggtggcggatggcaggagggatgtggacattagggaccgtgacatagatggtgatggcagcgagagacagaaattcactgaagaggaggaggatgaggttgtcaggatgagaaacactcctgattttttcaataagatagttgatagcatatgtcctactgtctttggtcatcaagaaataaagagggcacttctccttatgctcttgggtggtgttcacaagataacacatgaaggcataaaccttagaggcgacataaatgtctgtattgttggagatccaagttgtgcaaagtctcagtttttaaaatacactgctggtattgttccgcgatctgtttacacatctgggaagtcctcatctgctgctggattgacagcaactgttgcgaaagagcctgagaccggtgaattttgtattgaggcaggtgcactcatgttagctgataatggcatctgttgtattgatgaatttgataagatggatattaaggatcaggttgctatacatgaagcaatggagcagcaaaccatcagcataacaaaagctggaatacaagcaactttgaatgcacgaacttcaatactggcagcagcaaatcccacaggaggacggtatgacaagtcaaaaccacttaagtacaacgtggcactacctccagccattctttcaagatttgatttggtatacatcatgatagatgaacctgatgaaaacactgactaccacattgctcatcacattgtgagagtccatcaaaaacgtgaagaagcactttcccctgcatttagcactgcagaattgaagcgctactttgcttttgcaaagtctttgaaacctcagttgagttcggaagcaaagaaagttctggtcgaatcatatgttgtcctccgcagaggtgacagcactcctggtactagggttgcttacaggatgacagttaggcaactggaggcgctaatcaggctgtcagaagccattgccagaagccatttggaaagaattgttctccctgctcatgtacgcatggccgttaaattactcaaaacatccataataagtgtggaatcaagtgaagttgacctatctgattttcaagatgcacctcttgataatgatgatgaacagccagtacaaggagatgctactgcacaagatggtccagatgaaccagcagaggtgattaagaagaaattggttattactgaagaacatttccagagagttacacaagctttggtcatgagactgaggcaacatgaagaatcagtcaagaaagacggggatggtctggctggcatgaagcaaggggatctgatcatttggtatgttgagcagcagaatgcccaaggtgcatatagttctacagaagaggtgaaggaagaagttaagtgcatcaaggccattatagagaggctgatacagagggaaggtcatcttgtggtcatagatgaaggaacagcagcagaaggtgctgcggcaaggtcatcggagcacagaatcctggcggttaacccaaactatgttatcgattgattaaccagctgaggacacacagctaactagatccatcttgtgtggttgaccaatagagcacacattcaaatggaaatcatactgctgtcctatgctctagaaatgttgtacctgccacccccttcccaaggaagcacatgtatctctggaattgtatcttccttccaaggttgaagcatggtaattaatttgccaccagtactgtgcgtatttttcaccttttcatggttatgtaaactgcaactcatcaagacaagaacaacttaatttgtgtgcttctgaatttataagctttactctcagctagtgttgtgaaaaactctgaaaccagagctagaaaaacatgcctagatgacataatgcaaacatgtgttcattcacattcgtgagaatagtgtgttataccga

SEQ ID NO: 465 - DNA, 2805 bp, Secale cereale
ctctctcaccgcgcactcacacgccagaaccactccccaatccctaaacgctcgtctagatccagaaggcgccagaaggttcgccggccatggaggcgttcggcggcttcttcgtggacgagaaggcggcgcgggtggagaacatcttcctcgagttccttaagcggttcaaggaggcggatgcggcggagccgttctacgatgtggagatggaagcgatgcggtcgcgggagtccaccaccatgtacgttgatttcgcgcacgtcatgcgcttcaacgacgtcctccagaaggccatctccgaggagtaccttaggtttgagccgtaccttcgcaatgcgtgcaagaggtttgtgatggagcacagagctggcgagaaccgtgcgccgataatctccgacgatagccccaacaaagatattaatattgccttctacaacattccgatgctgaaaaggttgagagagctggggacagcagagattggtaagctcacagctgtaacgggggttgtaacaaggacgagtgaggtccgacctgagttattgcaaggcaccttcaagtgccttgattgtggaaatgttgttaaaaatgtagaccagcagttcaagtatactgagccaataatatgtgttaatgcaacatgccaaaaccgatcaagatgggcccttctccggcaggatagcaagtttacagattggcagcgggtcaggatgcaggagacatcaaaagagataccagctgggtcactacctcgttccctggatgtcattctgcggcatgagattgttgagaaggctagagctggggacacggtcatatttaccggaacggttgttgctgttccagatgttatggcattaacttcacctggtgagagagcagagtgtcgccgggaaggtcctcagcggaagaatgggtcaggtgtccaagaaggtgtaaagggcttgaagtcccttggagtgcgagatctctcatatcgccttgcttttgtggccaactcagtgcaggtggccgatggcaggagggacttggacatcagggaccgtgacatagatggtgatggcagtgagagacagaagttcactgaagaggaggaggatgaggttgttagaatgagaaacactcctgatttttcaataagatagttgatagcatatgtcctactgtctttggtcatcaagaaataaagagggcacttctccttatgctcttgggtggtgttcacaagataacacatgaaggcataaaccttagaggcgacataaatgtctgtattgtcggagatccaagttgcgcaaagtctcagtttttaaaatacactgctggtattgttccgcgatctgtttacacatcagggaagtcctcgtctgctgctggattgacagcaactgttgcaaaagaacctgagaccggtgaattttgtattgaggcaggtgcactgatgttagctgataatggcatctgttgtattgatgaatttgataagatggatattaaggatcaggttgctatacatgaagcaatggagcagcaaaccatcagcataacaaaagctggaatacaagcaactttgaatgcacgaacttcaatactggcagcagcaaatccaacaggaggacggtatgacaagtcaaaaccacttaagtacaatgtggcactacctccagccattctttcaagatttgatctggtatacatcatgattgatgaacctgatgaaaacactgactaccacattgctcatcacattgtgagagtccatcaaaaacgtgaagaagcactttccccagcatttagcactgcagaattgaagcgctactttgcttttgcaaagtctttgaaacctcagttgagttctgaagcaaaaaaagttctggttgaatcatatgttgtcctccgtagaggtgacagtactcctggtactagggttgcttacaggatgacagttaggcaactggaggcgcttatcaggctgtcagaagctattgcgagaagccatttggaaagaattgttctccctgctcatgtccgcatggcagttaaattactcaaaacatccataataagtgtggagtcaagtgaagttgacctatctgattttcaagatgcacctcttgataatgatgatgaacagccagtacaaggagatgctactccacaagatggtccagatgaaccagcagaggtgattaagaagaaattcgttattaccgaagaacatttccagagggttacacaagctttggtcatgagactgcggcaacatgaagaatcagtcaagaaagacggggatggtctggctggcatgaagcaaggggatctaatcatttggtatgttgagcagcagaatgcccaaggtgcatatagttctacagaagaggtgaaggaagaagttaaatgcatcaaggccattatagagaggctgatacagagggaaggccatcttgtagtcatagatgaaggagcagccgcagcagaaggtgctgcggcaagggcatcggagaacagaatcctggctgttaacccgaactacgttattgattgattaaccagctgaggacacacagctaattagatccatcatatgtgattgaccaatagagcacacattcaaacggaagacatcctgttgtcctatgctctagaaatgaaatgttgtacctgccacccccttcccaaggaagcacatgatctctggaattgtacctttttgaagtttggtaattaatttaccaactgtattcactgtttcatggttatgtaaactgcaactctgtacgataagtacagcttaatttatgt

SEQ ID NO: 466 - DNA, 3044 bp, Cocos nucifera
cagagggagcgagtcggggcgagcgagcgagagggacagagagatggatgcgtttgggggattcttcgtcgacgagaaagcggtccgagtggagaacatcttcctggaattcctcaagaggtttaaactcgatcccaatgccgttgagccattctacgagtcggagatcgaggcaatgaggtccaaggaatccacaaccatgtatgtggatttctctcatgtcatgcgcttcaatgacgttctccagaaggccattgcggaggagtatctcagattcgagccttacctgagaaatgcttgcaagaggttcgtaatggagcacaaatcaagcgagaataggcctgccatcatctccgatgacagccctaacagagacataaatgtcgcattctataacatcccactgttgaagagactgagagatctgacgacatcagagattggaaagctgacctcagtgatgggggtggtaacacggacaagcgaggtccgacccgagctccttcaagggacattcaagtgccttgaatgtggtggagttgtaaaaaatgtggagcagcagtacaaatacacggagcccataatctgcatgaatgcaacatgtgcaaaccgaactaattgggcactgctccggcaagaaagcaagttcacagattggcagagggtacggatgcaagaaacatcaaaggagatacctgctgggtctctccctcgttcgctggatgtcatcctccggcacgagattgttgagaaggcgagggctggagacacggtcatcttcacaggtactttggttgcggtgccagatgtgatggcattgacttcacccggtgagagagcagagtgccggcgagaggctcctcagcgtcggaatgcatctgccggtgaaggtgtcaggggccttagggctcttggagtaagagatctctcatatcgccttgctttcattgcaaactctgtgcagcttgcagatggtagaagggatggtgacatcagggacaggaggatggatggtgatgaaaatgacaaacaggagttcacgcaagaagaggaagatgaggttatgaggatgaggaacactcctgattttttcaataaactagttgatagcatatgtcccactgtttttggccatcaagaaataaaaagggcagtacttctcatgttgttgggcggtgtgcacaagttgacccatgaaggaatcaaccttagaggtgatgtcaatgtgtgcattgttggagatccaagttgtgctaagtctcagtttctaaagtatactgccagcctagttccccgatctgtttatacatcaggaaaatcctcatcagctgcaggtttgacagcaacagtggctaaagagcctgagactggcgagttttgcattgaggcaggtgcattgatgctggcggataatggtatatgttgtattgatgaatttgataaaatggatataagggaccaggttgccatacatgaagcaatggaacagcagaccataagtatcacgaaagctggaatacaagccacattgaatgctagaacctccattttggcagctgcaaatcctactggaggacgctatgacaagtcaaagccactcaagtacaatgtggcccttcctcctgctatcctttcaaggttcgatctagtatatgttatgattgatgaaccagatgaaaacactgattaccatattgcccaccacattgtgagagttcatcagaaacgtgaagatgcacttgcccctgcatttaccactgcagagttgaagcgttatatcacatatgcaaagtcgttgaaacctcagctgagctcagaagcgaaaaaggtgctagtggaatcatatgtaactcttcgcagaggggacagtactcctggaaccagagttgcttacagaatgacagttaggcaactggaggccttgatcaggctttctgaagccattgctcgttgtcacttggagaaagtggtgcttccagcgcatgttcgcatggcagtaaggctgctaaaaacatccattatcagtgttgaatcaagtgaaatcgatctttctgatttccaagatcatgaagatggtgatgggaacagagcttctgatcaagctgccgcagaaccagctcctgcaaatgttgatcaagtgccagaaaatgaaggtaatgaacaaggggccgatagtcggcagaagaagaaactggttataacagaagatcattttcagagagttactcaagctcttgtcatgcgcttgcgacagcatgaagaggcagtaatgcaagatggaagtggtttggctggcatgaagcaaggtgatctaattgtttggtatgtcgagcagcagaatgcccaaggtgcgtacagttccaccgacgaggtgcgggaagaggtcaagtgcatcaaagctattatagagaggttgatacaaagggaaggacacctaatagtcatagatgatgggacaggctcggcagctgtagatggcggtgaggcaaggagatcctctgagaatcggattttagctgtggccccaaattatgtcattgattgacaaaacaacctataaaattttaatttatccaccatcgaacatgatgaggatgtatttggaagaaaacaaggtgaagacatcgttactgcagctggctgttgcttgttttaggtgtttgatggcagcagctagggtttctcatcagcatccaggaaaacagatggtgagtcactctgtattgatgattcatgttgcatgatagaagcattagggctgattttcggcgatctgcaggtgagaattttattgtatcaaggtgagaatgatagcttccttttgtttatcagcaaaacttttctcctatgttggctgacaggttgtgttttttcttgtaatgcatctgttcaacgatggtgtcatcaaactgcagcttaagctacagtacttgattcgatatgacatggtccagtgacagttgagttttataagttaacatttcatttatattttcttgtctttcaacatgaagaaggaagaacccaataaataatgatttaac

SEQ ID NO: 467 - DNA, 3367 bp, Ananas comosus
cgaccttgactcctctctctctcccctgtctctgctgatgccctagcctccttcgctccgccggagatccgccttccccgtcagatcgcctcaccaatctcgcttctcccgccttgctgcagctcctttcctccttaactgagagagtgatggggggggggggggggggggggggggggggggggggagatggagggcttcagcggcttcttcgtcgacgagaaagcggttcgcgtcgagaacatcttcctcgagttcctcaagaggttcaagcttgatccgaatgcgacggagcccctctacgaggccgagatcgaggcgatgcggtccaaggaatccaccaccatgtacgtggacttctcccacgtgatgcggttcaatgatgttcttcagaaggccatctccgaagagtacctccgatttgagccctatttgaggaatgcgtgtaagagatttgtgatggagcagaaatcgggaccgtccataatccccgacgatagccctaacaaggacatcaatgtcgccttctacaatattccgctgctgaagagattaagagacctcaagacctcggagatcgggaagttgacgtcggtgatgggggttgttacgcgaactagcgaagttcgtcccgagctccttcaggggaacttcaagtgcctcgagtgtgggaacgttgcgaagaatgtggagcagcagtttaagtatacggaacctatcatctgcacgaacgcgacatgtcagaaccgagctaagtgggctcttctccggcaagagagcaagttcacagattggcagaggatgcggatgcaggagacttcaaaggaaattcctgccgggtctcttcctcggtcgttggatgtcattctgcgacatgagatggttgagaaggcgagggctggggacacggtcatcttcacaggcatggtggttgctgtaccagatgtgatggcattaacttctcctggagaaagggcagaggttcggcgggaagcttctcagcgtcggaatggaggtagcggtcatgaaggtgtaaggggtttgaaatctttgggagtaagagatctctcgtatcgcattgctttcatagcaaactcagtgcaggtgacagatgggaggagagatggcgaccttagggaccggaaattggatggtgatgacacagacagacaagaattcactcaagaagaggaagaggaggttttcaggatgagagacactcctgattttttcaataagcttgttgatagcatatgccctactgttttcggtcatcaagaaattaaaagagcaatcctccttatgctattgggtggtgttcacaagattacacatgaaggaactaacctcagaggtgatattaatgtgtgtattgttggagatcccagttgtgcaaaatcccaattcctgaaatatgttgccggtcttgttccacggtctgtttatacgtcaggaaaatcctcatcggctgctggtttgacagcaacagttgctaaagagccagaaacaggggagttttgtattgaggctggcgcacttatgctggctgataatggtatctgttgcattgacgaatttgacaagatggacattagggatcaggttgccatacatgaagcaatggaacaacagaccattagcataacaaaagctggcatacaagcaactctaaatgctagaactgctatcttagctgcagcaaatcctacaggaggacgctatgacaagaccaaacccctcaaatacaatgtggcccttcctcctgctattctttcaaggtttgatctggtgtacatcatgatcgatgagcctgatgataacactgattatcatattgctcaccacattgtgagggttcatcagaagcgcgaagatgcacttgcccctccatttaccacagcagagttgaagcgatattttgcttatgccaagtctcttaagcctcagctgagctctgaagctagaaaagtgttggttgaatcatacgtggcacttcgcagaggtgacactactcctggcactagagttgcttatagaatgacagtcaggcagctggaagcattaatcaggctgtctgaagccattgcaaggagtcatttgtataaagttgtgcttccggcacatgttcgaatggctgtaaggctgctaaaaacatctataatcagtgttgagtcgagcgagatagacctctctgactttcaagataatgaagatgctggtggaaatagagttgctgaccaagaaattgcagctccaactgaaaatgctcatccagcaccagaaaatgaaggtgatgctcaagggagtgagggccagcagaagaaaaaatggttataactgaagaacatttccagagagttactcaagcattggtcatgcgcctgcgacagcatgaagagactgttatgcaagatggaagtggattggctggcatgaagcaaggggacttgattgtttggtatgttgagaaacagaatgctcaaggtgcatacagttccaccgatgaggtgcgagaagaagttaaatgcatcaaggctgtcatagagaggttgatacagagggaaggtcatctgatagtgatagacgacggctcaagctcagcggcaccttcggcagatggaggggaaacaagaagatccgcggagaatagaatcttagcagtggctccaaattatgttattgattaacacatcaagttaacaaagaactaacctattcaattgacatggagaaactatcagattgtgccaccaattgttccggacatcaggtttcgttgaagtgtgacaacacatacggactctatgaaagtttcacagttcagcagccctgcttagaagaggattaaagtaggctttagtttgggacttgcgaagaggattttcatttcctaatgttatttgctatcctaagttgcaatacattcttcaggatataagatatactcttgcttccgcatggcaaatctatcagtcgccctgttaaagtttgatataagctggcaacaacattttcctcttttcttagactttgcccatttgattctgtatgaaatatgtcctattgagagggttgtactgtgttaaaaggttgactactccgtaactgatttccttttctggttgtattacattttgttgctgtaaatcgcaacagttttcagccgtcagcaggaagcggccttctcttagtcgtctaacacagttcagttggtcagcactttttccccaattgcagagctattattttcattagcaagacaagaagataatgaatggatcatgtacttgtacttttgcagcacaatggcctgggttcttctttggcttagcctttgaagtgacttttttacctttttcagattcgg

SEQ ID NO: 468 - DNA, 2788 bp, Musa acuminata
ccgttcctaacctccgaccgacctcttcgatcaatcgaaagggctacagggagagcgtgattgctaccgggatggatgccttcggggggttcttcgtcgatgagaaggcgatccgcgtggagaacatcttcttggaattccttaagagattcaagcatgatccaaacgcggtggagccgttctatgaggcggagatcgaggccatgcggcacaaggaatccaccaccatgtacgtggatttctcccatgtcatgcgcttcaacgacgtcctccagaaggccatttcagaggagtacctcagattcgagccctatctgcggaatgcttgcatgagattcgtaatggagcagaaatcgagcgagaacagacaacctatcatcgcagatgacaaccctaaccgcgacataaatgtcgccttctacaacattccattgttaaaaaggttgagggacctgacgacatcagagattgggaagctgacttctgtaatgggggtcgttacccggacaagtgaggtccggccagagctcctgcaggggacctttaagtgccttgagtgtggcggagtcattaagaatgtggaacagcaatacaagtataccgagcctataatatgcatgaatgctacatgtgcaaaccgaaataagtgggcattgcttcggcaagagagcaagttcacagattggcaacgggtaaggatgcaggagacatctaaagaaatacctgctggttctcttcctcgatctttggatgttattctccgacatgagattgttgagaaggcaagggctggagacacggtcatcttcactggcacattggttgcggtgccagatattatggcactgacttctccaggtgagagagcagaatgcaggcgtgaagctcctcagcgtcaaaatgtatccggtggccatggaggagtcagcggtctcaaggctttgggagtaagggatctttcatatcgcctcgctttcattgcaaactcagtgcagatagcagatggtagaggggatggagacatcagagacaggaagatagatgttgatgacagtgataaacaggagttcacacaagaagaggaagatgaggtgatgaggatgaggaatacccctgattttttcaataaattagttgacagcatatgccccacggtttttggtcatcaagaaataaagcgagcagttttgcttatgttattgggtggtgtgcacaagttaacccatgaaggaattaaccttagaggtgatatcaatgtgtgcatagtaggagatccaagctgtgcaaagtctcagttcctaaagtatacttctaatctcgtaccccgatctgtttatacatcaggaaaatcctcctctgctgcaggtttgacagcaacagtggctaaagagccagaaaccggggagttctgtattgaggcaggagctctaatgcttgcagacaatggtatatgttgcatagatgaatttgataaaatggacattagggaccaggttgctatacatgaagcaatggagcagcagactataagtatcaccaaagcaggtatacaagccacgttgaatgcaagaacttcaattttggcagcagcaaatcctactggaggacgctatgacaagtcaaagccccttaagtacaatgtggcccttcctcctgctattctttcaagatttgatctggtgtacattatgatcgatgagccagacgaaaacacagactaccatattgctcatcacattgtgagagttcatcagaagagggaggatgcacttgcccctgcatttacaactgcagagttaaagcgatacatagcatatgctaagtctctgaaacctcagcttagttcggaagcaaaaaatgtgctagtggaatcatatgtagctcttcgtagaggtgatagtactcctggaaccagagtggcctacagaatgacagttaggcaacttgaggcattgatcaggctttctgaagcaattgctaggagtcatttggagaatgtggtgctcccagcccatgttcgcgtggcagtaaaactcctaaaaacatccattatcaggcaagaagatttttttagatatcaacagaagttcaaggtagtttcttctggattcttaaaaagttttgtgtatacatacagtgttgaatctagtgagatcgatctttctgatttccaagatcatgaagatggtgttgcagtcaatgttcctgatcaagatgctgcagagttggcttctgatggaattagtccagcaacagaaaatggaggtaatgaacaaggatctgagagtcatcagaaaaagaaacttgttataactgaagaacactttcagagagttacccaagcccttgttatgcgtctgcggcaacatgaggaggcagtagcgcaagatggaagtggtttggctggaatgaagcagggggatctaattatttggtacgtggagcagcagaatgccgtaggtgcttacagtaacaccgatgaggtccgggaagaagtcaagtgcatcaaagccattatagagaggttgatacagagggaaggccatctgatagtgatagatgatggaacgagctcagcagcgtcggatggtcaagcaagaagatcgagtgagaaccgaattctggcagtggctccaaattatattgtcgagtaggagcatctgcaagtgcaggctgcagtcctttttagagatttctacatataggaagactcgggatgggacaattagaggcctttctgtattaactaattactaccgcaatgctcctccgtccagccctatgcgag

SEQ ID NO: 469 - DNA, 2897 bp, Musa acuminata
ctccccattagatccgttcgtaacctccgaccgacctcttcgatcaatcgaaagggctacagggagagcgtgattgctaccgggatggatgccttcggggggttcttcgtcgatgagaaggcgatccgcgtggagaacatcttcttggaattccttaagagattcaagcatgatccaaacgcggtggagccgttctatgaggcggagatcgaggccatgcggcacaaggaatccaccaccatgtacgtggatttctcccatgtcatgcgcttcaacgacgtcctccagaaggccgtttcagaggagtacctcagattcgagccctatctgcggaatgcttgcatgagattcgtaatggagcagaaatcgagcgagaacagacaacctatcatcgcagatgacaaccctaaccgcgacataaatgtcgccttctacaacattccattgttaaaaaggttgagggacctgacgacatcagagattgggaagctgacttctgtaatgggggtcgttacccggacaagtgaggtccggccagagctcctgcaggggacctttaagtgccttgagtgtggcggagtcattaagaatgtggaacagcaatacaagtataccgagcctataatatgcatgaatgctacatgtgcaaaccgaaataagtgggcattgcttcggcaagagagcaagttcacagattggcaacgggtaaggatgcaggagacatctaaagaaatacctgctggttctcttcctcgatctttggatgttattctccgacatgagattgttgagaaggcaagggctggagacacggtcatcttcactggcacattggttgcagtgccagatattatggcactgacttctccaggtgagagagcagaatgcaggcgtgaagctcctcagcgtcaaaatgtatccggtggccatggaggagtcagcggtctcaaggctttgggagtaagggatctttcatatcgcctcgctttcattgcaaactcagtgcagatagcagatggtagaggggatggagacatcagagacaggaagatagatgttgatgacactgataaacaggagttcacacaagaagaggaagatgaggtgatgaggatgaggaatacccctgattttttcaataaattagttgacagcatatgccccacggtttttggtcatcaagaaataaagcgagcagttttgcttatgttattgggtggtgtgcacaagttaacccatgaaggaattaaccttagaggtgatatcaatgtgtgcatagtaggagatccaagctgtgcaaagtctcagttcctaaagtatacttctaatctcgtaccccgatctgtttatacatcaggaaaatcctcctctgctgcaggtttgacagcaacagtggctaaagagccagaaaccggggagttctgtattgaggcaggagctctaatgcttgcagacaatggtatatgttgcatagatgaatttgataaaatggacattagggaccaggttgctatacatgaagcaatggagcagcagactataagtatcaccaaagcaggtatacaagccacgttgaatgcaagaacttcaattttggcagcagcaaatcctactggaggacgctatgacaagtcaaagccccttaagtacaatgtggcccttcctcctgctattctttcaagatttgatctggtgtacattatgatcgatgagccagacgaaaacacagactaccatattgctcatcacattgtgagagttcatcagaagagggaggatgcacttgcccctgcatttacaactgcagagttaaagcgatacatagcatatgctaagtctctgaaacctcagcttagttcggaagcaaaaaatgtgctagtggaatcatatgtagctcttcgaagaggtgatagtactcctggaaccagagtggcctacagaatgacagttaggcaacttgaggcattgatcaggctttctgaagcaattgctaggagtcatttggagaatgtggtgctcccagcccatgttcgcgtggcagtaaaactcctaaaaacatccattatcaggcaagaagatttttttagatatcaacagaagttcaaggtagtttcttctggattcttaaaaagttttgtgtatacatacagtgttgaatctagtgagatcgatctttctgatttccaagatcatgaagatggtgttgcagtcaatgttcctgatcaagatgctgcagagttggcttctgatggaattagtccagcagcagaaaatggaggtaatgaacaaggatctgagagtcatcagaaaaagaaacttgttataaccgaagaacactttcagagagttacccaagcccttgttatgcgtctgcggcaacatgaggaggcagtagcgcaagatggaagtggtttggctggaatgaagcagggggatctaattatttggtacgtggagcagcagaatgccgtaggtgcttacagtaacaccgatgaggtccgggaagaagtcaagtgcatcaaagccattatagagaggttgatacagagggaaggccatctgatagtgatagatgatggaacgagctcagcagcgtcggatggtcaagcaagaagatcgagtgagaaccgaattctggcagtggctccaaattatattgtcgagtaggagcatctgcaagtgcaggctgcagtcctttttagagatttctacatataggaagactcgggatgggacaattagagggcttgtgtattaactaattactaccgcaatgctcctccgtccagccctatgcgagagtttgtaccactgtaagtgtttgctttatttttatgatatcaaagttgagtttcaagtatcctctctacgttgaagaaaatgctttaattatgaac

SEQ ID NO: 470 - DNA, 2436 bp, Gossypium raimondii
tccaaatttagtcggcaattttatattttcagaaaacccctctttagcccctaatatccaacttttcttttcactttcaacccatattcttccttgttccacaccatcctcctcctccttctcctcttcttcgaattagggtttcacgatccccagatatgaagcgaactgccacgaagaagaagaggcggcctcgtgcggcgaaaacttcggcggtcaacgattcgtcacgtcacgctttaagtcagcgggatcagcggcgagaaggagaaggagaaggagaagacgatgaagaacaaaaaaggcttctcggctcgttaatggaagccttcggttcgatctctctagaagaagccacgtcagcttataaccaagccgacggtgatttggacaaagcggccgagattctatccaatttgatcgataacggtagcaatagtgaagatcccgatccgtcgacgagctcgatatcgagtggctcgtcatcgtcaggttcgtccgggttcggtttttctgaaacgagttgcgtacaaaatctgaatagcgggaggggacgtagcagagggggaaaacagcagaagcgagtggtagcgtcaacggggacggtttcgaccgtcctcgggaaagattacgttaggtcaagcccatggcgagacccggctgcagtggcaccggcgaaatcggtgttggcgacggaagaagcggaacagtttttatgctcaatgcttggggaagagtgtgaacttagcatggctgttgttagagatgttttgtgtctgtgtgggtacaatgttgagaaggctttggatgcattacttgatttatctgcttcctcctatgaaaaatccaagagttttaatgacaatttgaacagtagacaagatacaggattcgtaattgaatgtgcagacaatttaacagataggacatctgaccgcatatctaagttgttggaaagcgaacttcaagatagtatatggtcagccggatatggtcacaggaattactctaaggttcttgctagttctgaagctatgcaaccaccttgcccaaggagtaatgtttcgaatctccctcaggaggtcctggattctttatttaaaatccccaagagttctgagcatgaaccaagcactatgagttggaggaatgtagtaaagaagatgcagttgttgggaccacctattgatttttgtccatctactgatgcagaacctcagcaggatatctatgctaagggagatgaatatcacaaatttagagagagtgccaaagaacattgggattccatgagatcttattatcagaaggctgctactgcatattcaaagggagagttggagtatgcagcttatctttctgatcagggaaagatacagactaaattggcacgggaagcagatgaaagggcaagccagaatatatttaaagctaggaacaaagcctttgaaaatgtgataacaattgatttgcatgggcaacatgtcaaacaagcaatgaaacttttaaaactacaccttctatttggaatacatgttccttcggttcaaactctgagggttattactggctgtggaacacatggtatggggaagtcaaaactgaaacagtcggtcactaagcttcttgaaaaggaaggtattcagtggcaggaagaaaaccgtggaactgtactaatcaagcttgacggatacagagagttaagctttttagaatccaatagtgacacggagtaaattaattatctaataccaggtttgcatcatttaccatctgtttgtacaagacaaggatgtaatgtaacaaggtttaatgtagtggttcaaaaacagggatcagatgtttatatgtacattactagaagtccttgtactctttcctccttaggtaggtttcctccttgtaatcttcatgaagcttccgtgttcctgtatgttgagtttagcaaaatcgtgtatctgactcagttattggtaatgacaaagactcatgagagactgtgaattccatagttatcaacaaagagttgctgtgttcttttactttcattataaactcggtttggtatggagcatctttcctgctgcaggtaacctatttgtttgacaagatggaagaatggttggggattgttttgcttgaagtgttgcagaatggcgcagcagtgccagattttgagaagttgggaaatctattttattattgttttgatacttaaagttggggagtttccagtgacaccctagttgttctatcttcgattttgttgctggcttgagttgatttgtttagcattttatagaatagatgaattagcgtatctgtaacgtggattatggttcatggctttgtcttacaataatccttgtattaacctattcatccaacaatattttcttgttctgttggattcatccaacttttttggaccctggc

SEQ ID NO: 471 - DNA, 1903 bp, Gossypium hirsutum
tcctcctcctcctcctcctcctcctcttcgaattagggtttcacgatccccagatatgaagcgaactgccacgaagaagaagaggcggcctcgtgcggcgaaaacttcggcggtcaacgattcgtcacgtcacgctttaagtcagcgggatcagcggcgagaaggagaaggagaagacgatgaagaacaaaaaaggcttctcggctcgttaatggaaaccttcggttcgatctctctagaagaagccacgtcagcttataaccaagccgacggtgatttggacaaagcggccgagattctatccaatttgatcgataacggtagcaatagtgaagatcccgatccgtcgacgagctcgatatcgagtggctcgtcatcgtcaggttcgtccgggttcggtttttctgaaacgagttgcgtacaaaatctgaatagcgggaggggacgtagcagagggggaaaacagcagaagcgagtggtagcgtcaacggggacggtttcgaccgtcctcgggaaagattacgttaggtcaagcccatggcgagacccggctgcagtggcaccggcgaaatcggtgttggcgacggaagaagcggaacagtttttatgctcaatgcttggggaagagtgtgaacttagcatggctgttgttagagatgttttgtgtcagtgtgggtacaatgttgagaaggctttggatgcattacttgatttatctgcttcctcctatgaaaaatccaagagttttaatgacaaattgaacagtagacaagatacaggattcgtaattgaatgtgcagacaatttaacagataggacatctgaccgcatatctaagttgttggaaagcgaacttcaagatagtatatggtcagccggatatggtcacaggaattactctaaggttcttgctagttctgaagctatgcaaccaccttgcccaaggagtaatgtttcgaatctccctcaggaggtcctggattctttatttaaaatccccaagagttctgagcatgaaccaagcactatgagttggaggaatgtagtaaagaagatgcagttgttgggaccacctattgatttttgtccatctactgatgcagaacctcagcaggatctctatgctaagggagatgaatatcacaaatttagagagagtgccagagaacattgggattccatgagatcttattatcagaaggctgctactgcatattcaaagggagagttggagtatgcagcttatctttctgatcagggaaagatacagactaaattggcacgggaagcagatgaaagggcaagccagaatatatttaaagctaggaacaaagcctttgaaaatgtgataacaattgatttgcatgggcaacatgtcaaacaagcaatgaaacttttaaaactacaccttctatttggaatacatgttccttcggttcaaactctgagggttattactggctgtggaacacatggtatggggaagtcaaaactgaaacagtcggtcactaagcttcttgaaaaggaaggtattcagtggcaggaagaaaaccgtggaactgtactaatcaagcttgacggatacagagagttaagctttttagaatccaatagtgacacggagtaaattaattatctaataccaggtttgcatcatttaccatctgtttgtacaagacaaggatgtaatgtaacaaggtttaatgtagtggttcaaaaacagggatcagatgtttatatgtacattactagaaatccttgtactctttcctccttaggtaggtggaagcttcatgaagatgaagcttccgtgttcctgtatgttgagtttagcaaaatcgtgtatctgacttagttattggtaatggcaaagactcatgagagactgtgaattccatagtta

SEQ ID NO: 472 - DNA, 1341 bp, Pennisetum glaucum
gccgccccgtctccagtctccacccctcctccctcttcctcggccacaccgccagtgcccaagccttgtcttgcctcgctgctgctgctgcttcttccaccaccgggactgcgggagcggccgggatgaaggtcaccgtcgtgtcccggagcggccgggaggtcgtcaagggcggcatcgacctcaaggacttcgcaaaggtcgcggatctgcaggaggccatccatgccaggactaagaagtattatcctgctagacagcggctcactctccctcttcaacctggaaaaggtggaaagccagttgtcctcaatccgaaagccagtctgtcagagtactgtgagaagggttctgggtcactgactgtagtcttcaaagatttaggcccacaagtctactacagcacgctcttcttctttgagtacttgggtcctcttatcatctaccccatgttctattacctgcctgtctacaaattcttcgggtacgagggagaacgggtcatccaccctgtccagacctatgccatgtactactggtgcttccactacttcaagaggatcatggagacgttcttcgtgcaccgtttcagccacgcaacatcacctctgtcaaacgtcttcaggaactgcgcctactattggactttcggtgcttacattgcttactactgcaaccacccactctacaccccagtgagtgatctgcagatgaagattgggtttggcttcgggatcatctgccagattgcaaacttctactgccacatcttgctgaggaacctcaggagcccaagtggtaacggtggttaccagatcccccgtggtttcttgttcaacattgtgacctgcgccaactacaccaccgagatctaccagtgggttgggttcaacattgccacccagactgtggcaggctacatcttcctcgtcgtggctgcaagcatcatgaccaactgggcgctaggcaagcacagccgcttgaagaagctgtttgatggcaaggacgggaggccgaagtatcctcgccgctgggtgattctccctccgttcctgtgaagaggtgatgattgcggtagctgctggcctgtcatgattcaatatctcatgcgttcagaagaagtttcaaatcatggataccaagcaaacatttgtactaatcacacctttgtaccagtggaactttgattccgaagtcttaaatttctaatccgaaagatggatgttaagtttttcttcggtattctgtgacaatgtcatgtgatcctgtcgtaacagtaatacattcgaatgttcatctggtgtcggcttcttttacaaaaaaaaaaaaagtaaaactcta

SEQ ID NO: 473 - DNA, 1693 bp, Saccharum officinarum
tctgagttcgtacgattccggttgacacgctgcccctcttcgatgtatcacactacacgcagcacgagtcctagtcgtctctctctccccgctctgcctcgctgccgcggcttcccgccggcgggaggatgaaggtcaccgtcgtgtcccggagcggccgggaggtcgtcaagggcggcatcgacctcaaggactcggccaaggtcgcggatctgcaggaggccatccatgccaggactaagaagtattatccttctaggcagcggctcaccctccctattcaacctggaaaaggtgggaagccagttgtcctcaatccgaaggccagcctgtcagaatactgcgagaagggttctgggtcactgacagtggtcttcaaagatttaggaccacaggtctactacagcacgctattcttctttgagtacttgggtcctcttatcatctaccccatgttctattatttgcccgtctacaaatacttcgggtacgagggggaacgggtgatccaccctgtccagacctacgccatgtactactggtgcttccactacttcaagaggatcatggagacgttcttcgtgcaccgcttcagccacgcaacatcgcccctgtcaaacgttttcagaaactgcgcctactactggaccttcggcgcttacattgcttactactgcaaccacccgctgtacaccccagtgagtgatctgcagatgaagattgggttcggtttcgggatcgtctgccagattgcaaacttctactgccacatcctgctgaggaacctcagaagcccaagcggcagcggcggttaccagatcccccgtggcttcttgttcaacatcgtgacctgtgccaattacaccaccgagatctaccagtgggtcgggttcaacattgctacgcagactgtggcaggttacatcttccttgtcgtggcagcagctatcatgaccaactgggcgcttggcaagcacagccgtctgaagaagctatttgatggcaaggatggaaggcccaagtaccctcgccgctgggtgattctccctccattcctgtgaacaggtggtggctgttggtcggcccattgggattcgatgtctacagcatccccagcacacagaagttcgaattcttgaatggtcatgcgaacagttgtactaatcacgcctttttacgggttgaacttcgactctattgcccacatttctaatccgaaagatggattttattttttttcttggtattgtgtcacaatgttacgtggtcctgtcttaatacgatccaaggttcatctgatgttatcttctttttcgcccccatttgtccaagcagaagtgaatgcagacataatttcgttttgacactttgcgttgctgtcgtgtcctatgaccctgcatatctaatctgaagtttgtgatgcatatgcatgacattattgccgtcaattttattgcacggcatacagcttcaaggaatcaaggtgaatgatgacttgcagacttttgagcctccatgtgtagtaccaacagcattttacttttgaggttgccatccacgtcaccatttttttttactgctcacatgcagacattctgcagaccatattttgttttacttccagtcctgagcctccatggggctattactatatgatttgatgtgaaggaaaactctgaatgttcatcatggc

SEQ ID NO: 474 - DNA, 1310 bp, Echinochloa colona
ccacctcctctcctcttctcctcctcggctagtcagtcctcgccttgcctcgctgtcgctgccgctgctgccagcgcggggggcgcgaggatgaaggtcaccgtcgtgtcccggagcggccgggaggtcgtcaagggcggcatcgacctcaaggactcggccaaggtcgcggatctgcaggaggccatccatgccaggactaagaagtattacccttctagacagcggctcacccttcctcttcaacctggaaaaagtggaaagccagttgtcctcagtccgaaggccagcctatcagaatactgtgagaaaggttctgggtcactgacagtagtcttcaaagatttaggccctcaagtctactacagcacgctgttcttctttgagtacttgggtccccttttcatctaccccatgttctattatctccctgtctacaaattctttgggtacgatggagaacgggtcatccaccctgtccagacctacgccatgtactactggtgcttccactacttcaagaggatcatggagacgttcttcgtccaccgtttcagccacgcaacatcgcctctgtcaaacgtcttcaggaactgcgcctactactggaccttcggcgcttacatcgcttactactgcaaccacccactctacaccccagtgagtgatctgcaaatgaagattgggtttggcttcgggatcatctgccagatcgcaaacttctactgccacatcctgctgaggaacctcagaagcccaagcggaagtggaggctaccagatcccccgtggtttcttgttcaacattgtgacctgtgccaactataccactgagatctaccagtgggttgggttcaacattgccacacagactgtggcaggctacatcttcctcgttgtggcagcaagcatcatgaccaactgggcgctaggcaagcacagccgcttgaagaagctgtttgatggcaaggacggcaggcccaggtatcctcgccgctgggtgattctccctccattcctgtgaagagggtatccttggcgctgggtgattctattgcagcttgcctatcaggattaaatgttttatgcgttccagcgttcagaagctccaaagtattgaataccatgcaaacatttgtactaattatgctattgtaccagttaaaactttgattccgaagtctgaaatttctaatccgaaagatggatgttaaattgttctttggtattctgtcatgatgtcatgtggtcctgtcttaatacagttgaaggttcatctgatgtcagcttatttttgctcccatttgtcca

SEQ ID NO: 475 - DNA, 1767 bp, Sorghum bicolor
ctcgccgttccgtctccacttctctccacgtctccacggccacgcccgcaggcagcagcagtcctagtcgtctctctctctctccccgccccgctctgcctcggcttcccgccggcgggaggatgaaggtcaccgtcgtgtcccggagcggccgggaggtcgtcaagggcggcatcgacctcaaggactcggccaaggtcgcggatctgcaggaggccatccatgccaggacaaagaagtattatccttctaggcagcggctcaccctccctcttcaacctggaaaaggtgggaagccagttgtcctcaatccaaaggccagcctgtcagaatactgcgagaagggttctggatcattgacagtggtcttcaaagatttaggaacacaggtctactacagcacgctgttcttctttgagtacttgggtcctctcatcatctaccccatgttctattatttgcccgtctacaaatacttcgggtacgagggagaacggatcatccaccctgttcagacctacgccatgtactactggtgcttccactacttcaagaggatcatggagacattctttgtgcaccgtttcagccacgcaacatcacccctgtcaaatgtcttcagaaactgtgcctactactggaccttcggcgcttacattgcttactactgcaaccacccgctgtacaccccagtaagtgatctgcagatgaagattgggttcggtttcgggatcatctgccagattgcaaatttctactgccacatcctgctgaggaacctcagaagcccaagcggcagcggcggttaccagatccctcgtggcttcttgttcaacatcgtgacatgcgccaattacaccactgagatctaccagtgggtcgggttcaacattgctacgcagactgtggcaggttacatcttccttatcgttgcagcagctatcatgaccaactgggcgcttggcaagcacagccgtctgaagaagctttttgatggcaaggatggaaggcctaagtatcctcgccgctgggtgattctccctccattcctgtgaacaggtggtggctgttggtcggcccattgggattcaatgtctacagcatccccagcacacagaagttccaattcttgaatgtcatgcgaacaattgtactaatcacgcctttttaggggttgaacttcgactctgttgtccaaaatttctaatccgaaagatggattttattttattgccttggtatttgtttcacaacgttacgtggtcctgtcttaatatgatcgaaggttcatgtgatgttatcatctttctcgccccatttgtccaagcagaagtgaatgcagacataatttcgttgacatttggcgctgctctcctgtcctataaccctgcttgtctcatctgaatcttgtggtgcttgacattgttgccgtcagttttattgcatggcatacagcttcaaggaatcaaggtgaatgatgacttgcagacttttgtggccccacttatgtttgattcctggatggcacaattaacagttatcatgtggagtaccaacagcattttacttttgaggttgccatcctcgttaaaaaaaaaaactattgctatgatttgatgtgaagaaaaactgagatctcctcgcaagcaatgcatgaccttttcctgaatcctgtctttttcttgtgaaaatgaattgatcccataatttttttggtatgattactgcaaaattcttgtgttccaaagggatctgaatgttcatcat

SEQ ID NO: 476 - DNA, 2096 bp, Panicum virgatum
acgcttcggggcgcgatgtacggctacgttttttttctctttatatgatagagcagtactcatgctattttttcaaacaaattgagcaaaaattccactcacatgctttgcgccggtttacaactcccaacttcgtacttccaattgtaaaaaagttttagcactgtactggccaagggaagccgtggacccggtccacatcaagatgttgagccacataactccgggtgggtccaacgccccccacctgcaagcgggcccaccagccccgcgccgcgggatcaaatacacctcctccctccgtccactccctcgccgccccgtctcctccctcttctcttcacttctcctctcctcggccacaccgccacaccgtcgcctcgctgctgcctgctgccagctgctgctgccagcgcggcgcgggcgggatgaaggtcaccgtcgtgtcccggagcggccgggaggtcgtcaagggcggcatcgacctcaaggaatcggccaaggtcgcggatctgcaggaggccatccacgccaggactaagaagtattatccttctaggcagcggctcaccctccctcttcaacctggaaaaagtggaaagccagttgttctcagtccaaaggccagcctgtcagaatactgtgagaagggttctgggtcactgacagtagtcttcaaagatttaggcccgcaagtctactacagcacgctgttcttctttgagtacttgggtcctcttatcatctaccccatgttctattatttgcccgtctataaattcttcgggtatgagggagaacgggtcatccaccctgtccagacctatgccatgtactactggtgcttccactacttcaagaggatcatggagacattcttcgtgcaccgttttagccatgctacatcacctttgtcaaatgtcttcaggaactgcgcctactactggaccttcggcgcttacattgcttactactgtaaccacccgctctacaccccagtgagtgatctgcagatgaagattgggtttggcatcggaatcatctgccagatcgcaaacttctattgccacatcctgctgaggaacctcagaagcccgagcggcagtggtggttaccagatcccccgtggtttcttgttcaacattgtgacctgcgccaactataccaccgagatctatcagtgggtcgggttcaacattgccacacagactgtggctggctacatcttccttgtcgtggcagcaagcatcatgaccaactgggcgctaggcaagcacaaccgcttgaagaagctgtttgatggcaaggacgggaggcccaagtatcctcgccgctgggtgattctccctccgttcctgtgaagaggtggtgattgcggctggcctgtcacagttctacgtaccagccttcagaagttccaagacatgatatcatgcaaacatttgtactaattgtgccttagtaccagttgaaccttgatcacgaagtctgaatttctaatccgaaagatggatgttaaatttttctttggcttcttttgaaatgtcatgtgctcctgtcgtagtgcaatcgaaggttcatctgctgtcatatttttcgcccctatttgtccaagcataagtaactgcaaacataacttcctattgacgcttgctgttgctgtcctatcatcctgcatatatgtcatccttgatactggaatcgagctacttccatttttttaaaacttgaaaatcctgatgcttgacattgctgccgtcaatttgattgcccggcagcatgctgctctgtattcatggcgagatttcttgctgacttttgggactcctgtgatgtttgattcctggatgcagctatcatgtgaagtgccaacgacatctacttttgcaactgctcacatgtggacgatctgcaggccactttttttttttgtacttccagtatgggtcttcatggggccaattactaacaagtggcccaaagaaaaactctgaaggcctgtttgggttgatgccaccaggcatagtttctgtagttatttggttgctgcttgctgccataaattagaccgttaacttcttagtcacatggtgcac

SEQ ID NO: 477 - DNA, 1283 bp, Triticum aestivum
gcacgaggccccgccccgctctgcctcggcttcccgccggcgggaggatgaaggtcaccgtcgtgtcccggagcggccgggaggtcgtcaagggcggcatcgacctcaaggactcggccaaggtcgcggatctgcaggaggccatccatgccaggacaaagaagtattatccttctaggcagcggctcaccctccctcttcaacctggaaaaggtgggaagccagttgtcctcaatccaaaggccagcctgtcagaatactgcgagaagggttctggatcattgacagtggtcttcaaagatttaggaacacaggtctactacagcacgctgttcttctttgagtacttgggtcctctcatcatctaccccatgttctattatttgcccgtctacaaatacttcgggtacgagggagaacggatcatccaccctgttcagacctacgccatgtactactggtgcttccactacttcaagaggatcatggagacattctttgtgcaccgtttcagccacgcaacatcacccctgtcaaatgtcttcagaaactgtgcctactactggaccttcggcgcttacattgcttactactgcaaccacccgctgtacaccccagtaagtgatctgcagatgaagattgggttcggtttcgggatcatctgccagattgcaaatttctactgccacatcctgctgaggaacctcagaagcccaagcggcagcggcggttaccagatccctcgtggcttcttgttcaacatcgtgacatgcgccaattacaccactgagatctaccagtgggtcgggttcaacattgctacgcagactgtggcaggttacatcttccttatcgttgcagcagctatcatgaccaactgggcgcttggcaagcacagccgtctgaagaagctttttgatggcaaggatggaaggcctaagtatcctcgccgctgggtgattctccctccattcctgtgaacaggtggtggctgttggtcggcccattgggattcaatgtctacagcatccccagcacacagaagttccaattcttgaatgtcatgcgaacaattgtactaatcacgcctttttaggggttgaacttcgactctgttgtccaaaatttctaatccgaaagatggattttattttattgccttggtatttgtttcacaacgttacgtggtcctgtcttaatatgatcgaaggttcatgtgatgttatcatctttctcgccccatttgtccaagcagaagtgaatgcagacataatttcgttgac

SEQ ID NO: 478 - DNA, 1237 bp, Echinochloa colona
ccacctcctctcctcttctcctcctcggcaagtcctcgccctgcctcgctgttactgccgctgctgccagcgcggggcgcgaggatgaaggtcgccgtcgtgtcccggagcggccgggaggtcgtcaagggcggcatcgacctcaaggactcggccaaggtcgcggatctgcaggaggccatccatgccaggactaagaagtattatccttctagacagcggctcacccttcctcttcaacctggaaaaagtggaaagccagttgtcctcagtccgaaggccagcctatcagaatactgtgagaaaggttctgggtcactgacagtagtcttcaaagatttaggccctcaagtctactacagcacgctgttcttctttgagtacttgggtccccttttcatctaccccatgttctattatctccctgtctacaaattctttgggtacgatggagaacgggtcatccaccctgtccagacctacgccatgtactactggtgcttccactacttcaagaggatcatggagaccttcttcgtccaccgtttcagccacgcaacatcgcctctgtcaaacgtcttcaggaactgcgcctactactggaccttcggcgcttacatcgcttactactgcaaccacccactctacaccccagtgagtgatctgcaaatgaagattgggtttggcttcgggatcatctgccagatcgcaaacttctactgccacatcctgctgaggaacctcagaagcccaagtggaagtggaggttaccagatcccccgtggtttcttgttcaacattgtgacctgtgccaactataccactgagatctaccagtgggttgggttcaacattgccacacagactgtggcaggctacatcttcctcgttgtggcagcaagcatcatgaccaactgggcgctaggcaagcacagccgcttgaagaagctgtttgatggcaaggacggcaggcccaggtatcctcgccgctgggtgattctccctccattcctgtgaagagggtatcctcggcgctgggtgattctattgcagctggcctatcgggattaaatgttgtgtgttccagcgttcagaagctccaaagtattgaataccatgcaaacatttgtactaattatgctattgtaccagttaaaactttgattccgaagtctgaaatttctaatccgaaagatggatgttaaattgttctttggtattctgtcacgatgtcatg

SEQ ID NO: 479 - DNA, 1396 bp, Zea mays
cgccccgccgcgggatcaaatacgccgcctccgcccgtccactccctcgccgcccccgtctcctctcctctcctctcctctcccccgcatccacggccgcaggcagcaggcagccactcgacgatctagtcgtctctctccccgctctgccgcctcgctgccgcggcttcccgtcggcgggaggatgaaggtcacggtcgtgtcccggagcggccgggaggtcgtcaagggcggcatcgacctcaaggactcggccaaggtcgcggacctgcaggaggccatccatgccaggactaagaagtattatccttctaggcagcggctcaccctcccccttcaacctggaaaaggcgggaagccagttgtcctcagtccgaaggccagcctgctagaatactgcgagaagggttctgggtcactgacagtggtcttcaaagatttagggccacaggtctactacagcacactgttcttcttcgagtacctgggtcctctcatcatctaccccatgttctactatctgcccgtctacaagtacttcgggcacgagggggagcgggccatgcaccctgtccagacctacgcaatgtactactggtgcttccactacttcaagcggatcatggagacgttcttcgtgcaccgcttcagccacgcgacgtcgccgctctcgaacgtcttcaggaactgtgcctactactggaccttcggcgcttacattgcttactactgcaaccacccgctgtacaccccagtgagtgatctgcagatgaagattgggtttggttttggggtcgtctgccaggtcgcgaacttctactgccacatcctgctgcggaacctcaggagcccaagcggcagcggcgggtaccagatcccccgcggtttcttgttcaacatcgtgacctgcgccaattacaccaccgagatctaccagtgggtcggcttcaacatcgccacacagaccgtggcaggttacgtcttccttgtcgtggcggcgggcatcatgaccaactgggcgctcggcaagcacagccgtctgaagaagctgtttgacggcaaggatgggaggcccaagtaccctcgccggtgggtgattctccctccgttcctgtgaagaggtggtggtggtggctcactgttggtggtcggcccattgtgattcgatgtctacagacagttgtactgtactaatcgtgcctgtttagcggttgaacttggattccgttgtccgaaatttctaatccgaaagatggatttcattgtcttcttcttcttcttagcattatgtcactgtctcacgtcgtcctgtctcaatacagtctaaggttcatgtgatgttatccccatttgtccacgcagaagtgaagtgaatgcagtcactatttcgattcga

SEQ ID NO: 480 - DNA, 1311 bp, Oryza sativa
acctcgtctccaccgcacgagcagcagcagcagcagcggcggccgcagcgcgagctctctctctctctctcgcggtgggcggcgggatgaaggtgtccgtcgtgtcccggagcggccgggaggtggtcaggggcggcgtcgagctcaaggactcggctaaggtcgcggatctgcaggatgccatctatgccaagactaagaagtattaccctgctaggcagcggctcaccctccctatccaacctggaaaatcaggaaagccagttgtccttagtgcaaaggccagcctatcagaatactgcgaaaagggttctggatccctgacagtggtctttaaggatttaggcccacaggtcttctacagcacgctgttcttctttgaatacttgggtcctcttcttatctaccccatgttctattacttgcctgtctacaaatatttcggatacgagggagagcgggtcatgcatcctgtccagacttacgccatgtactattggtgtttccactacttcaagaggatcatggagacgttctttgttcaccgcttcagccacgcgacttctcctgtatcaaatgtcttcaggaactgtgcctactactggacctttggagcttacattgcttactactgcaaccacccgctttacacccctgtgagtgaattgcagatgaagattgggtttggatttgggattctctgccaaattgcaaacttttattgccatatcctgctgaggaacctcagaagtccgagtggtaacggtggctatcagattcctcgtggcttcctgttcaacatagtgacatgcgcaaactataccactgagatctaccaatggcttgggttcaacattgccacacagactgtggcaggttacatcttccttgttgtggcagcgagtatcatgaccaactgggcacttggaaagcaccgccgtctaaagaagttgttcgatggcaaggaagggaggccgaagtatcctcggcgatgggtgattcttccaccattcctgtaaggagttggtgtcagcacgatggccacatgggattgaatctttggtctggtctcagtgttcggaagttgaagccttcagtgtaccacttctattctatgatctaaaatatctagtccacaatggaatccctcttagctattgttgaacttctctttgagtttgcattggccctgttgtaatggttaaatacaatacaagtttcatctgatatcagcttattgacttcttgtccatttgtccaagcagtagtaatgcgatcataatttcattttgacgcctggaattgctgtcc

SEQ ID NO: 481 - DNA, 1331 bp, Brachypodium distachyon
attggctgctcttcactaccttcgtcttctacctccaaccctttgcctgctgctgcgggaacaccaccagcagaggagcggagcgccgggaggggaagaagcatgaaggtctccgtcgtgtcccgcagcggccgcgaggtcgtcaggggcggcatcgacctccccgactcggccaaggtcgcggatctgcaggaggccatccacgccaagactaagaagtattatcctgctaggcagcggctcaccctccctctacaacctggaaaatctggaaaaccagttgtcctcagtccaaagtccagcctatctgaatactgtgagaagggttctggctccctgaaagtagtcttcaaagatttaggcccacaggtctattacagcacactgttcttctgggaatacgtgggtcctcttatcatctaccccatattctattatctgcccgtttataaatactttggatatgagggagagcgggtcattcatcctgtccagacctacgccatgtactacttttgcttccactacttcaagaggatcatggagacgttctttgtccaccgattcagccatgcgacttctcctgtgtcaaatgtctttaggaactgtgcctactactggacctttggagcttacattgcttactactgcaaccatccgctttacacccctgtgagtgatctgcagatgaagattgggtttgggtttgggatcgtgtgccaaatcgcaaacttctactgtcatatcctgctgaggaacctcaggagcccaactggcagtggtggttatcagatcccacggggtttcttgttcaacatagtgacctgtgcaaactacaccactgagatctaccaatggctggggttcaacattgccacgcagactgtggcaggttatgtcttcctcgctgttgcagcagctatcatgaccaactgggcgctcggaaagcacagccgtctgaggaagctgttcgatggaaaggacgggaggcccaagtatcctcgccgatgggtgattcttcctccattcctgtgaagaggtggtgcttggagctgagctggcctctgggggattccatatttattctgtttcagcagttggaagttaaaagtcgttcatttcacgacatttatactaattgtgccatctaccagttgtcaaccctcagtttgttatccgaaaggtctaatccaaaggatggatttatcctctattcttgaaacctttatctgggttaatttatgtcacggtgttatgcattggtactttttttggttgttaattttacatagaagtttcattagcctgtttgtttcacatatttctcaagc

SEQ ID NO: 482 - DNA, 1334 bp, Brachypodium distachyon
attggctgctcttcactaccttcgtcttctacctccaaccctttgcctgctgctgcgggaacaccaccagcagaggagcggagcgccgggaggggaagaagcatgaaggtctccgtcgtgtcccgcagcggccgcgaggtcgtcaggggcggcatcgacctccccgactcggccaaggtcgcggatctgcaggaggccatccacgccaagactaagaagtattatcctgctaggcagcggctcaccctccctctacaacctggaaaatctggaaaaccagttgtcctcagtccaaagtccagcctatctgaatactgtgagaagggttctggctccctgaaagtagtcttcaaagatttaggcccacaggtctattacagcacactgttcttctgggaatacgtgggtcctcttatcatctaccccatattctattatctgcccgtttataaatactttggatatgagggagagcgggtcattcatcctgtccagacctacgccatgtactacttttgcttccactacttcaagaggatcatggagacgttctttgtccaccgattcagccatgcgacttctcctgtgtcaaatgtctttaggaactgtgcctactactggacctttggagcttacattgcttactactgcaaccatccgctttacacccctgtgagtgatctgcagatgaagattgggtttgggtttgggatcgtgtgccaaatcgcaaacttctactgtcatatcctgctgaggaacctcaggagcccaactggcagtggtggttatcagatcccacggggtttcttgttcaacatagtgacctgtgcaaactacaccactgagatctaccaatggctggggttcaacattgccacgcagactgtggcaggttatgtcttcctcgctgttgcagcagctatcatgaccaactgggcgctcggaaagcacagccgtctgaggaagctgttcgatggaaaggacgggaggcccaagtatcctcgccgatgggtgattcttcctccattcctgtgaagaggtggtgcttggagctgagctggcctctgggggattccatatttattctgtttcagcagttggaagttaaaagtcgttcatttcacgacatttatactaattgtgccatctaccagttgtcaaccctcagtttgttatccgaaaggtctaatccaaaggatggatttatcctctattcttgaaacctttatctgggttaatttatgtcacggtgttatgcattggtactttttttggttgttaattttacatagaagtttcattagcctgtttgtttcacatatttctcaagcaga

SEQ ID NO: 483 - DNA, 1738 bp, Triticum aestivum
ggatcgatctcaaatacgcctcccctgcctgccccttctcccccacccagtgtcttcctcctctccacctccacaccaccacctctaccacaggttctcgcctcgcctcgctgctgccgaagccaccggcggagggagcatgaaggtctccgtcgtgtcccggagcggccgcgaggtcgtcaagggcggcatcgagctcaaggactcggccaaggtcgcggatctgcaggaggccatccacgccaagactaagaagtattatcctgctaggcaacggctcaccctccctgcacagcctggaaaatctggaaagccagttgtcctcaatcaaaaggccagcctatcggaatactgcgagaagggttccgggtccctgacagtggtcttcaaagatttaggcccgcaggtctactacagcacgctcttcttctgggaatacgtcggccctcttatcatctaccccatcttctattacctgcccgtctacaaatactttggatatgagggggagcgggtcatccaccccgtccagacgtacgccatgtactacttctgcttccactacttcaagaggatcatggagaccttcttcgtccaccgcttcagccacgcgacttcccccgtgtcaaacgtcttcaggaactgcgcctactactggacctttggagcctacattgcctactactgcaaccaccctctgtacacccctgtgagtgacctgcagatgaagatcgggttcggcatcggggtcgtgtgccagatcgcaaacttctactgccacatcctgctgaggaacctcaggagcccgaccggcagcggcggctaccagatccctcggggcttcctgttcaacatcgtgacgtgcgcaaactacactaccgagatctaccaatggctggggttcaacatcgccacgcagaccgtggcgggctacgtcttcctcgccgtggcggcggctatcatgaccaactgggcgctcgggaagcacagccgcctgcggaagctgttcgacgggaaggatgggcggcccaagtacccccgccgatgggtgattcttcccccattcctgtgaagaagacacagtgctcgcagggccggcatctggagattcaacatttattctgttccagcgtccgaaagttaaaagccatcagtcgatttcacgcatacattcctactaatggtgccttgtaccagccgtcaaacctcaattatgtagtccaaatgttcttatccgaaggatgtattttcttaccatattgttgaaaaactttctccggggtttatttacgccttgacgggacgtgtcttagtcaagtccaaccctaagatggttcatctgatatgtgtcggcccgtgttccgttcctctgagcagtagatgatgcaaccatacgccattctgatgctttatcatcattcattcccatgtcatctcatttgaagtttgacaatgttcatatgcttgcttgacattgctgtgcgtcctcatccacaaagtcgttggaagaggtcaattagaagaagatgacctgttggttgatttatgtatggttggtgatggcacggccactctgctctctcgaccagtcagcttccgtgtgacttgtcagcttatcttatcaccaccggtcaatgttttctctctcagaaataagtaaataaatactggtcacaaaaaaccaatgatattttttctatcttctgtatgtacatgcatgcatgtggacatgtaaata

SEQ ID NO: 484 - DNA, 1797 bp, Triticum aestivum
aggcgcctcctctctcctccatccctcctgcgcgcgtcggccacctccttccggcagagctcgacccccacccccaagcgtctctcctccaccctctcccaagcccctcgatcccagatccccgtctccaagtcaccctctccctccctcagatctcgatccgccgccgcccaccatcgacgaccctcaccatagacgagatcgagcttctccctccctcccgttctcccctagccttatccactccgagccaaccaaccactccggacctctcctcccccacccagccttcttcgtctccaccaccaccacaggttcgaggggagctcgcctcgccttgctgcctgaatccaccagcggagggagcatgaaggtctccgtcgtgtcccggagcggccgcgaggtcgtcaagggcggcatcgagctcaaggactcggccaaggtcgcggatctgcaggaggccatccacgccaagactaagaagtattatcctgccaggcaacggctcaccctccctgcacaacctggaaaatctggaaagccagttgtcctcagtcaaaaggccagcctatcggaatactgcgagaagggttccgggtccctgacagtagtcttcaaagatttaggcccgcaggtctactacagcacgctcttcttctgggaatacgtcggccctcttatcatctaccccatcttctattacctgcctgtctacaaatactttggatatgagggagagcgggtcatccaccctgtccagacctacgccatgtactacttctgcttccactacttcaagaggatcatggagaccttcttcgtccaccgcttcagccacgcgacatcccccgtgtcaaacgtcttcaggaactgcgcctactactggacctttggagcctacattgcctactactgcaaccaccctctgtacacccccgtgagtgacctgcagatgaagattgggttcggcatcggggtcgtgtgccagatcgcaaacttctactgccacatcctgctgaggaacctcaggagcccgaccggcagcggcggctaccagatcccacggggcttcctgttcaacattgtgacgtgcgcgaactacaccaccgagatctaccaatggctggggttcaacatcgccacgcagacggtggcgggctacgtcttccttgctgtggcagcggctatcatgaccaactgggcccttggcaagcacagccgtctgaggaagctgttcgacgggaaggacgggcggcccaagtaccctcgccgatgggtgattcttccaccattcctgtgaagaagacacggtgcctgcaacgccagcatctggagattcaacatttgttctgttccagcgtccgaaagttaaaagccatcagtccgatttcacacaaacatttcctactaatcgtgccttgtaccagctgtcaaacctcaattatgtagtccaaatgctcttatccgaaggatgtaatttcttatcctattgttgaaaaacttcctctggggtttatttacgccgcgacgagttgtcgctgtcaagtccaaccttaagatggttcatctgatgtgtcggcccgtgctccattcttcatgccattttgatgctttatcatcattcctgcccatgtcatcttacttgaagtttgacaatgttcatatgcttgcttgacattgctgtgtgtggtcggtcgtctacaaagtcattagaagaagatgtcaattagggcacgcacattacaagatgatctgttggttagtttatttatggttggtgatggcatggccactctg

SEQ ID NO: 485 - DNA, 1215 bp, Avena sativa
ggaacccaagccaagctcgctccgtctccacctcttcgtctgcgacagctgcggacagggagcgagccggcggagcggaggaagatgaaggtcgccgtggtgtcccggagcggccgcgaggtcgtcaagggcggcatccagctcaccgactcggccaaggtcgcggatctgcaggaggccatccacgccaagactaagaagtactatcctgctagacagcggctcaccctccctgtacaacctggaaaatctgggaagccagttgtcctgagtcaaaaggccagcctatcggactactgtgagaagggctctgattccctgacagtggtcttcaaagatttaggcccacagatctactacagcacgctcttcttctgggaatatgtgggccctcttttaatctaccccatgttctactacctcccggtctacaaatactttggatatgagggagagcgggtcatccaccctgtccagacctacgctatgtactacttctgcttccactacttcaagaggatcatggagacgttctttgtccaccgcttcagccacgcgacctctcctgtgtcaaacgtcttcagaaactgcgcctactactggacattcggagcctacattgcctactactgcaatcaccctctttacacccctgtgagtgacctgcagatgaaaatcggtttcgccatcgggatcgtgtgccagatcgcaaacttctactgccatatcctactgaggaacctcaggagcccgtccggcagcggcggctaccagatcccacgtggcttcctgtttaacatcgtgacatgtgcaaactacaccactgagatctaccaatggcttgggttcaacatcgccacgcagaccgtcgcgggctacgtcttcctcgctgtcgctgcgtctatcatgaccaactgggcgctcggaaagcacagccgtctgaggaagctgtttgacgggaaggatggaaggcccaagtaccctcgccggtgggtgattctccccccgttcctgtgaagaagtggcggtgcttccatgctgctgtcctctggggatccgatatttgttgtattctagcattgaaaagtcggtcgattttacgcaaacatttctactaatcgtgccctgtactgtaccggttgttaaacctatatggtccaattgttctaatccgaaggatggatttcctatctattattgaaaattttctgtggg

SEQ ID NO: 486 - DNA, 1250 bp, Avena sativa
gatgaaggtctccgtcgtgtcccggagcggccgcgaggtcgtcaagggcggcatccagctcagcgactcggccaaggtcgcggatctgcaggaggccatccacgccaagactaagaagtattatcccgctaggcagcggctgaccctccctgtacaacctgggaaatctggaaagccagttgtcctcaatcaaaaggccagcctatcggactactgcgagaagggctcggggtccctgactgtggtcttcaaagatttaggcccgcaggtctactacagcacgctcttcttctgggagtatgtgggccctcttttcatctaccccatgttctactacctccctgtctacaaatactttggatacgagggagagcgggtcgtccaccctgtccagacctatgccatgtactacttctgcttccactacttcaagcggatcatggagaccttcttcatccaccgcttcagccacgcgacatcccccgtgtcgaacgtcttcaggaactgcgcctactactggaccttcggagcctacattgcctactactgcaaccacccgctgtacacccccgtgagcgacctgcagatgaagatcgggttcggcattggggtcgtgtgccagattgcaaacttctactgccacatcctgctgaggaacctccggagcccgaccggcagcggcggctaccagatcccacggggcttcctgttcaacatcgtgacgtgcgcgaactacacgaccgagatctaccagtggctgggcttcaacatcgccacgcagaccgtggcgggctacgtcttcctcgccgtcgcggcggccatcatgaccaactgggcgctcgggaagcacagccgtctcaggaagctgttcgacgggaaggacgggcggcccaagtaccctcgccggtgggtgatcctacccccattcctgtgaagaggcggtgcttgcgggccggcctctggggatctactactagtatttattctgttccggcattcaaaatccaaagtcagtccattttacgcaaacatttctactgatcaagtgaatgtaccagttgttaaacctcaggtctatggttccgaacgttctaatccgaaggatgggtttcttatctattgttgaaaacttttatttgggtttatttatgtcgcatttgttatccattggtcctgttatataccatggttatccagctgaagattcatctgatatctccccgggttttcctacctagtctaagacagaa

SEQ ID NO: 487 - DNA, 1200 bp, Avena sativa
ctccgtctcgaccacacgacagctcaggacagcgggtcgccggcgggccaaggaggaggaggagatgaaggtctccgtcgtgtcccggagcggccgcgaggtcgtcaagggcggaatccagctcgacgactcggccaaggtcgcggatctgcaggaggccatccacgccaagactaagaagtattatcctgctaggcagcggctcaccctccctgtacaacctgggaaatctggaaagccagttgtcctcaatcaaaaggccagcctatcggactactgcgagaagggctccgggtccctgacagtggtcttcaaagatttaggcccgcaggtctactacagcacactcttcttctgggagtatgtgggccctcttttcatctaccccatgttctactacctccctgtctacaaatactttgggtacgagggagagcgggtcgtccaccctgtccagacctacgccatgtactacttctgcttccactacttcaagaggatcatggagaccttcttcatccaccgcttcagccacgcgacatcccccgtgtcaaacgtcttcaggaactgcgcctactactggaccttcggagcctacatcgcctactactgcaaccacccactgtacacccctgtgagtgatctgcagatgaaaatcggtttcggcatcggggtcgtgtgccagatcgcaaacttctactgccacatcctgctgcggaacctcaggagcccgactggcagcggcggctaccagatcccacggggcttcctgttcaacatcgtgacgtgcgcgaactacaccaccgagatctaccagtggctgggcttcaacatcgccacgcagaccgtggcgggctacgtcttcctcgccgtcgcggcggctatcatgaccaactgggcgctcgggaagcacagccgtctcaggaagctgttcgacgggaaggacgggcggcccaagtaccctcgccggtgggtgatcctacccccattcctgtgaagaggcggtgcttgcgggccggcctctggggatctactactagtatttattctgttccggcattcaaaattcaaagtcagtccattttacgcaaacatttctactgatcaagtgaatgtaccagttgctaaacctcaggtctatggttccgaaccttctaatccgaaggatgggtttcttatctattgttgaaaacttttatt

SEQ ID NO: 488 - DNA, 1451 bp, Lolium multiflorum
ctcaaataagccagcccacctccttctgtacctcactccgtctccacctcgtcgtccgcgaccacaccacacacagatacacagctgacgccggcggaagaacaaagatgaaggtctccgtcgtctcccggagcggccgcgaggtcgtcaagggcggaatccagctcagcgacgacgccaaggtcgcggatctgcaggacgccatccacgccaagactaagaagtattatcccgctaggcaacggctcaccctccctgtacaacctggaaaatctggaaagccagttgtactcaaccaaaaggccagcctatcggattactgtgagaagggttccgggtccctcaccgtggtcttcaaagatttaggcccgcaggtctactacagcacactgttcttctgggaatatgtgggccctcttttcatctaccccatcttctactacctccccgtgtataagtactttggatatgagggagagcgggtcatccatcctgtccagacctacgccatgtactacttctgcttccactacttcaagcggatcatggagacgttctttgtccaccgcttcagccacgcaacttctccggtgtcaaatgtcttccggaactgcgcctactactggaccttcggggcctacattgcttactactgcaaccaccctctttacactcctgtgagtgatctacaaatgaagattgggtttggcattgggatcgtgtgccagatcgcaaacttctactgccatatcctgctgaggaacctccgcagcccgaccggcagcggtggttatcagatcccacgtggtttcttgttcaacatcgtgacatgtgcgaactacactacggagatctaccagtggctgggcttcaacatcgccacgcagaccgtggccggttacgtcttcctcgccgtcgctgcggccatcatgaccaactgggcgctcgggaagcacagccgtctcaggaagctgttcgacgggaaggatggacggcccaagtatcctcgccggtgggtgattctccccccgttcctgtgaagaactggtgcttgcaggcatttctggggatccattatttgttcagttccagacgtcgattctacgcatacatttctactaattatgtatcgtactagttgttaaacctgtggtccaaatgttctgatccgaaggatggattgcgtatctattattgaagaaattatttggatttatctatgtcagtgttatacagctgcccacttgtcatggttagtttgaccaaaactattcatctgatatcagcgtgtattccatctgtcccaagttaaaaaagaataatgccaccagaatgtgctgctgcttatctttcatgcatatgttatcttgtttgaaggttgacatgttcatgctgtacattgttgtatgcatccttccacaactcaaattggtgtactgaacatacatcct

SEQ ID NO: 489 - DNA, 1271 bp, Avena sativa
agctcgggacagcgggtcgccggcgagccaaggaggaggaggagatgaaggtctccgtcgtgtcccggagcggccgcgaggtcgtcaagggcggaatccagctcgacgactcggccaaggtcgcggatctgcaggaggccatccatgccaagactaagaagtattatcccgctaggcagcggctcaccctccctgtacaacctgggaaatctggaaagccagttgtcctcaatcaaaaggccagcctatcggactactgcgagaagggctcggggtccctgactgtggtcttcaaagatttaggcccgcaggtctactacagcacgctcttcttctgggagtatgtgggccctcttttcatctaccccatgttctactacctccctgtctacaaatactttggatacgagggagagcgggtcgtccaccctgtccagacctatgccatgtactacttctgcttccactacttcaagcggatcatggagaccttcttcatccaccgcttcagccacgcgacatcccccgtgtcgaacgtcttcaggaactgcgcctactactggaccttcggagcctacattgcctactactgcaaccacccgctgtacacccccgtgagcgacctgcagatgaagatcgggttcggcattggggtcgtgtgccagattgcaaacttctactgccacatcctgctgaggaacctccggagcccgaccggcagcggcggctaccagatcccacggggcttcctgttcaacatcgtgacgtgcgcgaactacacgaccgagatctaccagtggctgggcttcaacatcgccacgcagaccgtggcgggctacgtcttcctcgccgtcgcggcggccatcatgaccaactgggcgctcgggaagcacagccgtctcaggaagctgttcgacgggaaggacgggcggcccaagtaccctcgccggtgggtgatcctacccccattcctgtgaagaggcggtgcttgcgggccggcctctggggatctactactagtatttattctgttccggcattcaaaatccaaagtcagtccattttacgcaaacatttctactgatcaagtgaatgtaccagttgttaaacctcaggtctatggttccgaacgttctaatccgaaggatgggtttcttatctattgttgaaaacttttatttgggtttatttatgtcgcatttgttatccattggtcctgttatataccatggttatccagctgaagattcatctgatatctccccgggttt

SEQ ID NO: 490 - DNA, 1225 bp, Avena sativa
gaacccaagccaagctcgctccgtctccacctcttcgtctgcgacagctgcggacagggagcgagccggcggagcggaggaagatgaaggtcgccgtggtgtcccggagcggccgcgaggtcgtcaagggcggcatccagctccacgactcggccaaggtcgcggatctgcagcaggccatccacgccaagactaagaagtattatcctgctaggcagcggctcaccctccctgcacaacctgggaaatctggaaagccagttgtcctcaatcaaaaggccagcctatcagactactgcgagaagggctccgggtccctgacagtggtcttcaaagatttaggcccgcaggtctactacagcacgctcttcttctgggagtatgtgggccctcttttcatctaccccatattctactacctcccagtctacaaatactttggatacgagggagagcgggtcgtccaccctgtccagacctacgccatgtactacttctgcttccactacttcaagcggatcatggagaccttcttcgtccaccgcttcagccacgcgacatcccccgtctccaacgtcttcagaaactgcgcctactactggacatttggagcctacatcgcctactactgcaaccacccgctgtacacccccgtgagcgacctgcagatgaagatcgggttcggcattggggtcgtgtgccagatcgcaaacttctactgccacatcctgctgcggaacctccggagcccgacaggcagcggtggctaccagatcccacggggcttcctgttcaacatcgtgacgtgcgccaactacacgaccgagatctaccagtggctgggcttcaacatcgccacgcagaccgtggcgggctacgtcttcctcgccgtcgcggcggccatcatgaccaactgggcgctcgggaagcacagccgcctcaggaagctgtttgacgggaaggacgggcggcccaagtaccctcgccggtgggtgattcttcccccgttcctgtgaagaagtgtccgtgtgcttccatgctggcctctggggatcggaacgtttgttctattctaagcattcaagagtcaaaaatgtgtcccatatttacgcacatgtttctactaattgtgccttgtacgagttgttaaacctcaggtctatggttcccaacgttctaatccgaaggatgggtttcttatctattgttgattgggttcgtttat

SEQ ID NO: 491 - DNA, 1192 bp, Avena sativa
aagccaagctcgctccgtctccacctcttcgtctgcgacagctgcggacagggagcgagccggcggagcggagcggagggaggaagatgaaggtctccgtcgtgtcccggagcggccgcgaggtcgtcaagggcggcatccagctcgccgactcggccaaggtcacggatctgcaggaggccatccacgccaagactaagaagtactatcctgctagacagcggctcaccctccctgtacaacctggaaaatctgggaagccagttgttctgagtcaaaaggccagcctatcggactactgtgagaagggctctgattccctgacagtggtcttcaaagatttaggcccacaggtctactacagcacgctcttcttctgggaatatgtgggccctcttttcatttaccccatgttctactacctccctgtctacaaatactttggatacgagggagagcgggtcgtccaccctgtccagacctacgccatgtactacttctgcttccactacttcaagaggatcatggagacgttctttgtccaccgcttcagccacgcgacctctcctgtctcgaacgtcttcaggaactgcgcctactactggacattcggagcctacattgcctactactgcaaccaccctctttacacccctgtgagtgacctgcagatgaaaatcggttttggcatcgggatcgtgtgccagatcgcaaacttctactgccatatcctgctgaggaacctccggagcccgtctggcagcggcggctaccagatcccacggggcttcctgttcaacatcgtgacatgtgcaaactacaccactgagatctaccaatggcttgggttcaacatcgccacgcagaccgttgcgggctacgtcttcctcgctgtcgctgcggctatcatgaccaactgggcgctcggaaagcacagccggctaaggaagctgtttgacgggaaggatggaaagcccaagtaccctcgccggtgggtgattctccccccgttcctgtgaagaagtggcggtgcttccatgctgctggcctatggagatccgatatttgttgtattctagcattgaaaagtcggtcgattttacgcaaacatttctactaatcgtgccctgtactgtaccggttgttaaacctatatggtccaattgttctaatccgaaggatggatttccta

SEQ ID NO: 492 - DNA, 1213 bp, Festuca arundinacea
tacctcactccgtcgtctccacctctttcttggtccgcgaccacaccacggacagagcagagcacgccggcggaacaaggaagatgaaggtctccgtcgtctcccggaccggccgcgagctcgtcaagggcggaatccagctcagcgacgaggccaaggtcgcggatctgcaggaggccatccacgccaacactaagaagtattatcccgctaggcaacggctcaccctccctgtacaacctggaaaatctggaaagccagttgtactcaaccaaaaggccagcctatcggactactgtgagaagggttccgggtccctcaccgtggtcttcaaagatttaggcccgcaggtctactacagcacactgttcttctgggaatatgtgggccctcttttcatctaccccatcttctactacctccccgtgtataagtactttggatatgagggagagcgggtcatccatcctgtccagacctacgccatgtactacttctgcttccactacttcaagcggatcatggagacgttctttgtccaccgcttcagccacgcaacttctccggtgtcaaatgttttccggaactgcgcgtactactggaccttcggggcctacattgcttactactgcaaccaccctctttacactcctgtgagtgatctacaaatgaagattgggtttggcattgggatcgtgtgccagatcgcaaacttctactgccatatcctgctgaggaacctccgcagcccgaccggcagcggtggttatcagatcccacgtggtttcttgttcaacatcgtgacatgtgcgaactacactaccgagatctaccagtggctgggcttcaacatcgccacgcagaccgtggccggttacgtcttcctcgccgtcgctgcggccatcatgaccaactgggcgctcgggaagcacagccgtctcaggaagctgttcgacgggaaggatggacggcccaagtatcctcgccggtgggtgattctccccccgttcctgtgaagaactggtgcttgcaggcatttctggggatccattatttgttcagttccagacgtcgattctacgcacacatttctactaattatgtatcgtactagttgttaaacctctggtccaaatgttctgatccgaaggatggattgcgtatctattattgaagaaattatttggatttatctatgtcagtgttatacagc

SEQ ID NO: 493 - DNA, 1199 bp, Avena sativa
ggaacccaagccaagctcgctccgtctccacctcttcgtctgcgacagctgcggacagggagcgagccggcggagcggagcggagggaggaagatgaaggtctccgtcgtgtcccggagcggccgcgaggtcgtcaagggcggcatccagctcgccgactcggccaaggtcacggatctgcaggaggccatccacgccaagactaagaagtactatcctgctagacagcggctcaccctccctgtacaacctggaaaatctgggaagccagttgttctgagtcaaaaggccagcctatcggactactgtgagaagggctctgattccctgacagtggtcttcaaagatttaggcccacaggtctactacagcacgctcttcttctgggaatatgtgggccctcttttcatttaccccatgttctactacctccctgtctacaaatactttggatacgagggagagcgggtcgtccaccctgtccagacctacgccatgtactacttctgcttccactacttcaagaggatcatggagacgttctttgtccaccgcttcagccacgcgacctctcctgtctcgaacgtcttcaggaactgcgcctactactggacattcggagcctacattgcctactactgcaaccaccctctttacacccctgtgagtgacctgcagatgaaaatcggttttggcatcgggatcgtgtgccagatcgcaaacttctactgccatatcctgctgaggaacctccggagcccgtctggcagcggcggctaccagatcccacggggcttcctgttcaacatcgtgacatgtgcaaactacaccactgagatctaccaatggcttgggttcaacatcgccacgcagaccgttgcgggctacgtcttcctcgctgtcgctgcggctatcatgaccaactgggcgctcggaaagcacagccggctaaggaagctgtttgacgggaaggatggaaagcccaagtaccctcgccggtgggtgattctccccccgttcctgtgaagaagtggcggtgcttccatgctgctggcctatggagatccgatatttgttgtattctagcattgaaaagtcggtcgattttacgcaaacatttctactaatcgtgccctgtactgtaccggttgttaaacctatatggtccaattgttctaatccgaaggatggatttccta

SEQ ID NO: 494 - DNA, 1168 bp, Pseudoroegneria spicata
gaggtcgtcaagggcggcatcgagctcaaggactcggccaaggtcgcggatctgcaggaggccatccacgccaagactaagaagtattatcctgctaggcaacggctcaccctccctgcacagcctggaaaatctggaaagccagttgtcctcaatcaaaaggccagcctatcggaatactgcgagaagggttctgggtccctgacagtagtcttcaaagatttaggcccgcaggtctactacagcacgctcttcttctgggaatatgtcggcccccttatcatctaccccatcttctattacctgcctgtctacaaatactttggatatgagggggagcgggtcatccaccctgtccagacctacgccatgtactacttctgcttccactacttcaagaggatcatggagacgttcttcctccaccgcttcagccacgcgacttcccccgtgtcaaacgtcttcaggaactgcgcctactactggacctttggagcttacattgcctactactgcaaccaccctctgtacacccctgtgagtgacctgcagatgaagattgggtttggcatcggggtcgtgtgccagatcgcaaacttctactgccacatcctgctgaggaacctcaggagcccgaccggcagcggtggctaccagatcccacggggtttcctgttcaacattgtgacgtgcgcaaactacaccaccgagatctaccaatggcttgggttcaacatcgccacgcagaccgtggctggttacgtcttcctcgctgtggcggcggctatcatgaccaactgggcgctcggcaagcacagccgcctgaggaagctgttcgacgggaaggacgggcggcccaagtacccccgccgatgggtgattcttcctccattcctgtgaagaagacacggtgcctgcagggcctgcatatggcgattcaacatttattctgttccagcgttcgaaagttaaaagccgtcagtccgatttcacgcaaacattcctactaatcgttccttgtaccagccgtcaaacctcaattatgtagtccaaatgttcttatccgaaggatgtatttttttatcatgttgctgaaagtttatttacgccgcgccgcgacgtgttgtcatggtcaagtccaaccgtaagatgatttatcagatatgtg

SEQ ID NO: 495 - DNA, 1850 bp, Panicum virgatum
tgttcacttcttgaaatatcatattttagctgcatctgtgataagaattttaagaggcatcctataatcacattcataggcaccgtcttcttcagttgtacactctgcagactagtaataagtagatctgcatgttagcctatttacttccataatattatactgcggtggtcagcacaagcatttattgttcatgagtcaatgagtcatgactcttgttggaccactaaagcaggtttgctggaatgctgccatgtagttgggcgaggctagagtatatcatcatgtatggttaagcagtgcagtttaagtgcatcaaatgctaccaacatggattgttgagctgcaatatgtcaacttgcagtagtgtggtgctctgccctcaatttagacctgaagcatagggctaatttacttccagattttgttcgaatttgttggaacgatggacactttccaaattggcatgcggattttgcaccttgtgtacatattctaaagtagcttcataatgctctaccaaaggtatataaaccagaataggtgactgggatttgagaaactggtatcttccaagtgggtctagtaatcattgcaagattgctaaaatctggttactgcaaagctaggtgtagtgattttattggattcaaactaatgctattttaaattcaagcttgtgccactaattggtagaacaatattagagtttgcatctagtaaaatgttttgtgtcaatctggttggatgaaactgtgtctgggtccgttgggtgaaaatatctaatcaagtattagtctcattttattttctcccggtacatatttgataattctccttctgatgtgctgcttttctctttatgatgtatgacttgctaactgcttatctctgcataatgcagctaagaagtattatccttctaggcagcggctcaccctccctcttcaacctggaaaaagtgggaagccagttgttctcagtccgaaggccagcctgtcagaatactgtgagaagggttctgggtcactgacagtagtcttcaaagatttgggcccgcaagtctactacagcacactgttcttctttgagtacttgggtcctcttatcatctaccccatgttctattatctgcctgtctataaattcttcgggtatgaaggagaacgggtcatccaccctgtccagacctatgccatgtactactggtgcttccactacttcaagaggatcatggagacattcttcgtgcaccgtttcagccacgctacatcacctttgtcaaacgtcttcaggaactgcgcctactactggaccttcggtgcctacatcgcttactactgcaaccacccgctctacaccccagtgagtgatctgcagatgaagattgggtttggctttggaatcatctgccagatcgcaaacttctactgccacatcctgctgaggaacctcagaagcccgagcggcaatggtggttaccagatcccccgtggtttcttgttcaacattgtgacctgcgccaactataccactgagatctaccagtgggtcgggttcaacattgccacacagactgtggcaggctacatcttccttgtcgtggcagcaagcatcatgaccaactgggcgcttggcaagcacagccgcttgaagaagctgtttgatggcaaggacgggaggcccaagtatcctcgacgctgggtgattcttcctccattcctgtgaagaggtggtgattgcgtcccagccttcaggagttccaagtcatgatatcattcaaacatttgtactaatagtgccttagtaccagttgaaccttgatcgccaagtctgaaatttctaatctg

SEQ ID NO: 496 - DNA, 1467 bp, Ricinus communis
gttagctcccctactcccaactacacgcctttaatatatccgcctatctataactatctatattggcccaaacccatctctgccttcttctatttcatgtgctgtttttcactttgaatctatttgagatctccttcaatttcccacttcaagctctggttctagtccaatcttgagtacgatcctttgtagtctaaagggtttcttttgtttgccatttggtgtattgggtctctctcatttcatcattaggatgaaggttactgtagtttcacgcagtggtagagaggtcatcaaaggaggcctcgacctcaatgattcggctacagtggctgatctgcaggaggcaattcataaacgaaccaaaaaattctacccttcaagacagcggctgacccttcctcttccaccgggatcaaaggacaggccaactgttctgaactacaagaagagtcttaaggattactgtgatgggaattcagataatataacagtagttttcaaggatctgggtccacaagtatcctaccgcacactttttttcttcgagtacttgggtcctttgatcctctatcctgtcttttacttcttccctgtgtacaagtactttggatacaaggaggaacgtgtcatccacccagttcagacatatgctatgtactactggtgcttccattacttcaaacgtatcatggaaacattttttgtgcaccgatttagccatgcaacatcaccgctctccaatgttttccgaaattgtgcttattattggacctttggttcctatattgcttactatgtgaaccacccactttacactcctgttggtgatcttcaaatgaagattggttttggttttggtttgatttgtcaaattgccaacttctattgtcacatcttgctgaaaaatcttcgcagccctgatggcagtggaggttatcaaatcccacatgggtttctcttcaatattgtgacatgcgcaaactacacaacagaaatttaccagtggttgggtttcaatattgcaacgcagactgttgcaggctatatctttcttgtggttgccgcttcgatcatgaccaattgggcccttgcaaagcaccgccgactgaggaagctatttgacggaaaggatggaagaccaaaatatccacgccgatgggttatattgcccccattcctgtagaactgaattgatactctgccactcttttgctgatttggtattgagtcttggcagtatgatgaatcccagattttggttcgttcttctcagatatgaagtggaggtcacacttatgtaatcgcttggagaacctagtctttccatttagatagtaaattattggaaatagaggataatcttgtccaaacataatcttattttaaactttctccagtatgttaaattatttggcaagttatctgaatttgttggtttagctaatctgatgagttatgactttc

SEQ ID NO: 497 - DNA, 1444 bp, Allium cepa
tagttacgggggacgtggtaaagaaaacatgcgaacgaagtccaaaattgaaccaattcgaccaaaggaggaggatcccctttcattttctttccctgtagaagaaagtccagcaatgacaatgacagaataacgccatacgtggactgggctaataagaagaaaagttagctctcctactcccaaccacaactcttaactccctcacctgtccataaccatatgccattaattccattcttaatttctcagatccctctgtcaaatccactctcttaaatacacaacccgccttcactgccctttctcacactgcttcttcgattgtagcaagcatgaaggtcatcgttgtctctcgaagcggtagggaagttgttaagggcggcatcgagctcgatgattcggctactgttagtgatttgcaggaggccattcatgctaaaaccaaaaagtactatccttcaagacaaagactaacccttccccttcaatccggaacccaaggaaaacccgtggtactaagtcccaaaaaatctctcaaagattactgcgatggaaactccaacacattaaccgtagttttcaaggacttgggcattcaagtttactacagcacactattcttcttcgaatacctcggccctctattcatataccccatgttctactacctccctgtgtacaaatatttcgggtacaaagaagatcgagtcatccatccagttcaaacttatgccatgtactattggtgctttcactacttcaaacgaatcatggagacgtttttcgttcataggttcagccatgcaacttctcctctctctaatgtgtttagaaattgtgcctattattggagttttggtgcatatattgcatactatgtgaaccatccttattatacacctgttagtgacttgcaaatgaagataggttttggattcggaatcgtatgtcaaatttcgaacttttattgccatctcattttgagaaatcttagaagcccagatggaaatggagggtatcaaattcctcgtggatttttgtttaatattgtgacatgtgcgaactatactacggagatttaccaatggcttgggttcaatattgctacacagactgtagctggttatgtgttccttgtggttgctgcttctattatgactaattgggcttttgccaagcatcgcagattgaggaagctattcgacggaaaagaaggaagacccaaatatccaagacgttttgtgatactgcctccttttgtttaaagaaattagtctctattaatgtatttatccatttccagaattatatatctatcaagtaaacaaaaaagctggccgaaagtgcagtaatatatttgcaaaattgtttaatgtcatactttgcttgttttgtagttcaagttcaaatgaacatgtgtgttttagttatgttcgaattt

SEQ ID NO: 498 - DNA, 1559 bp, Ricinus communis
tggcaatttaaggaaggtatgtgcggtgcggttcatcagaattcaatctaagagcagtatagttagctcccctactcccaactacacgcctttaatatatccgcctatctataactatctatattggcccaaacccatctctgccttcttctatttcatgtgctgtttttcactttgaatctatttgagatctccttcaatttcccacttcaagctctggttctagtccaatcttgagtacgatcctttgtagtctaaagggtttcttttgtttgccatttggtgtattgggtctctctcatttcatcattaggatgaaggttactgtagtttcacgcagtggtagagaggtcatcaaaggaggcctcgacctcaatgattcggctacagtggctgatctgcaggaggcaattcataaacgaaccaaaaaattctacccttcaagacagcggctgacccttcctcttccaccgggatcaaaggacaggccaactgttctgaactacaagaagagtcttaaggattactgtgatgggaattcagataatataacagtagttttcaaggatctgggtccacaagtatcctaccgcacactttttttcttcgagtacttgggtcctttgatcctctatcctgtcttttacttcttccctgtgtacaagtactttggatacaaggaggaacgtgtcatccacccagttcagacatatgctatgtactactggtgcttccattacttcaaacgtatcatggaaacattttttgtgcaccgatttagccatgcaacatcaccgctctccaatgttttccgaaattgtgcttattattggacctttggttcctatattgcttactatgtgaaccacccactttacactcctgttggtgatcttcaaatgaagattggttttggttttggtttgatttgtcaaattgccaacttctattgtcacatcttgctgaaaaatcttcgcagccctgatggcagtggaggttatcaaatcccacatgggtttctcttcaatattgtgacatgcgcaaactacacaacagaaatttaccagtggttgggtttcaatattgcaacgcagactgttgcaggctatatctttcttgtggttgccgcttcgatcatgaccaattgggcccttgcaaagcaccgccgactgaggaagctatttgacggaaaggatggaagaccaaaatatccacgccgatgggttatattgcccccattcctgtagaactgaattgatactctgccactcttttgctgatttggtattgagtcttggcagtatgatgaatcccagattttggttcgttcttctcagatatgaagtggaggtcacacttatgtaatcgcttggagaacctagtctttccatttagatagtaaattattggaaatagaggataatcttgtccaaacataatcttattttaaactttctccagtatgttaaattatttggcaagttatctgaatttgttggtttagctaatctgatgagttatgactttctgatgatcattagtatctcattcttcatttc

SEQ ID NO: 499 - DNA, 1205 bp, Allium cepa
ggggactgcttcttcgattgtagcaagcatgaaggtcatcgttgtctctcgaagcggtagggaagttgttaagggcggcatcgagctcgatgattcggctactgttagtgatttgcaggaggccattcatgctaaaaccaaaaagtactatccttcaagacaaagactaacccttccccttcaatccggaacccaaggaaaacccgtggtactaagtcccaaaaaatctctcaaagattactgcgatggaaactccaacacattaaccgtagttttcaaggacttgggcattcaagtttactacagcacactattcttcttcgaatacctcggccctctattcatataccccatgttctactacctccctgtgtacaaatatttcgggtacaaagaagatcgagtcatccatccagttcaaacttatgccatgtactattggtgctttcactacttcaaacgaatcatggagacgtttttcgttcataggttcagccatgcaacttctcctctctctaatgtgtttagaaattgtgcctattattggagttttggtgcatatattgcatactatgtgaaccatccttattatacacctgttagtgacttgcaaatgaagataggttttggattcggaatcgtatgtcaaatttcgaacttttattgccatctcattttgagaaatcttagaagcccagatggaaatggagggtatcaaattcctcgtggatttttgtttaatattgtgacatgtgcgaactatactacggagatttaccaatggcttgggttcaatattgctacacagactgtagctggttatgtgttccttgtggttgctgcttctattatgactaattgggcttttgccaagcatcgcagattgaggaagctattcgacggaaaagaaggaagacccaaatatccaagacgttttgtgatactgcctccttttgtttaaagaaattagtctctattaatgtatttatccatttccagaattatatatctatcaagtaaacaaaaaagctggccgaaagtgcagtaatatatttgcaaaattgtttaatgtcatactttgcttgttttgtagttcaagttcaaatgaacatgtgtgttttagttatgttcgaatttctttcaatagggtgtaccgttcttttctttttccatgttagcatggtttcaataatatgttaacattg

SEQ ID NO: 500 - DNA, 1700 bp, Panicum virgatum
ccatgtggttgggtgatactagagtatggggctgcttggttcccagccacaactcaccacgccactgtagcgcggcgggtctggtgctcagaatcggcgccacagccctgtggcgtggcttcccgtggctgggaaccaaacacaccctatatcatcatgtatggttaagcggtgcagtttaaatgcatcgaatgctactaacatggattcttgagctgcaatatggcaacttgcagtattgtggtgctctgccctcaatttagacctgaagcataggctaatttacttccagattttggtcgaatttgttgcaacaacgaacactttccaaattggcatgcgaattttgcaccttgtgtattctaaagtagcttcatgatgctctaccaaaggtatataaaccagaataggtgactgagatgtgagaaattgatataagtggtctagtaatcattgcaagattgctaaaatctggttactgcaaagctaagtgtagtggttttattggattcaaactaatgctattttaacttcaagcttgtgcgactaattggtagaacaatattagagtttgcttctagtaaaacgttttgtgtcaatctggttggatgaaactgtgtctgggttgagtgaaaatatttaatcatgtattagtttcattttactttctcctggaacatgtttctccttgtgatgtgctgcttttctctttatgatgtatgacttgctaactgcttttctctgcataatgcagctaagaagtattatccttctaggcagcggctcaccctacctcttcaacctggaaaaagtgggaaaccagttgttctcagtccgaaggccagcctgtcagaatactgtgagaagggttctgggtcactgacagtagtcttcaaagatttaggcccacaagtctactacagcacactgttcttctttgagtacttgggtcctcttatcatctaccccatgttctattatctgcctgtctataaattcttcgggtatgaaggagaacgggttatccaccctgtccagacctatgccatgtactactggtgcttccactacttcaagaggatcatggagacgttcttcgtgcaccgtttcagccacgctacatcacctttgtcaaacgtcttcaggaactgcgcctactactggaccttcggcgcttacatcgcttactactgcaaccacccgctctacaccccagtgagtgatctgcagatgaagattgggtttggctttggaatcatctgccagatcgcaaacttctactgccacatcctgctgaggaacctcagaagcccaagcggcaatggtggttaccagatcccccgtggtttcttgttcaacattgtgacctgcgccaactataccactgagatctaccagtgggtcgggttcaacattgccacacagactgtggcaggctacatcttccttgtcgtggcagcaagcatcatgaccaactgggcgcttggcaagcacagccgcttgaagaagctgtttgatggcaaggacgggaggcccaagtatcctcgccgctgggtgattcttcctccattcctgtgaagaggtggtgattgcgtcccagccttcaggagttccaagtcatgatatcattcaaacatttgtactaatcgtgccttagtaccagttgaaccttgatcgccaagtctgaaatttctaatctg

SEQ ID NO: 501 - DNA, 1498 bp, Allium cepa
gcctagttacgggggaattcgactaaaggaggaggatcccctttcattttctttccctgtagaagaaagtccagcaatgacaatgacagaataacgccatacgtggactgggctaataagaagaaaagttagctctcctactcccaaccacaactcttaactccctcacctgtccataaccatatgccattaattccattcttaatttctcagatccctctgtcaaatccactctcttaaatacacaacccgccttcacttccctttctcacactgcttgttctattgtaccaagtatgaaggtcatcgttgtctctcgaagtggtaaggaagttgttaagggcggcatcgagcttgatgattcggccacagttagtgatttgcagcaggccattcatgctaaaaccaaaaagtactatccttcaagacaaagattaacccttccccttcaacctggaacccaaggaaaacccgtggtactaagtccgaaaaaatctctcaaagattactgcgatggaaattccaatacattgaccgtagttttcaaagacctgggcattcaagtttactatagcacgctgttcttctttgaatacctcggccctctattcatataccccatgttctactacctccccgtgtacaaatattttgggtacaaggaagatcgagtcatccatccagttcaaacttatgccatgtactattggtgctttcactacttcaaacgaatcatggagacgtttttcgttcataggttcagccatgcaacttctcctctctctaatgtgtttagaaattgtgcctattattggagttttggtgcatatattgcatactatgtgaaccatccttattatacacctgttagtgacttgcaaatgaagataggttttggattcggaatcgtatgtcaaatttcgaacttttattgccatctcattttgagaaatcttagaagcccagatggaaatggagggtatcaaattcctcgtggatttttgtttaatattgtgacatgtgcaaactatactacggagatttaccaatggcttgggttcaatattgctacacagactgtagctggttatgtgttccttgtggttgctgcttctattatgactaattgggcttttgccaagcatcgcagattgaggaagctattcgacggaaaagaaggaagacccaaatatccaagacgttttgtgatactgcctccttttgtttaaagaaattagtctctattaatgtatttatccatttccagaattatatatctatcaagtaaacaaaaaagctggccgaaagtgcagtaatatatttgcaaaattgtttaatgtcatactttgcttgttttgtagttcaagttcaaatgaacatgtgtgttttagttatgttcgaatttctttcaatagggtgtaccgttcttttctttttccatgttagcatggtttcaataatatgttaacattgccattatggtgccatgaatgctgaa

SEQ ID NO: 502 - DNA, 1495 bp, Ananas comosus
ctcttccgatctaaatagagaaaaaatcatttgggtttgtggattcgtaagagatgaaggtgacggtggtttctcgcagcggtaaagagattatcaagggcgggatcgagctcaatgatgccgccactgtagcggaactgcaagaggcaatttattcacgaaccaaaaagtactatccttcaagacagcggcttaccctcccggtccaacccggaacctctacaaaacccgtagtccttaatccaaaggcaaacttatctgagtactgcgaaaagaactcgaccaatcttactgtggtattcaaagatttgggcccacaggtctcatacagaactcttttcttctttgagtacttgggcccgctagtcatctaccctatattttactacttcccagtgtacaaatacttcggatatgggaccgaacggaccatccaccccgtccagacctacgccctgtactactggtgtttccactacgccaaaagaatattggagacattttttgtgcacagattcagccacgcaacttcaccgttatcgaatgtctttagaaactgtgcctattattggacttttggggcttatatcgcttattatgttaaccaccctctgtacactcccgtaagtgatttacagatgaagatcggatttgcctttgggttgatttgccaattatgcaacttctattgccatattatattgaggaaccttagaagccccagtggcaatggcggataccaaattcctcgcggatttttgttcaatatagtgacatgtgcgaattatacaacagagatttatcagtggctagggtttaacattgctacacaaacggcagcagggtatgttttccttgttgtggcggcacttattatgaccaactgggccctcgcaaagcaccgccggctgaaaaagttatttgatgggaaagatgggcgaccaaagtatcctcggcgttgggttattcttcccccattcctctaagaagcttggcttatctgcattggcttctctacgtagctcgatccattctgctgtagctgtaaccgtttctgctcgtttgctaaacacttcaaacttaatgtgttccagccaattagatttgcttctcaagtgtaactttcagttgtatggaactttagagttacttatttctgtcaacaaacttctcatttttatttggatttctaagcttgatggtggagaaatcttgttgagtacgtattgcgcttgatttctaagcgtgatttctaagcttgattgtgtgatttcatctctttatgttccctgcttcatagcctgaagcatcaggatatatataattgcaggaaccataattagatgcccagccaaggtttgtgctgcatcatgctgttaggacaaggtgaaggtgtaacagacacctggtttacgacgcattttgatttggctacctatattttttacaagtttgatcttattagctgatctttttagttcacatgatgtggcct

SEQ ID NO: 503 - DNA, 1507 bp, Castanea mollissima
tggttcatcagcctatgcagttagctctcctaccccaactacacgccattactatgtctcccaaaccaccccttaattactctgcaaaaaaaaatattaatactttcatagcctgccatacccatccttgggatctcatacgagtttcccatttcctcaattgggtcacagctcctggatcttcaataaaaccactcacaaaccaaaagggtttgtcttttgcaccatttcgtgaattgggtcactctcttttggtctcaaaaaatgaaggtcagtgtagtttctcggagtggtaaagatgttgtcaagggtggccttgagctcagtgattccgctacggttgcagatctgcaggaggcaattcatcaacgaactaaaaagttctatccttcaagacagcggttaaccctcccccttaaaccgggatcaaaggaaaagcctgttgttcttaactacaagaaaagtctcaaggattattgtgatggaaaccacttgactgtagtgttcaaggacttgggcacacaagtttcctatcgtacacttttcttctttgaatacttgggtcctttgctcctttatcccatcttttattacttccctgtctaccagttctttggctacaaaggggagcgagtcatccacccagttcagacatatgctttatattactggtgtttccactacttcaaacgaattatggaaacattttttgtgcatcggttcagccatgcaacctcaccactctccaatgtgtttcgtaattgtgcatattattggacctttggctcttacattgcttactatgtgaaccacccactttacacccctgttagtgacctccaaatgaagatcggctttgggtttggagtgctttgtcaaatctgtaacttctattgccatatcttgctgaggaatctgcgcagccctgatgggaatggaggatatcaaattccacgtggttttctattcaatattgtgacgtgtgcaaactacacaacagagatttatcaatggttgggtttcaatattgccacacagactgtcgcaggctatattttccttttggttgctactattattatgaccaattgggccctcgcaaagcaccgtcggctgaagaagctatttgatgggaaggatggaagaccgaagtatccacgcagatgggtaatacttcccccattcctgtaagcatggctcttatcttgtatcttgttgctctctttggtaccaagaatcggattcaacagcaagaattcaagatggttggagcttaataggtgtcagatatgaacttgacatttttatagacagcttactcccacttgaactacctgaggataatcatcttttattcttttcttagtgttttgtttttccccccaatttatgtctcctctcatttgtcatgttatttgggaagaaatacagctaatgttggtgatttagcttcttatcagattggcttcttgactattttttataattcattgggcttttttttttt

SEQ ID NO: 504 - DNA, 1385 bp, Castanea mollissima
agctctcctaccccaactacacgccattactatgtctcccaaaccaccccttaattactctgcaaaaaaaaaatcttaatactttcatagcctgccatacccatccttgggatctcatacgagtttcccatttcctcaattgggtcacagctcctggatcttcaataaaaccactcacaaaccaaaagggtttgtcttttgcaccatttcgtgaattgggtcactctcttttggtctcaaaaaatgaaggtcagtgtagtttctcggagtggtaaagatgttgtcaagggtggccttgagctcagtgattccgctacggttgcagatctgcaggaggcaattcatcaacgaactaaaaagttctatccttcaagacagcggttaaccctcccccttaaaccgggatcaaaggaaaagcctgttgttcttaactacaagaaaagtctcaaggattattgtgatggaaaccacttgactgtagtgttcaaggacttgggcacacaagtttcctatcgtacacttttcttctttgaatacttgggtcctttgctcctttatcccatcttttattacttccctgtctaccagttctttggctacaaaggggagcgagtcatccacccagttcagacatatgctttatattactggtgtttccactacttcaaacgaattatggaaacattttttgtgcatcggttcagccatgcaacctcaccactctccaatgtgtttcgtaattgtgcatattattggacctttggctcttacattgcttactatgtgaaccacccactttacacccctgttagtgacctccaaatgaagatcggctttgggtttggagtgctttgtcaaatctgtaacttctattgccatatcttgctgaggaatctgcgcagccctgatgggaatggaggatatcaaattccacgtggttttctattcaatattgtgacgtgtgcaaactacacaacagagatttatcaatggttgggtttcaatattgccacacagactgttgcaggctatattttccttttggttgctactatcattatgaccaattgggccctcgcaaagcaccgtcggctgaagaagctatttgatgggaaggatggaagaccgaagtatccacgcagatgggtaatacttcccccattcctgtaagcatggctcttatcttgtatcttgttgctctctttggtaccaagaatcggattcaacagcaagaattcaagatggttggagcttaataggtgtcagatatgaacttgacatttttatagacagcttactcccacttgaactacctgaggataatcatgttttattcttttcttagtgttttgtttttcccccaatttatgtctcctctcatttgt

SEQ ID NO: 505 - DNA, 1587 bp, Citrus clementina
gagggaaggatttgtcagcgtggttcatcggttcgctttggttagctctcctacccccaaccacacgcctttattatgcatctacatctacttggccacccagttctatcatcgaactcgtttccactttccagatctcattaaatttcccatttcagctttcaggcttatcgtcttctctaccaatcctgctgatacttaaagggtttgtttgtttgtctatttgctgaagcgggtatcttccgaagaaagtaaaaacaaaatgaaggtgactgtaatttcacgcagcggtcgagaagttatcaaaggagggcttgaacttaatgattcagccacagtggctgatctgcaggaggcaattcataagcgaaccaaaaaaatttacccttcaaggcagaggctaaccctcccactccctcctggatccaagcagagagctactgtcctcgattacaagaagagtctcaaagaatactctgatggaaactcgggcaacttgactgtaatgttcaaggacctgggtccacaagtttcctatcgtacacttttcttctttgagtacttgggtcctttgattctctatcccattttttactacttccctgtctatcaattctttggctataaaggggagcgtgtcattcacccagttcagacatatgctttatactactggtgtttccactacttcaaacgaattatggaaacattttttgtgcaccgcttcagtcatgcaacgtcgccaatttcgaatgtgtttaggaactgtgcttattattggtcctttggttcttatattgcctactatgtgaaccacccacgatataccccagttagtgacctccaaatgaagattggctttgcttttggaataatttgtcagatcgcaaacttttattgccatatattgctgaagaatcttcgtagcgctgatggaagtggagggtatcaaatccctcgggggtttctgttcaatattgtgacctgtgctaattacactacagaaatttatcagtggctgggattcaatattgcgacacagactgttgcaggctacatctttcttgtggttgctgcacttattatgaccaattgggccctcgcaaagcatcgtcgtttgaagaagctatttgatggaaaagacggaaggcccaagtatccacggcgatgggtaatactgcccccattcctgtagaagtgaatggcgagcctgccgctcattggttaagttttggattcaacttcttgtattgaagactatcagtcctttctcttcagatatgaactagagctcccatgttaacctagtttcattattggtgtttagacagtttagacgttgtaattcatttgagcagtgcgagcatattttcttttatctaaatcaaattacttagcaaagtgttcagacttttcttagcttcattgcatgttcgtggctaatctttgatacgccgttgcttctttctttctttctttctttgtttgcaagtaatgtgtaatctagcagccttttggcacaatgaagtcctcaatttgcaactttggcaaggttgcaccaacaatgaatatatatttgtgccactg

SEQ ID NO: 506 - DNA, 1507 bp, Quercus alba
attgtggttcatcagccaatacagttagctctcctaccccaactacacgccattactatatctcccaaacccaccccttaattactctgcaaaaaaattaatactaccctacccatctctgggatctcatacgagtttcccatttcctcaattgggtcacagctcttggatcttcaataaaaccacccacaaattaaaagggttcgtcgtttacaccatttcgtgaattgggtcactctcttttggtctcaaaaaatgaaggtcagtgtagtttctcggagtggtaaagatgttgtcaagggtggccttgagctcagtgattccgctacggttgcagatctgcaggaggcaattcatcaacgaaccaaaaagttctatccttcaagacagcggttaaccctcccccttaaaccgggatcaaaggaaaagcctgttgttcttaactacaagaaaagtctcaaggattattgtgatggaaaccacttgactgtagtgttcaaggacctgggcacacaagtttcctatcgcacacttttcttctttgaatacttgggtcctttgctcctttatcccatcttttattacttccctgtctaccagttctttggctacaaaggggagcgagtcatccacccagttcagacatatgctttatattactggtgtttccactacttcaaacgaattatggaaacattttttgtgcatcggttcagccatgcaacctcaccactctccaatgtgtttcgtaattgtgcctattattggacctttggctcttacattgcttactatgtgaaccacccactttacacccctgttagtgacctccaaatgaagatcggctttgggtttggagtgctttgtcaaatctgtaacttctattgccatatcttgctgaggaatctgcgcagccctgatgggaatggaggatatcaaattccacgtggttttctattcaatattgtgacatgtgcaaactacacaacagagatttatcaatggttgggtttcaatattgccacacagactgtcgcaggctatgttttccttgtggttgctacacttattatgaccaattgggccctcgcaaagcaccgtcgtctgaagaagctatttgatgggaaggatggaagaccgaagtatccacgcagatgggtaatatttcccccattcctgtaagcatggctctcatcttgcatcttgttgctctctttggtaccaaaaatcagattcaacagcaagaattcaagatggttggagcttaataggtgtcagatatgaacttgacatttttatagacagcttactcccacttgaactacctgaggataatcatcttttattcttttctgatctgggtctgcaaattcaagccacaaagtgaagtgggtctctctctccctctcactctctttgctttgctttgtttggctctttatggggggtttgggtgggcttaaatgttggtttggtcatttttcaggtagagatcttctacagtgct

SEQ ID NO: 507 - DNA, 1326 bp, Persea americana
ggcctcttgccttctgttctctctctatctctctatctttttatctctgattagattcattccatcttctgcttctcctggttcagactagaaatttgtgctcttttctgagtttggggtgttgggttcttctcatttttgaagatgaaggtcttagtggtttcaaggagtgggagagaagtcgttaagggaggactggatctcaaggcttcggctaaagtgagagatctgcaagaggcaattcatcaccgaaccaaaaagtactatccttccagacagcgcctcacactccctctgcaacctggatctcgagcgaagccagtcgttcttgatcccaaaaagaaccttggagaatactgtgatggaaatgcggacaacttaactgttgtgtttaaggatttgggcatgcaagtctcttatagtacacttttcttctttgagtacttgggtcctttaatcatctaccctatcttctactactacgatgtatatcagtactttggctacaagggtggtcgtgtcattcacccagttcagacctatgccatgtactactggtgcttccattacttcaagcgtatcatggagacattttttgttcacagattcagtcatgcgacttcacccctctctaatgtattcaggaactgtttttactactggagttttggcatgtacattgcttattacgtgaaccaccctctctatactcctgtgggtgatcttcaaatgaagattggtttcagctttgggttggtttgtcagtttgcaaacttttattgccatctcctgttgaggaaccttagaagcccggatggcaatggaggatatcaaattccacgtggatttctattcaatatagtgacttgtgcgaactacactacagagatctatcaatgggctggtttcaatattgcaacacagaccgttgcaggttatgcgttcgtggtggtggcagcttatatcatgactaactgggccattgccaaacaccatcgtttgaagaagttatttgatgggaaagatggaagaccaaagtacccacggcgatgggtgatacttcctccattcttctaagaagtcacaccaacttagcgctggtttctgtgttccctatttgtctcgagattcttatatttgaacttcactacataatggtagaatcttcatgtttctgtttgcattttgctgctgttgtttgcattttctttgatcaagttccagatgtttaagcaaatacaagatatctatagactacccattagctgtaaagtgcttagctgttcaaggcttccatggattaagttctcaatgatatcatctgat

SEQ ID NO: 508 - DNA, 1445 bp, Vaccinium corymbosum
cccgcagtgctctacactgactgggtttcaattatctcactcatccgcagaaaatgaaagtgagcgtagttacacgtagtggtagagaactcgtcaagggtggccttgatctcaatgattccgctactgttgctgatctgcaagaagcaattcatcgtcggaccaaaaaatattatccatctaggcagcgcctgactctccccctccaacctggatctaaggaaaagcctaatgtacttcactataggaaaagtctcaaggaatactatatcgaaaactcagacaaattgactgtggtgttcaaggatctaggtccacaagtttcctaccagacgcttttcttctttgaatatttgggtccgctgttgatctatccaattttctactacttccctgtgtatcaatacttcggctacgaaggagagcgtgtcattcacccagttcagacatatgccttgtactactggtgtttccactacttcaaacgtatcatggagacattctttgttcatcgcttcagccatgcaacctcaccactgtctaatgtgttccggaattgtgcttattactggacatttggtgcttacattgcttactacatgaatcacccattttacacccctgttggtgaccttcaaatgaaaattggttttgcttttggagtgctttgccaaatctcaaacttctattgccacatcttgctgaggaatcttcgtagacctgatggaaatggtggctaccaaatcccacgtgggtttttgttcaatattgtcacatgcgcaaattatacaacggaaatttatcagtggctgggattcaatattgcaacacagacgattgcaggttatgtctttcttgtagttgccgctctgatcatgactaactgggcacttgctaagcaccgccgtctgaagaagctatttgatggaaaggagggaagacccaaatatcctcgacgatgggtcatactgcccccattcctgtaggaaggattagcaaattagctactcagtccatttgttggaaaaggaaaaaatggaaataagtagaaaaacaacgttgtagcaagatgtttggagtttttagttgccgttcttagcaaaatgtgctaataagggatgagatacctttcctccttgatatcacagtcttcttttggagtctagtccagtttgaagtatttctgttctttccttgttccattctatcaaattgtccgtagaacacttcttgttgctgtcagtcgtcatgctcgtcatcggattggatgcctcttagaccatctttgctaattttatgtgttgtacttttgttggatgtaattgctttggattattatttgaagtattgcaaatttgcagctctcgtgaacttccgatattttgagccatttctgatgaaggatcattgattttatagacattacttcctagtcgtgatttgac

SEQ ID NO: 509 - DNA, 1534 bp, Cucumis sativus
actttctcttcactaatccatggcaatttttttcttccattaagaatttgggttcacgttcatcccaataaatttattcagttggctgtcgcctccagcatcgcagatcaaacgatgtgtccaattgcaattaggagatgattagcgacacggttcatcagtcatccgaattagctctcctaccccaactgcacaccatttaatagcctacttcccaacctcccacttcaaacccagaaaccttttcctattttaaattcacacccatttgcggatctcatcatatatccattttttgggttctgggtcttctcattttgctcttttcaggatctgggtacaaatttttggcttttttctccaactggttctctaatttggctgcagaaatgaaggtctcggtagtttctcgcagtgggagagaggttgttaaagggggtattcaactgagcgactctgcttcggtggcagatctgcaggatgcgattcataagcgaaccaaaaagttctatccagctaggcaaaggctaactcttcccgttcaacctggttcaaaggagagacctactgttcttaactccaagaaaagcctcagagaatattgtagcgacaactcggacagcataaccgttgtcttcaaggatttgggcccacaagtttcttatcgtacactctttttctttgaatacttgggtccactgattctctaccccatcttttactacttccctgtatatcagttctttggctacaaagcagaacgtgttatccatcctgttcagacttacgcaatgtactactggtgttttcattatttcaaaagaatcatggaaacgtttttcgtccataggttcagccacgcaacctcaccactttcgaatgtgttcagaaattgtgcttactactggtcttttggctcgtacattgcttattatgtcaatcacccactttatacccctgttggcgatcttcagatgaagattggctttgcatttggtttgctgtgtcaagtgtcaaacttctactgccatatcttgctgagaaaattgcgtagccctgaaggcaatggtggatatcaaatccctaaggggtttctgttcaacattgtgacatgtgcgaattacacaacagaaatatatcagtgggtaggcttcaatatagctacacagacttttgctggttatgtctttcttgtggttgctgctcttatcatgactaactgggcacttgcaaagcaccgtcgcctcaagaagctgtttgatgggaaagagggaaggccaaagtatccacgcagatgggtgattcttcctccatttctgtagaagcatttggtggcctcagcaaccaattcaatctcaagatggtaggctttagattaaaagtgtcacttgaaagaaagacagagacaaggcacagacatcacttttaccaaatgcaattttaatgttcttttgttgttgtctttaacattatagacaatgttccttttgttttgctttggcgttttagtgcattgttggtgattgatggttgc

SEQ ID NO: 510 - DNA, 1667 bp, Cucumis melo
ctcactaatccatggctaaattttttctttaattaagaatttaggttcacgttcaacccaataaatttattcagttggctgtcgcctccagcatcacactgatcaaacgatgtgtcgaattgcaattaggagatgattagcgacacggttcatcagtcatcggaattagctctcctaccccaactgctcaccatttaatagcctacttcccaacctcccacttcaaacccagaaactttttccaattttaaattcacacccatttgcggatctcatcatatattcattttttgggttctgggtcttctcattttgctctttttaggatctgggtaccaatttttggcttttttccccaactggttctctaatttggctgcagaaatgaaggtctcggtagtttctcgcagtgggagagaggttgttaaagggggtattcaactgagcgactctgcttcggtggcagatctacaggatgcgattcataagcgaaccaaaaagttctatccagctaggcaaaggctaactcttcccgttcaacctggttccaaggagaggcctactgttcttaactccaagaaaagcctcagagaatattgtagcgacaactcggacagcataactgttgtcttcaaggatttgggcccacaagtttcttatcgtaccctctttttctttgaatacttgggtccattgatcctctaccccatcttttactacttccctgtatatcagttctttggctaccaagcagaacgtgttatccatcctgttcagacttacgcaatgtactactggtgttttcactatttcaaaagaatcatggaaacatttttcgtccataggttcagccacgcaacctcaccactttcaaatgtgttcagaaactgtgcttactactggtcttttggctcgtatattgcatattatgtcaatcacccactttatacccctgttggtgaccttcaaatgaagattggctttgcatttggtttgctgtgtcaagtgtcaaacttctactgccatatcttgctgagaaaattgcgtagccctgagggcaatgggggatatcaaatccctaaggggtttctgttcaacattgtgacatgtgcaaattacacaacagaaatatatcagtgggtaggcttcaatatagctacacagacttttgctggttatgtctttcttgtggttgctgctcttatcatgactaactgggcacttgcaaagcaccgtcgcctcaagaagctgtttgatgggaaagagggaaggccaaagtatccacgcagatgggtgattcttcctccatttctgtaggagttggtggcctcagcaaccaattcaatttcaagttgttaggctttagattaaaagtgtcacttgaaagaaagacagagacaaggcacagacatcatttttaccaaatgcaattttaatgttcttttgttgttgtctttaacattatagacaatgttccttttgttttgctttggcgttttagtgcattgttggcgattgatggttgcatatttttttcctacttctttacaactctcccttcctgttagttagtttgaggacattctttcaatttgttttttgtattgacttatcttagttaaggtgcctttaaatttattgttttaatagaattttggcactacaat

SEQ ID NO: 511 - DNA, 1293 bp, Elaeis guineensis
gtcgtcctgtcgtcctgagccaccactctgccccctacctctctctctctcttctcttcggtccgccgagtggatttggcttcgaaacctccggcgcgatgaaggtgaccgttgtctctcgcagcggcagagaaatcataaagggcgggatcgagcttaaggattcggccaccgtgagcgatctacaggatgccatttatgctcgaaccaaaaaatactatccttctagacagcggcttaccctacctatgccacccagaacccaggggaaacctgttgtccttaatccaaagaagaggcttactgagtattgtgatggagatgcaagcagtttgactgtggtattcaaggatttaggcatgcaggtctcgtacagcactcttttcttctgggagtatttgggccctttaattatctacccgatcttttactacttcccggtgtataagtattttggttatgagggtgaacgagtcactcatccacatcagacctatgccttgtattattggtgctttcactacttcaagcgtatcatggagacgttctttgttcacagattcagccatgcaacttcaccactctccaatgtattcaggaactgtgcctattattggacttttggctcatacgttgcatactatgttaaccatccactctatacacctgttggtgatttacaaatgaagattggttttggccttgggttgatctgccaagttttgaacttttattgccatctcctcttgagaaaccttaggagcgctgatggcagtggcggttatcaaattcctcgtgggtttttgttcaacatagtgacttgtgcaaattacacaacagagatctatcaatggcttggtttcaatattgctacgcagactgtagcaggttatgtcttcctggtggttgctgctctcataatgactaactgggcccttgcaaagcaccgcaggctgaagaagatatttgatgggaaagaggggcgacctaaatatcctcggcgatgggtgatacttcctccatttctctaagaagtagcagtcctcttggtttgtttctctgctctgaagatcccatctatccaagtggaatcctgtcactggaatttagaagattgtctactgtgaacagctgaaactgtgttgaacaaccaagcagttaaatgatcatgattgcttgtggagtgcataatctcaagttcagtttattgtttaacttattttgtcctaggtaccttcttttttgttgtgttgttgtattattatattatatatatatatactatatacgtac

SEQ ID NO: 512 - DNA, 1513 bp, Gossypium hirsutum
tgccccattccataaactgtcaccaccttcgcttactttcctttcaaagttctaatctttgagatctccgaagatccaaagatctaactctcccaaaccttaaaaagcttcaaagggtttctccctttagccataacaaaaactgggtctcatttgttttgatctcaaaaaggatgaaggtcactctagtttctcggagtgggagagagttcatcaaaggtggccttgagcttaatgactcggctactgtggctgatctgcaggaagcaattcacaagagaactaaaaagttctatccttcaagacaaagactaacacttcccgtgccatcgggatcaagggagaggcctgtcgtccttaactacaagaagagtctcaaagactactgcgatggaaatgagaacagcttaaccatagtgttcaaggacttgggtccacaagtgtcgtatcgaacacttttcttcttcgaatacttgggtcctttgatcctctaccctgtcttctactacttccctgtatacaagtactttggatacgaagaaaagcgtgtcatccaccctgttcaaacatatgctttatattactggtgtttccactacttcaaacgaatcatggaaacattcttcatccaccgtttcagccatgcaacgtccccactatcaaacgttttcagaaactgtgcttattactggaccttcggttcatacattgcttactacgtcaaccacccactttacacacctgttagtgatcttcagatgaagattgggttcgggtttggtatagtttgtcaacttgcaaacttctattgtcatattatactgaagaatctacgcagtcctgatggtagtggagggtatcaaattcctcgtgggtttctgttcaacattgtgacttgcgcgaactacacaacagagatttaccaatggttgggtttcaatatcgctacacagactgttgctggctacgtattccttgtggttgctacctctatcatgacaaattgggcccttgcaaagcaccgtcggttgaagaagctattcgacggtaaagatggaaggccgaagtacccccgaagatgggttattcttcctccattcctgtagaaaggatcgatgagcatcgtacttttcgagatattaaatttacgacgttgaaacatggtttccgagttcattgaaagatcaattcttgttagattatggaattttagtatgtgggcatgcattaggatgcttttttgcttatgtaaaatcattgccggtttaaactattgctgttggttattatttcaattgatggattttcattttcttattttaaatcttgctgttcgggttcggttcaatttgattcagtcattttcgagtcgagcaaattaagtcattaaacgagttgagtacgctcggttcaaataaatcgtgctacttgtattgaaaattctaaatttgaattccagttctttatttaaaaatgttaagtaaaatattaaattttaatagtattagtgtga

SEQ ID NO: 513 - DNA, 1221 bp, Gossypium hirsutum
aaaagcttcaaagggtttctccctttagccataacaaaaactgggtctcatttgttttgatctcaaaaaggatgaaggtcactctagtttctcggagtgggagagagttcatcaaaggtggccttgagcttaatgactcggctactgtggctgatctgcaggaagcaattcacaagagaactaaaaagttctatccttcaagacaaagactaacacttcccgtgccatcgggatcaagggagaggcctgtcgtccttaactacaagaagagtctcaaagactactgcgatggaaatgagaacagcttaaccatagtgttcaaggacttgggtccacaagtgtcgtatcgaacacttttcttcttcgaatacttgggtcctttgatcctctaccctgtcttctactacttccctgtatacaagtactttggatacgaagaaaagcgtgtcatccaccctgttcaaacatatgctttatattactggtgtttccactacttcaaacgaatcatggaaacattcttcatccaccgtttcagccatgcaacatccccactatcaaacgttttcagaaactgtgcttattactggaccttcggttcatacattgcttactacgtcaaccacccactttacacacctgttagtgatcttcagatgaagatcgggttcgggtttggtatagtttgtcaacttgcaaacttctattgtcatattatactgaagaatctacgcagtcctgacggtagtggagggtatcaaattcctcgtgggtttctgttcaacattgtgacttgcgcgaactacacaacagagatttaccaatggttgggtttcaatatcgctacacagaccgttgctggctatgtattccttgtggttgctacctctatcatgacgaattgggcccttgcaaagcatcgtcgactgaagaagctatttgacggtaaagatggaaggccgaagtacccccgaagatgggttattcttcctccattcctgtagaacggatcgatgagcatcgtacttttcgagatatgaactttacgacgttgaaacatggtctccaagttcatcgaaagatcaattcttgttatagtatggaattttagttggtggtgaaccaatataatttacttgacatgcgcattaggatgctttcttgcttatgtaaactcattgctggtttaaactattggtgttggttattgtttcaattgat

SEQ ID NO: 514 - DNA, 1424 bp, Gossypium raimondii
atcacatgccccgttccataaactgtcaccaccttcgcttactttcctttcaaagttctaatctttgagatctccgaagatccaaagatctaactctcccaaaccttaaaaagcttcaaagggtttctccctttagccataacaaaaactgggtctcatttgttttgatctcaaaaaggatgaaggtcactctagtttctcggagtgggagagagttcatcaaaggtggccttgagcttaatgactcggctactgtggctgatctgcaggaagcaattcacaagagaactaaaaagttctatccttcaagacaaagactaacacttcccgtgccatcgggatcaagggagaggcctgtcgtccttaactacaagaagagtctcaaagactactgcgatggaaatgagaacagcttaaccatagtgttcaaggacttgggtccacaagtgtcgtatcgaacacttttcttcttcgaatacttgggtcctttgatcctctaccccgtcttctactacttccctgtatacaagtactttggatacgaagaaaagcgtgtcatccaccccgttcaaacatatgctttatattactggtgtttccactacttcaaacgaatcatggaaacattcttcatccaccgtttcagccatgcaacgtccccactatcaaacgttttcagaaactgtgcttattactggaccttcggttcatacattgcttactacgtcaaccacccactttacacacctgttagtgatcttcagatgaagatcgggttcgggtttggtatagtttgtcaacttgcaaacttctattgtcatattatactgaagaatctacgcagtcctgatggtagtggagggtatcaaattcctcgtgggtttctgttcaacattgtgacttgcgcgaactacacaacagagatttaccaatggttgggtttcaatatcgctacacagaccgttgctggctatgtattccttgtggttgctacctctatcatgacgaattgggcccttgcaaagcatcgtcgactgaagaagctattcgacggtaaagatggaaggccgaagtacccccgaagatgggttattcttcctccattcctgtagaacggatcgatgagcatcgtacttttcgagatatgaactttacgacgttgaaacatggtttccgagttcattgaaagatcaattcttgttagagtatggaattttagttggtggtgaaccaatataatttacttgacatgcgcattaggatgcttttttgcttatgtaaactcattgctggtttaaactattggtgttggttattgtttcaattaatggtttttttatgttcttattttgaatcttgcagttggggtttggttgaattcgattcagtcattttcgagtcgagcaaactaagtcattaccaat

SEQ ID NO: 515 - DNA, 1289 bp, Platanus occidentalis
agtggagcataacaattttgtgaggtgggttttacagcaactttggtgctttccgtcttttctgttctgatctgaaaattttatcgactctgttggtgtggagatcgaaggatcgtttatagaataaagggtcgtcgtgtttctccatttggggaagtgggtctttcccttttggtctaatctcatcaccgaagatgaaggtgaccgttgtttcccggagcggtagagaaatcatcaagggtggtattgagctcaatggttcggctactgtgcgtgatctgcaggaggccattcatcgtcgaccaaaaaatactatccttctagacaacgtctcacccttcccctccaacctggatcaaaggagaaacctgttgttctcaaccccaagaaaaatattcaagattattgtgatggaaatgcagatcacatgaccttggtgttcaaggacctgggcccacaggtttcatacaggacccttttcttctgggagtatgtggggcctctgatcatttaccccatcttctactacttccccgtgtaccagtactttggctacgaaggagaacgcatcatccacccagctcagacttatgcaatgtactactggtgctttcactacttcaaacgtattatggaaacattctttgtccataggttcagccatgcaacttcacccctctccaatgtgttcagaaactgtgcttactactggacatttggcgcctacattgcttactatgtgaaccacccgctctatacccctgtaagtgacctccagatgaaggttgggtttgggtttggattgatctgtcaagttgcaaacttctattgtcatctcttgctaaagaacctacggagccctgatgggagtggagggtaccaaattccccggggctttttgttcaatatagtgacttgcgctaattacactacggagatctatcagtgggtaggcttcaatatcgcaacacagacagttgcgggctattcgttccttgttgtagctgctttcatcatgactaattgggccctagcaaagcaccgtcgtttgaagaagttatttgatgggaaggagggaaggctgaggtatccacggcgatgggtaatattgcctccattcctgtgaaagattgcgagcaagcctgccttttgggtggcctctttgctacgtggttccaaattcaacagcgtgatttcaagattgctgaagcttagatcttgttagattaatgcttagaagagacaaaagtttcaccttcctttcatttgcatgtgttctttccttctat

SEQ ID NO: 516 - DNA, 1139 bp, Brassica oleracea
actctgaatcttcttatctgggtcttcctcgttttctccgcttttaagccatgaaagtcaccgtcgtctcccgcagcggcagagaagttctcaaagcccccctcgacctccccgattcggcgactgttgctgatctgcaggaagcttttcacaagagagctaagaagttttacccatcgaggcaaagactgactcttcctgtctctcctgggtcaaaggacaaacctgttgtcctcaacagcaagaagtcactcaaagagtactgcgatggcaacactgactccttaaccgtagtcttcaaggacttgggagcacaagtctcataccgcacgctcttcttcttcgagtatctaggcccgctcctaatctacccggtcttctactacttccctgtttacaaatacctcggctacggcgaagaccgtgtgatccacccggtccagacctacgccatgtactactggtgctttcactacttcaaacgtatcatggaaacgttcttcgtccataggttcagccacgcgacttcaccgatagggaacgtgttcaggaactgtgcttactactggacctttggtgcttacattgcgtattacgtgaaccaccctttgtacacgccggtgagtgaccttcagatgaagatcggtttcgggtttggtttggtctgccaagtcgcaaacttttactgtcacattctgttgaagaatctgagagaccctagtggctctggagggtatcagatcccacgtggcttcctcttcaacattgttacgtgtgccaattacacgactgagatttaccagtggctagggttcaacatcgctactcagaccgttgcgggatacgttttcttggctgttgctgctctgattatgactaactgggctcttggaaagcacagccgtctgagaaagatatttgatgggaaagatgggaagccaaagtatccaagaagatgggtgatattgcctccattcctgtagaagactcatcgttgtgatcctcgtttttatcagtttaaaactctcttaataaggttgtaaaagagatttgcaagatgtgtggtttcctctgtattggttgttccttttgttttgagatgttttgtaagtttagagattttagaaacatgcttcttt

SEQ ID NO: 517 - DNA, 1134 bp, Brassica juncea
ggaatcttcttatctgggtcttcctcgttttctccgcttttaagccatgaaagtcaccgtcgtctcccgcagcggcagagaagttctcaaagcccccctcgacctccccgattcggcgactgttgctgatctgcaggaagcttttcacaagagagctaagaagttttacccatcgaggcaaagactgactcttcctgtctctcctgggtcaaaggacaaacctgttgtcctcaacagcaagaagtcactcaaagagtactgcgatggcaacactgactccttaaccgtagtcttcaaggacttgggagcacaagtctcataccgcacgctcttcttcttcgagtatctcggcccgctcctaatctacccggtcttctactacttccctgtttacaaatacctcggctacggccaagaccgtgtgatccacccggtccagacctacgccatgtactactggtgctttcactacttcaaacgtatcatggaaacgttcttcgtccataggttcagtcacgcgacgtcgccgatagggaacgtgttcaggaactgtgcttactactggacctttggtgcttacattgcttactacgtcaaccatcctttgtacacaccggttagtgaccttcagatgaagattggtttcgggtttggtttggtctgccaagtcgcaaacttttactgtcacattctgttgaagaatcttagagaccctagtggctctggagggtaccagatcccacgtggcttcctcttcaacattgttacgtgtgctaattacacgacagagatttaccagtggctaggattcaacatcgctactcagaccgttgcgggatatgttttcttggctgttgcagctctgattatgaccaactgggctcttggaaagcacagccgtctgagaaagatatttgatgggaaagatgggaagccaaagtatccaagaagatgggtgatcttgcctccgttcctgtagaagactcgtcgttgtgatcctcgttctatcagtttaaagctttcttaataaggttgtaaaagagatttgaaagatgtttggtttcctctgtatttgttatcacttttgttttgagatgttttgtaagattagagattttagaaacatgcttactt

SEQ ID NO: 518 - DNA, 1321 bp, Brassica juncea
gagatagtaagttagttgtcctactcccaactacacaacttcaatgccccaatctcttcctcctccctcctctctatttaactttccttctctctctccctcactctgaatcttcttatctgggtcttcctcgttttctccgcttttaagccatgaaagtcaccgtcgtctcccgcagcggcagagaagttctcaaagcccccctcgacctccccgattcggcgactgttgctgatctacaggaagcttttcacaagagagctaagaagttttacccatcgaggcaaagactgactcttcccgtggctcctgggtcaaaggacaaacctgttgtcctcaacagcaagaagtcactcaaagagtactgtgatgggaacacagactccttaaccgtagtcttcaaggacttgggagcacaagtctcataccgcacgctcttcttcttcgagtatctcggcccgctcttgatctacccggtcttctactacttccctgtttacaaatacctcggctacggcgaagaccgagtgatccacccggtccagacctacgccatgtactattggtgctttcactacttcaaacgtatcatggaaacgttcttcgtccataggttcagccacgccacgtcgccgatagggaacgtgttcaggaactgtgcttactactggacctttggtgcttacattgcttattacgtcaaccaccctttgtacacgccggttagtgaccttcagatgaagattggtttcgggtttggtttggtttgccaagtcgcgaacttttactgtcatatcctcctgaagaatcttagagaccctagtggctctggaggctaccagatcccacgtggtttcctcttcaacattgttacttgtgctaattacacgacagagatttaccagtggctaggattcaacatcgctactcagaccgttgccggatacgttttcttagctgttgctgctctgattatgactaactgggctcttggaaagcacagccgtctgagaaagatatttgatgggaaagatgggaagccaaagtatccaagaagatgggtgatattgcctccattcctgtagaagactcatcgttgtgatcctcgtttttatcagtttaaaactctcttaataaggttgtaaaagagatttgcaagatgtgtggtttcctctgtattggttgttccttttgttttgagatgttttgtaagtttagagattttagaaacatgcttctttaatcgtttatcacgcaaactaaatcatccgttattccactgtgttgcatagtaagtcaatctcaaaacattttgaacaac

SEQ ID NO: 519 - DNA, 1312 bp, Brassica oleracea
gagggacggtagcaaccagatgggtccaaaaattaagtttgggagatagttagttagttgtcctactcccaactacacaacttcaatgcccaatctcttcctcctcctcctcctcctctctatttaactttccttctctctctctctctctctcacactctgaatcttcttatctgggtcttcctcgttttctccgcttttaagccatgaaagtcaccgtcgtctcccgcagcggcagagaagttctcaaagcccccctcgacctccccgattcggcgactgttgctgatctgcaggaagcttttcacaagagagctaagaagttttacccatcgaggcaaagactgactctccccgtgcctcctggctcaaaggacaaaccggttgtcctcaacagcaagaagtcactcaaagagtactgtgatggaaacacagactccttaaccgtagtcttcaaggacttgggagcacaagtctcataccgcaccctcttcttcttcgagtacctaggcccgctcctaatctacccggtcttctactacttccctgtttacaaatacctgggctacggcgaagaccgtgtgatccacccggtccagacctacgccatgtactactggtgctttcactacttcaaacgtatcatggaaacgttcttcgtccataggttcagccacgcgacttcaccgatagggaacgtgttcaggaactgtgcttactactggacctttggtgcttacattgcgtattacgtgaatcaccctttgtacacgccggtgagtgaccttcagatgaagatcggtttcgggtttggtttggtctgccaagtcgcaaacttttactgtcacattctgttgaagaatctgagagaccctagtggctctggagggtaccagatcccacgtggcttcctcttcaacattgttacgtgtgccaattacacgactgagatttaccagtggctagggttcaacatcgctactcagaccgttgcgggatacgttttcttggctgttgcggctctgattatgactaactgggctcttggaaagcacagccgtctgagaaagatatttgatgggaaagatgggaagccgaagtatccaagaagatgggtgatcttacctccattcctgtagaagactcatcgttgtggtcctcgtttttatcagtttaaaactctattaataaggttgtcaaagagatttgcaagatgtgtggtttcctctgtattggttgttccttttgttttgagatgtttcctaagttccgagattttagaaacctgcttctttaatcgtttatcacgcaa

SEQ ID NO: 520 - DNA, 1444 bp, Theobroma cacao
taaaataaacccacagcttctcactttctttttcgagttataaactttgggatctcagatattgaacgcatccacactttccaagcttaaagctttaaagggtttgttcctttcaccataacaaaaattgggcctcgtttgttttggtttcaagaaggatgaaggtcacactagtttcacgcagtggaagagaggtcatcaaaggaggccttgagcttcatgactcagccactgtggctgatctgcaggaggcaattcacaaaagaactaagaagttctatccttcaagacaaagactaacacttcctgtgccaccggggtcaaaggagaggcctgttgttcttaactacaagaagggtctcaaagattactgtgatggaaaccagaacaatataactgtagtgtttaaggacctgggtcctcaagtatcttatcctacacttttcttctttgaatatttgggtcctttgatcctttatcccaccttctactacttccctgtgtaccagttctttggttataaagtggagcgtgtcatccaccctgttcaaacatatgctttatattactggtgtttccactacttcaaacgtattatggaaacattcttcatccaccgcttcagccatgcaacatctccactatcaaatgtcttcagaaattgtgcttattactggacctttggtgcttacattgcttactatgtaaaccacccgctttacacccctgttagtgacctccagatgaagattggttttgggtttgggttgatttgtcaactcgcaaacttctattgtcatatcatactgaagaatctacgtagccctgatggtagtggagggtatcaaattcctagtggttttctgttcaacattgtgacatgtgcaaattacacaacagagatttaccaatggctgggtttcaatattgctacacagactgttgcaggttatgtatttcttgtggttgctacttctatcatgaccaactgggcccttgcaaagcaccgccgcttgaagaagctatttgacggtaaggaaggaaggcccaagtacccccgcagatgggtaattctccccccattcctgtagaattgatgtgtgaacctgctacttattggtctcctcagtgtcaaactgcaatctagaagcatttattcaagtgtattgaagattcaattcttgtcagtttagaactgaagatcactccccacaaaagttgttttgattaattttgcttttctgtttagacaagttgctctttggtggaagaaataatttcattatgacagaacatcattgctggtttaagccattaatgtaggttgttatgtgaattgtgatgatcagttctatcaatattccattgcataaggcagatgccattatctgagctgatagttttgacatcaaactacatgtccttgtttttgaattataggaaa

SEQ ID NO: 521 - DNA, 1157 bp, Brassica napus
ctgggtcttcctcgttttctccgcttttaagccatgaaagtcaccgtcgtctcccgcagcggcagagaagttctcaaagcccccctcgacctccccgattcggcgactgttgctgatctgcaggaagcttttcataagagagctaagaagttttacccatcgaggcaaagactgactcttcctgtctctcctgggtcaaaggacaaacctgttgtcctcaacagcaagaagtcactcaaagagtactgcgatggcaacactgactccttaaccgtagtcttcaaggacttgggagcacaagtctcataccgcacgctcttcttcttcgagtatctcggcccgctcttaatctacccggtcttctactacttccctgtttacaaatacctcggctacggccaagaccgtgtgatccacccggtccagacctacgccatgtactactggtgctttcactacttcaaacggatcatggaaacgttcttcgtccataggttcagccacgcgacttcaccgatagggaacgtgttcaggaactgtgcttactactggacctttggtgcttacatcgcttattacgtgaaccaccctttgtacacgccggtgagtgaccttcagatgaagattggtttcgggtttggtttggtttgccaagtcgcaaacttttactgtcacattctgttgaagaatcttagagaccctagtggctctggagggtaccagatcccgcgtggcttcctcttcaatattgttacgtgtgctaattacacgacagagatttaccagtggctaggattcaacatcgctactcagaccgttgcgggatacgttttcttggctgttgctgctctgattatgactaactgggcacttggaaagcacagccgtctgagaaagatatttgatgggaaagatgggaagccaaagtatccaagaagatgggtgatattgcctccattcctgtagaagactcatcgttgtgatcctcgtttttatcagtttaaaactctcttaataaggttgtaaaagagatttgcaagatgtgtggtttcctctgtattggttgttccttttgttttgagatgttttgtaagtttagagattttagaaacatgcttctttaatcgtttatcacgcaaactaaatcatccgttatt

SEQ ID NO: 522 - DNA, 1204 bp, Brassica napus
tcttatctgggtcttcctcgttttctccgcttttaagccatgaaagtcaccgtcgtctcccgcagcggcagagaagttctcaaagcccccctcgacctccccgattcggcgactgttgctgatctgcaggaagcttttcataagagagctaagaagttttacccatcgaggcaaagactgactctccccgtggctcctggctcaaaggacaaaccggttgtcctcaacagcaagaagtcactcaaagagtactgtgatggaaacacagactccttaaccgtagtcttcaaggacttgggagcacaagtctcataccgcacgctcttcttcttcgagtacctaggcccgctcctaatctacccggtcttctactacttccctgtctacaaatacctgggctacggcgaagaccgtgtgatccacccggtccagacctacgccatgtactactggtgctttcactacttcaaacgtatcatggaaacgttcttcgtccataggttcagccacgcgacttcaccgatagggaacgtgttcaggaactgtgcttactactggacctttggtgcttacattgcgtattacgtgaaccaccctttgtacacgccggtgagtgaccttcagatgaagatcggtttcgggtttggtttggtctgccaagtcgcaaacttttactgtcacattctgttgaagaatctgagagaccctagtggctctggagggtatcagatcccacgtggcttcctcttcaacattgttacgtgtgccaattacacgactgagatttaccagtggctagggttcaacatcgctactcagaccgttgcgggatacgttttcttggctgttgctgctctgattatgactaactgggctcttggaaagcacagccgtctgagaaagatatttgatgggaaagatgggaagccaaagtatccaagaagatgggtgatcttacctccattcctgtagaagactcatcgttgtgatcctcgtttttatcagtttaaaactctattaataaggttgtcaaagagatttgcaagatgtgtggtttcctctgtattggttgttccttttgttttgagatgttttgtaagtttagagattttagaaacttgcttctttaatcgtttatcacgcaaactaaatcatccgttattccattgtattgcatagtaagtcaatctcaaaacattttgcc

SEQ ID NO: 523 - DNA, 1377 bp, Eschscholzia californica
taccccaacaacttagaataatctctattctgattcagtagtactagtagtttacattgttcttgaaggtggggttgtattcttctcctcaatagggatgaaggtcactgttgtttctcggagtggtagagaaattgtcaaaggtgggattgagctcaatgattcggctacagtgagtgatctccaagaagctattcatgaaagaaccaagaagtactatccttctaggcagcgcctaaccctcccactcgaacctggaagcaaggcgagacccgtcgtcctagccccgaagaaaactctacacgattattgtgatgggaattctggtaacttgactgtggtattcaaggatctaggtcctcaggttttatacagtacccttttcttctgggaatatttcggccctctagtcatatatcccattttttactactttgacgtgtataagtacttggggtacaaaggagaaagggttatccatccagtgcagacatatgcgacatatgtctggtgtttccactattttaaacgaattatggaaacatttttcgtgcatagatttagtcatgcaacttcaccactttcgaatgtgttcagaaactgtttgtattactggtcttttggtgcgttcattgcttactatgtgaatcacccactttatactcctgttagtgatttacagatgaagatagggtttgggtttggagtgatttgtcaaatttcaaacttctattgtcatattttgcttagaaatcttcgaagtcctgatggaaatggcgggtatcaaattcctcgtgggtttttgtttaatttagttacttgtgctaattacacgacggagatatatcagtgggtaggtttcaatattgctacacagactgttgctggttacgtgtttgctgctgttgctgcttttatcatgaccaattgggctctcgcaaaacaccgacgtcttaagaagttattcgacggtaaggaaggcaggcctaagtacccacgaagatgggtgatacttcctccgttcatttaagaaggtagtcctcgacaaactcttgactggatttctctgtggcaaaacctgcaattcatggaatctcggaacccggcttcaagatatctaaaatgtcagcgttgtgattgtaagcatgaaactaagttattgtttcttgttcaacttagacaaaaataagttcgacgtagtttaaggtgtttattttcttttctcgtcttaaggtttattttgattataatcagtgttgttatttagcttcctgcttttttaatgtgttgttccttgttgacattacaaaattctatactattgtattctggtattcttagaataaaaaaaaagtacgtagggtaggacgaaggacg

SEQ ID NO: 524 - DNA, 1563 bp, Glycine max
ctttgttacaatatgtggtgagttatagattatcaggcaaaaacggttagctgtccaaccccaactgcatcacatcaatgtatgcatatccatggcttcatcttctactgaccatacttcacattaatttatcctctcccatctaaaaatctatatataatatattacattgaatttcaattttcctaagctcacatttcctttgtgtttgtgagtaactggcaaagacaccaacaccccttatctctctctctgcccaattctgacctcaagttctgttggatcttgcatatagttaccgtttattgattcgcaaagatgaaggtcacagtggtttctcgaagtggaagagaagtggttaaaggtggcattgagctcagcgattctgctactgtagcagatttgcaggaggcaattcataagcgaaccaagaaatacccatcaaggcagcgcttgacacttcctgtccaacctggatcaaaggaaaggcctgttgtccttaattacaagaagagtctgaaagactatacaattggaaattcagaaaccttaactgttgtattcaaggacttgggcccacaagtttcttaccgtacactttttttctgcgagtatttgggacctttgcttctctatccagtcttctattatctccctgtctaccaatattttggctacaaaggtgaacgtgtcatccaccctgtgcagacatatgccttgtactactggtgtttccattatgccaaacgaattctggaaacattttttgtgcattgcttcagccatgcaacctcacccctttccaatgtgtttcgtaactgtgcttattactggacctttggctcctatattgcttattatgtgaaccaccctttatatacccctgtaaacgacctccaaatgaagattgggtttggatttgggatactttgtcaaatttcaaatttctattgccatattattctgaagaatcttcgtagtcctggtggtgaaggtggataccaaatcccaaggggctttctcttcaatattgttacctgtgcaaattatacaactgagatctatcagtggctgggattcaacattgcaacacaaactgttgcaggctacattttccttgtggttgctacttttataatgaccaattgggctttggccaagcacaggcgtttaaagaagttgtttgatggaaaggaagggagacctaggtatcctcgtcgatgggtaatattgcccccattcctgtagaagaagcctaagcaactgatgaggtcaccactctgctcacaggattctcagatttagaattgtagcataatggaattttggtgatctctttttatttgatatgaatttgtcttgcaatgcttttgactatgaagttgattgctaaattattgaatcagtgttttgcagaatatctgtaatcatttcaagattgtagttctaaggattcttgtttcttcaaaatctttaatgttgctgtttaatttttgttggctacttcctttactgtctccaatgtctcattaatcattttagaaaacaagagttcaattttct

SEQ ID NO: 525 - DNA, 1006 bp, Chelidonium majus
ctctctagggatgaaggttaccgttgtttctcggagtggtagagaaattgtcaaagtgggattgagctcaatgattcggctactgtgagtgatctccaagaggctattcatcgacgaaccaaaaagtactatccttctagacagcgactaactctccccctccaacctggaaccaacgctagacctgtcgtcctcaaccccagaaaactgtccaggattattgcgatgggaattctgacaacttgactgttgtgttcaaggatctcggtacgcaggttttatacagtacccttttcttctgggagtattttggccccctagtcatctatcccatcttttactactttaatgtgtaccagtactttgggtacaaaggcgagcgtgttatccacccagtccagacctatgccacatactactggtgcttccactactttaagcgtataatggaaacattttttgtccatagattcagccatgcaacttcacccctatccaacgtgttccgaaactgtgcttattactggtcatttggctcatttatcgcttactatgtgaaccacccactctatactcctgtgagtgatctacagatgaagattggttttgggattggattgatctgccaaattgcaaacttttattgtcatattttgctgaggaaccttagaagccctgatgggaatggaggataccaaatccctcgtgggtttttgttcaatatagttacttgtgcaaattacacgacagagatatatcagtggttgggcttcaatattgcaacgcagacggttgcaggttatatctttgctgccgtggctgcttttatcatgtctaactgggcccttgcaaagcaccggcgtctgaagaagttatttgatgggaaggatgggaagccaaagtacccgcgaagatgggttattcttcctccattcctttgagaacctcctcttgggttgctatctctgccacgaggtcttgaatccaacagttcaacttcaagaag

SEQ ID NO: 526 - DNA, 1412 bp, Brassica rapa
agggacggtagcaaccaaatgggtccaaaaatttataagtttgggagatagtaagttagttgtcctactcccaactacacaacttcaatgccccaatctcttcctcctccctcctctctatttaactttccttctctctctccctcactctgaatcttcttatctgggtcttcctcgttttctccgcttttaagccatgaaagtcaccgtcgtctcccgcagcggcagagaagttctcaaagcccccctcgacctccccgattcggcgactgttgctgatctgcaggaagcttttcacaagagagctaagaagttttacccatcgaggcaaagactgactcttcctgtctctcctgggtcaaaggacaaacctgttgtcctcaacagcaagaagtcactcaaagagtactgcgatgggaacacagactccttaaccgtagtcttcaaggacttgggagcacaagtctcataccgcacgctcttcttcttcgagtatctcggcccgctcttaatctacccggtcttctactacttccctgtttacaaatacctcggctacggccaagaccgtgtgatccacccggtccagacctacgccatgtactactggtgctttcactacttcaaacggatcatggaaacgttcttcgtccataggttcagccacgcgacttcaccgatagggaacgtgttcaggaactgtgcttactactggacctttggtgcttacatcgcttattacgtgaaccaccctttgtacacgccggtgagtgaccttcagatgaagattggtttcgggtttggtttggtttgccaagtcgccaacttttactgtcacattctgttgaagaatcttagagaccctagtggctctggagggtaccagatcccgcgtggcttccacttcaacattgttacgtgtgctaattacacgacagagatttaccagtggctaggattcaacatcgctactcagaccgttgcgggatacgttttcttagctgttgctgctctgattatgactaactgggcacttggaaagcacagccgtctgagaaagatatttgatgggaaagatgggaagccaaagtatccaagaagatgggtgatattgcctccattcctgtagaagactcatcgttgtgatcctcgtttttatcagtttaaaactctcttaataaggttgtaaaagagatttgcaagatgtgtggtttcctctgtattggttgttccttttgttttgagatgttttgtaagtttagagattttagaaacatgcttctttaatcgtttatcacgcaaactaaatcatccgttattccattgtattgcatagtaagtcaatctcagaacattttgaaaatggactaagagcgcaaaccaatgaacactgtcattttaagtaacagtaa

SEQ ID NO: 527 - DNA, 1474 bp, Manihot esculenta
gttgttagctctcctaccttccaaccacacctctttattgtattccccataaaataggcccaaacccatctcctcatttgtattcgagctctgctttagctggtttctgtatgagatctccttcaaaagtttcagttcttcctttgattctttctgaatcttgagttgaatcctcaagttttgaagggtttgttttgttttgacatttggtgaattgggtctcttttatttcaactccaaaatgaaggttactatagtttcacgcagtggtagagagattgttaaaggaggcctagagattaatgattcagctacagtggctgatctgcaggaggcaatctataagcgaaccaaaaagttctatccttcaagacagcgactgacactgcctcttccaccgggatcaagggagaggcctgtcgtccttcattacaagaagagtcttaaggaatactgtgatgggaattctgacaacataactgtagttttcaaggacctgggtccacaagtttcttaccgcacacttttcttctgggagtacttgggtccattgatcatatatcctatcttttacttcttccctgtctatgagtactttggttacaagagggaacgtgtcatccatccagttcagacatatgctttatactattggtgcttccactacttcaaacgtatcatggaaacattttttgtgcaccgatttagccatgcaacttcacctctgtccaatgttttccgaaattgtgcttactattggacctttggttcctacattgcctactatgtaaaccacccactttacactcctgttagtgatcttcaaatgaagattggttttggattcggtttggtttgtcaagttgcaaacttttattgccacatcttgctgaaaaatcttcgcactccagaaggaagtggaggttaccaaatcccacgtggttttcttttcaatattgtgacatgtgcaaattacacaactgagatttatcagtggttaggtttcaatattgcaacacagactgttgcaggctatgtctttttagtggttgctactgtgatcatgaccaattgggcccttgcaaagcaccggcgattgaagaagctatttgacgggaaggatggacggcctaaatatccacgcagatgggttatcctgcctccgttcctgtagaaatgaccagctattctgctacttgttcactgctttcggcttggttttggcaacatcacgaattccagattgtggttcattcttctagatatttgatcgagctcgcacttttcaccaaattgattgaagatcatagtttcttttacttaagacagaaaattactggaagctagaggataatcttgttaaatgttttcttttattagaactttcgccgaactgttgcattacatgtggaggttcaccactcttgttggtgtaagcgatttattgaatggtggcttcttgatgatcatcatt

SEQ ID NO: 528 - DNA, 1435 bp, Gossypium hirsutum
acatgccccattccataaactgtcaccaccttcgcatactttcctttcaaagttctaatcttcgagatctccgaagatccaaagatccaactctcccaaaccttaaaaagcttcaaagggtttctccctttagccataacaaaaactgggtctcatttgttttgatctaaaaaaggatgaaggtcactctagtttctcggagtgggagagagttcatcaaaggtggccttgagcttaatgactcggctactgtggctgatctgcaggaagcaattcacaagagaactaaaaagttctatccttcaagacaaagactaacacttcccgtgccatcgggatcaagggagaggcctgtcatccttaactacaagaagagtctcaaagactactgcgatggaaatgagaacaccttaaccatagtgttcaaggacttgggtccacaagtgtcgtatcgaacacttttcttcttcgaatacttgggtcctttgatcctctaccccgtcttctactacttccctgtatacaagtactttggatacgaagaaaagcgtgtcatccaccccgttcaaacatatgctttatattactggtgtttccactacttcaaacgaatcatggaaacattcttcatccaccgtttcagccatgcaacgtccccactatcaaacgttttcagaaactgtgcttattactggaccttcggttcatacattgcttactacgtcaaccacccactttacacacctgttagtgatcttcagatgaagatcgggttcgggtttggtatagtttgtcaacttgcaaacttctattgtcatattatactgaagaatctacgcagtcctgatggtagtggagggtatcaaattcctcgtgggtttctgttcaacattgtgacttgcgcgaactacacaacagagatttaccaatggttgggtttcaatatcgctacacagaccgttgctggctatgtattccttgtggttgctacctctatcatgacgaattgggcccttgcaaagcatcgtcgactgaagaagctattcgacggtaaagatggaaggccgaagtacccccgaagatgggttattcttcctccattcctgtagaacggatcgatgagcatcgtacttttcgagatatgaactttacaacgttgaaacatggtctccgagttcattgaaagatcaattcttgttagagtatggaattttagttggtggtgaaccaatataatttacttgacatgcgcattaggatgcttttttgcttatgtaaactcattgctggtttaaactattggtgttggttattgtttcaattaatggttttttatgttcttattttgaatcttgccgttggggtttggttgaattcgattcagtcattttcgagtcgagcaaactaagtcattaccaatatcctagtgctccgt

SEQ ID NO: 529 - DNA, 1197 bp, Echinacea purpurea
ctcatatttcatcaatcccagatctcaaaacatcccaattattaccattgttttctccgctcaattccagttcctaatcgccggaaagatgcaggttaccgttactacaagaagtggtagagaactaatcaacggtggccttgttcttgactcctctgctactgttgctgatttgcaggaagcaattcatcagcgaatcaagaaatactatccatcccgacaacgtctgaccctacccctccaaccgggctcaaaggaaaaggccgttgttcttcaatccaagaaaagtctaaaagagtacacagatggaaactctgacacccttactgtagtgtttaaggatttgggcccacaagtttcataccgcacactcttcttttttgagtatttgggcccgttaatcctctatcccgtcttctactacttcccagtgtaccaattttttgggtacaaaggcgaacgggtcatccatccagttcaaacatatgcattatactactggtgtttccactacttcaaacgtatcatggaaaccttttttgtgcaccgtttcagtcatgcaacttcacctctttcaaatgtgtttagaaactgtgcttattactggacttttgggtgttacattgcttattatgttaatcatcctcattacacacccgtaagtgacctccaaatgaagattggatttgggttcgggttgattatgcaatttgcaaatttgtattgccacatcatactcagaaatctcaggagcccgagtgggaatggagggtaccaaattccacgcgggtttttgtttaatattgtgacttgtgcgaattacacaactgagatttatcagtggttgggttttaatatcgcaacacagactgttgcgggttatatctttcttgtggttgctgcttccattatgactaattgggccctggctaagcatcgtcgtctcagaaggctctttgacgggaaggaaggaagaccgaagtaccctcgccgatgggtaatactgcccccatttttgtaagcgactgcaaacatgggtcgtatgtcattttatatggctcgggtttatcagctagatttggttgtatcatgagtttgtttttagtccacgtatgtttagaacttttgtttctattgaactgggaatcataccatctgtactaagattaagaccatatgcgtaatttctcataaaaa

SEQ ID NO: 530 - DNA, 1319 bp, Solanum melongena
agattcataatttggagttggagatggtggattggttcgttcagctactttctacccaactaaacgccattaattgcttacttctactacttatcaagcgccattaaatatctcaacctcctcacactattcattatttctcagaagatagttgtgttcttgtagatcccaaagtttggggagcaaaaatgaaggttttggtggttacacgtagcggcaaagaactcatcaagggtggacttgaactcgctgattctgctacagttgctgatttgcaggaggcaattcataaacgaaccaaaaaatactatccttctagacaacgactcaccctgcctgttcaacctggctcaaaagagaggccaactgttcttcactaccagaagagcctaagtgagtatactaaggggagcacaggcgaattgactgtagttttcaaggatctgggtccacaagtcaagtatagcacacttttcttctttgaatatctggggcctctgctgctctatcctatcttttactacttccctgtctacaagtattttggctacaaagaagagcgtgtaatccaccctgtccagacttatgccttgtattactggtgtttccactacttcaaacgtatcatggagaccttctttgtgcaccgcttcagccatgccacttctccaatttccaatgttttccggaactgtgcctattattggtcttttggagctttgattgcttacttcgtgaatcatcctcgttttactcctgttagtgatctccagatgaagattggatttggttttgggatagtttgtcaggtggcaaacttctattgccatttattgttgagaaatctccggagtcccagtggtaatggaggttaccaaataccccgtggcttcttgttcaatattgtcacctgtgcaaattacactacagaaatctaccagtggttgggcttcaacattgctactcagactgttgcaggctatatcttcatggttgttgctgctagcattatgactaactgggctcttggaaagcatcgtcgtttgaagaagctctttgatggaaaggaaggaagaccaaagtatcctcgacgatgggtgatattgcctccattcctgtagaccatttccttgacgatgtgaggaagcccgataattatctatttagttgaccattttgtgtgaacctgcaacttttgaaggtttatgtttctcattaaagaatgtaatacttgataacatttttctcttgcattactattctgtcttagtttctttttagaccagatagtcttttgagttcaatgatatttgtagttc

SEQ ID NO: 531 - DNA, 1384 bp, Euonymus alatus
actcgattgccctgttgtggagttgattcagcttcttctttcttgggaagtcaatttggagaattgggtttctctccactctgaaaatgaaaatcactgttgtttcacgtagcggtagagaagtcgtcaaaggaggactggagctcaatgactcggcaacggtggctgatctgcaagaggcaatccatcggcgaactaaaaagttctacccttcaaggcagcgactgaccctcccccaaaagcctggcttgaaagagaggcctgttgcccttaactataagaagagtctgaaagaatactgtgatgggaattcagagaacttaactgtagtgtttaaggaccttggtccacaagtctcctaccgtatactttttttctgggagtatcttggtcctctcatcctctatccggtcttttattacttccctgtgtatcaattctttggctacaagggagagcgtgtcatccacccggtgcagacatatgctatgtactactggtgtttccactatttcaaacgtataatggaaacattttttgtgcaccgtttcagccatgcaacctcgccgctatcaaacgtattccgaaattgtgcttattactggtcttttggttctttcattgcatattatgtgaaccaccccctctacactcctgttgatgacctccaaatgaagatcggctttggtattgggttggtttgtcaacttgcgaatttctattgccacattttattgaagaatcttcgtagccctgatgggaatgggggatatcagattccgcgaggatttcttttcaatattgtgacttgtgcgaattacactactgaaatttaccagtggctgggattcaatattgcaacacaaacgattgctggttatatctttatggtagttgctgctcttatcatgaccaattgggcccttgcaaagcaccgtcggttgaagaagctatttgacgggaaggagggaaggcctaagtatcctcgacgttgggtgatattgcctccatttctgtagaaattacttgtgatgctgcctcaggctcagtcccttcatacctggttcgtattcagctgcatcaattctgacacgatcaagttccattctggtcagtggtcacatacaaagagtcttggatccattttggatgcaaaatttctcttaattgttgggatactgatcccctttcacactccttttttcccctttagctttctgcaagtgtctgatgagtgctctagagcttagtttgaataacttattgtgttgaacaaaaagctgatccttgatatgtagctagttgtttatcttatgtagaactgaatgtattgagtcatgaaacctaaaaaaagatttggttccttttaaattgttaaatcaaa

SEQ ID NO: 532 - DNA, 1244 bp, Raphanus sativus
gggtcctactcccaactacacaacttcaatgccccaatctcttcctttcttcttactcctcttcctcctctctatttaaatcttcctcttctttctctctcactctctcaatttcctcatctgggtcttcctcgttctctccgctttaagccatgaaagtcaccgtcgtctcccgtagcggtagagaagttctcaaagcccccctcgacctccccgattcggcgactgttgctgatctgcaggaagcttttcacaagagagctaagaagttttacccatcgaggcaaagactgactcttcccgtggctcctgggtcaaaggacaaacctgttgtcctcaacagcaagaagtcactcaaagagtactgtgatggaaacacagactccttaaccgtagtcttcaaagacttgggagcacaagtctcgtaccgcacgctcttcttcttcgagtacctcggcccgctcttgatctacccggtcttctactacttccctgtttacaaatacctcggctacggagaagaccgtgtgatccacccggtccagacctacgctatgtactactggtgctttcactacttcaaacgtatcatggaaacgttcttcgtccaccggttcagccacgcaacttcgccgatcgggaacgtgttcaggaactgtgcttactactggacctttggtgcttacattgcgtattacgtgaaccatcctttgtacacaccggttagtgaccttcagatgaagattgggttcgggtttggtttggtttgccaagtcgccaacttctactgtcacattctgttgaagaatctcagagaccctagtggagctggagggtaccagatcccacgtggtttcctcttcaacattgttacgtgtgccaattacacgaccgagatttaccagtggctaggattcaacatcgctactcagaccgttgcaggatatgttttcttagctgttgcagctctgattatgaccaactgggctcttggaaagcacagccgtctgagaaagatatttgatgggaaagatgggaagccaaagtatccaagaagatgggttatattgcctccattcctgtagaagactcatcgttgtgatcttcgttctatcagtttaaaagctttcttaataagaggttgtaaaagagatttggaagatgttcgtttttctctgtatttgttatcacttttgttttgagatgttttttgtaagtttagagattttagacacttgcttctt

SEQ ID NO: 533 - DNA, 1293 bp, Raphanus sativus
acacaacttcaatgccccaatctcttcctttctccttactcctcttcctctctatttaaatcttccccttctctctctctctctcaatttcctcatccgtgtcttcctcgttttctccgctttaagccatgaaagtcaccgtcgtctcccgtagcggtagagaagttctcaaagcccccctcgacctccccgattcggcgactgttgctgatctgcaggaagcttttcacaagagagctaagaagttttacccatctaggcaaagacttactcttcccgtggctcctgggtcaaaggacaaacctgttgtcctcaacagcaagaaatcactcaaagagtactgtgacggaaacacagactcattaaccgttgtcttcaaggacttgggagcacaagtctcgtaccgcacgctcttcttcttcgagtacctaggcccactcttgatctaccctgtcttctactacttccctgtttacaaatacctcggctacggagaagaccgtgtgatccacccggtccagacctacgctatgtactactggtgctttcactacttcaaacgcatcatggagacgttcttcgtccacaggttcagccacgcaacttcgccgataggaaacgtgttcaggaactgtgcttactactggacctttggtgcttacattgcttactacgtgaaccatcctttatacacaccggttagtgaccttcagatgaagattggtttcgggtttggtttggtttgccaagtcgccaacttctactgtcacattctgttgaagaatcttagagaccctagtggagctggagggtaccagatcccgcgtggtttcctcttcaacattgtcacgtgtgctaattacacgacagagatttaccagtggctaggattcaacatcgctactcagaccgttgcaggatatgttttcttagcggttgctgctctgattatgaccaattgggctcttggaaagcatagccgtctgagaaagatatttgatgggaaagatgggaagccaaagtatccaagaagatgggtgatattgcctccattcctgtagaagacttatcgttatgaagcttttcttaataaggttgtaaaagagatttgaaagatgttttttttctctgtatttgttatcacttttgttttgagatgttttgtaagtttagagattttagacactttgctttaatcgtttctcgcgcaaatcaaatcctccattgtattgcatagtaagtcaatctcaagtcatggtgagggcactaggcatgcggttcaatattcggtta

SEQ ID NO: 534 - DNA, 1159 bp, Raphanus sativus
actctctcaatttcctcatccgtgtcttcctcgttttctccgctttaagccatgaaagtcaccgtcgtctcccgcagcggcagagaagttctcaaagcccccctcgacctccccgattcggcgactgttgctgatctgcaggaagcttttcacaagagagctaagaagttttacccatcgaggcaaagactgactcttcccgtggctcctgggtcaaaggacaaacctgttgtcctcaacagcaagaaatcactcaaagagtactgtgatgggaacacagactccttaaccgtagtcttcaaggacttgggagcacaagtctcataccgcacgctcttcttcttcgagtacctcggcccgctcttgatctacccggtcttctactacttccctgtttacaaatacctcggctacggccaagatcgtgtgatccacccggtccagacctacgctatgtactactggtgctttcactacttcaaacgcatcatggagacgttcttcgtccacaggttcagccacgcaacttcacctatcgggaacgtgttcaggaactgtgcttactactggacctttggtgcttacattgcttactacgtgaaccatcctttatacacaccggttagtgaccttcagatgaagattggtttcgggtttggtttggtttgccaagtcgccaacttctactgtcacattctgttgaagaatcttagagaccctagtggagctggagggtaccagatcccccgtggtttcctcttcaacattgtcacgtgtgctaattacacgacagagatttaccagtggctaggattcaacatcgctactcagaccgttgcaggatatgttttcttagcggttgctgctctgattatgaccaattgggctcttggaaagcacagccgtctgagaaagatatttgatgggaaagatgggaagccaaagtatccaagaagatgggtgatattgcctccattcctgtagaagacttatcgttatgatcttcgttctatcagtttaaaagcttttcttaataaggttgtaaaagagatttgaaagatctttgttctttctctgtatttgttatcacttttgttttgagatgttttgtaagtttagagattttagacactttgcttctttaatcgtttctcgcgca

SEQ ID NO: 535 - DNA, 1623 bp, Sesamum indicum
taaagattagcaaaaaatataaatatagaattgaatgttttaatgggagagaaaatggtgacagtgaggcagtagtggtttatcggtggctcatctaccccaaccacaacccaacgctattaattgcttccaagtacctcctccacctctatatcattcaaattcaatcaatcatctctgcaaattcatcaatccgccccaacgccttcctcctgcacttctttcacatacccatttccgcaccgtaacagcagagcccatctcttttttagagtagatcttgaaggtaagaggaagagaagatgaaggtgattgtcacgactcgtagcggccgagaactcgtcaaggggggccttgagctcagcgattctgctactgttgctgacctgcagggggcgattcacaaacgaaccaagaaatactatccttccagacagcgattgaccctcccactcccacctgggttgaaggaaaggcctaccgtccttaactataaaaagagtctgaaggactatactaatggcaacacagctgaattaacggttgttttcaaggatcttggtccacaagtcaagtatagcacgcttttcttttgggagtacttgggtcctttgattatctatcctatcttctattactatcctgtgtacaagttctttgggtacaagggggagcgtgttattcatcccgttcagacatatgccctgtattactggtgtttccactactttaaacgtattatggaaaccttctttgtgcaccgtttcagccatgcgacatcgcctctttcaaatgtgttccgaaactgtgcttattactggacttttggtgcttggattgcttattatgtcaatcaccctctttatacacctgtaagtgatctccaaatgaaagttggctttggttttgggttgctttgccaaatttcaaacttctattgccatatattgttgagaaatcttcgaagttctgaagggggtgggtaccaaatcccacgtggctttctattcaactttgttacatgtgctaactatacaactgagatatatcagtggctaggcttcaacattgcaacacagactgtggcaggttatgttttcatggtggttgccgctgccataatgacaaactgggccctcgccaagcaccgccgtctcaagaagctatttgatgggaaagagggaagaccaaaatacccccgacgatgggtgatactgcccccattcctgtaagagcaaacactcggtgcttttgtttttatcacgatccaagttctgcactgcccggttgaatgtagtcaattctcaaagagagttctctttaatagagatcacgcatagatcttgccagctagctcgtgttttacgtcctgacatccgttcattagcatcatggtaatggtgttttaggtgtcgttagtcgttacccttgtggtctctgtttcatttgcgatcaaacatcttgcatatgttgagtatttcctcgacttagtcagcacgttaagcagaacagatgatttaaaagtgcaaaatcttgctgttagcagacatttatcctctgttttggttatgatatctaccgttgctgcaaaactgcatggtgctacttattttgtaatcagtc

SEQ ID NO: 536 - DNA, 1280 bp, Plantago ovata
agctgaaaccagaaattttctctctagagagctaaacagggagagagagagcgagagaagatgaaggtgaccgtgacgactcgtagcggcagagaactcgtgaaaggaggtctcgaccttgctgattccgctaccgtcgctgatctgcaagaggcaattcacaagaaaaccagaaaatactatcccgcaagacaacgactcaccctgcctctcccagccggttcaaaggagagaccgacagtccttgcttctaaaaagagtctgaaggagtatgccgatggaaacaaagaattaactgtagtattcaaggatctgggtccacaagtcaagtacagcacacttttcttctttgagtacttgggtcctctggttctctatccaatcttctattactacttcccaatataccaattctttggctataagggtgaacgtgttattcacccagtgcagacatatgccatgtactactggtgtttccattacttcaaacgtatcatggagacctttttcgtccaccgattcagccacgccacttcacctgtctccaatgtcttccggaactgtgcttattactggacattcggtgcttggattgcttattacgtcaatcacccactttacacacctgtaagtgatcttcaaatgaagattgggtttggttttggggtgctttgtcaaatttcaaacttttattgccatatcttgctgagaaatcttcggggttctggcactggtggcggctatcaaatcccccgtggttttctgttcaacattgttacatgtgcgaactatacaacagagatataccagtggctgggtttcaacattgctacacaaactgtagcaggtattgtcttcatggtggttgcagcttccataatgacaaattgggcccttgcaaaacatcgccgtttgaagaagctatttgacgggaaggatggaagacccaaataccctcgacgatgggttatcctccctccgttcctgtagaagcacagtcagttggatgcttgttgtacggttgagtacttgagttaaacgtctgacgctagatcaagggttcatgacaattctagcagatcatttagtccccatcctatttgttcttgtggccttcagttcattgtgtgagcaaaaacatccttagcttgttatgtagtttgtattcagtaaactttgccttttagtcttgagaatggtggtgtatttgcatcttagacaagcaaattcatgttatcacgtgaagtttattacccaaaaaaaagaaaaaaacaaac

SEQ ID NO: 537 - DNA, 1322 bp, Musa acuminata
tcattaaagccggccaacgccctcggatcaagtcgagatccgtcggcataaatggtgcagatgagccgtcgtctctgattgtgatccgcgagggccgtccgcttcttctcctcgtttggccgcgctgagttgggcgcattccgaggtcgggaaggatgaaggtaacggttgtttcgcgcagcgggagggaggtcatcaagggcgggattgagctccacgatgaggccactgtgagcgatctacaggaagctatccatgcccgaaccaaaaagtactatccttcaagacagcgacttaccttgccaatgcaagctgggatccagggaaaaccaattgtccttagtccaaagaaaaagcttgtagactattgtgatgggaatgtcaagaatctgactgtggtcttcaaggatttaggagtgcaggtcttatacagaacacttttcttctgggagtacttgggtcctttggttatctacccgatcttctactattttccagtatacaagtacttcggctatgagggtgaacgtgttgtttacccagtccagacatatgctatgtattactggtgtcttcattactccaagcgtatcatggagactttcttcgttcacagattcagccatgcaacttcacctctctccaatgtcttcaggaactgtgcctattattggacttttggtgcatacattgcatactatgtgaatcaccccctgtatacacctgtcagtgatctgcaaatgaagattggttttggatttgggttgatatgccaggtttcaaacttttactgccatatattgttgaggaacctcagaaaccccaatggtaatggtggttatcagattcctcatgggtttttgttcaacatagtgacttgtgcaaactacacaacggagatctatcaatggcttggtttcaatattgcaacccaaacaatagcaggttacgtgttccttgtggtggctgctctcattatgactaactgggccctcgcgaaacaccgtcggctcaagaagttatttgatggaaaagaaggacgaccaaggtatccacggcgctgggtgatacttcctccattcatctaagtaacagctgcttagtcggtacttgcttctagagtttggaacttaaaaagcatcaacatgatatgggggtttggaacaacaatagactaccgaactatgtatttgcaatgtatcactgaaatgtcttcttgagcaagatctctagttgtttgatttcttgatgaacaaacattagactttatgaactgtcttttaacttactgatgcactgtttcatgcaaggaaacaatttta

SEQ ID NO: 538 - DNA, 1287 bp, Arabidopsis lyrata
ccaactacatcctcttcaatgctcaatctcttcttcctctctatttagtttcctctctctctctctctctctctctctctcaatttcctcatctgggtcttcctcgttttctccgctttagcaccatgaaggttaccgtcgtctcccgcagcggcagagaagtcctcaaagctccccttgacctccccgattcggcgactgttgctgatctgcaagaagcgtttcataagagagctaagaagttttacccgtcgaggcaaagactgactcttcctgtggctcctggatcgaaagagaaacctgttgtcctcaatagcaagaaatcactcaaggagtactgtgatggaaacaccaactccttaactgtagtcttcaaagacttgggggcacaagtttcctaccgcacgctcttcttctttgagtatcttggccctctccttatctacccggtcttttactacttccctgtttacaagtttcttggctatggagaggaccgtgtgatccatccggtccagacgtacgctatgtactactggtgctttcactacttcaaacggatcttagaaacgtttttcgttcatcggttcagccacgcaacctccccaatcgcgaatgtgttcaggaactgtgcttattactggagctttggtgcttacattgcttattacgtcaaccatcccttgtacactccagtcagtgaccttcagatgaagattggtttcgggtttggtttggtctgccaagtcgcaaacttttactgtcacattttgctgcagaatcttagggaccccaatgggtctggaggctaccagattccacgcggtttcctcttcaacattgttacatgtgccaattacactaccgagatttaccaatggctaggattcaacatcgctactcagactgttgcaggatatgtttttctcgctgttgctgctctaatcatgactaattgggctcttggaaagcacagccgtctgagaaagatatttgatggaaaagatggaaaaccaaagtatccaagaagatgggtgatacttcctccatttctttagaagccattgtcgcttatcactgaaagctctattaagttgaaaatgagactttctttggtttctctgtattttttgggtctatgtattggttataacttgtttattccttttgttttaaaatgttttgaagttaagagagatttagaatgtactacttctttagttgtttctcacgcaaaccaattcctcttatgtatcgcatacttgagtcaataagaaaaatgattac

SEQ ID NO: 539 - DNA, 1477 bp, Euonymus alatus
ctgcctgcatctcccattaaattatctctttaactgttttaatttcttaaaaagcctcctttgtcgatacccttctgagatctcactcgattgccctgttgtggagttgattcagcttcttctttcttgggaagtcaatttggagaattgggtttctctccactatgaaaatcactgttgtttcacgtagcggtagagaagtcgtcaaaggaggactggagctcaatgactcggcaacggtggctgatctgcaagaggcaatcaatcggcgaactaaaaagttctacccttcaaggcagcgactgaccctcccccaaaagcctggattgaaagagaggcctgttgcccttaactataagaagagtctgaaagaatactgtgatgggaattcagagaagttaactgtagtgtttaaggaccttggtccacaagtctcctaccgtatacttttttctgggagtatcttggtcctctcatcctctatccggtcttttatttcttccctgtgtatcaattctttggctacaagggagagcgtgtcatccacccagtgcagacatatgctatgtactactggtgtttccactatttcaaacgtataatggaaacgttttttgtgcaccgtttcagccatgcaacctcaccactatcaaatgtattccgaaattgtgcttattactggtcttttggttcttacattgcatattatgtgaaccaccccctctacactcctgttgatgacctccaaatgaagatcggctttggtattgggttggtttgtcaacttgcgaatttctattgccacattttattgaagaatcttcgtagccctgatgggaatgggggatatcagattccgcgaggatttcttttcaatattgttacttgtgcgaattacactactgaaatttaccagtggctgggattcaatattgcaacacaaacggttgctggttatatctttatggtagttgctgctcttatcatgaccaattgggcccttgcaaagcaccgtcgtttgaagaagctatttgacgggaaggagggaaggcctaagtatcctcgacgttgggtgatattgcctccatttctgtagaaattacttgtgatgctgcctcgggcttagtcccttcatacctggttcgtattcagctgcatcaattctgacacgatcgagttccattctggtctgtggtcacatacaaagagtcttggatccattttggaggcaaaatttctcttaattgttgggatactgatcccctttcacactcctttttttcccgttagctttgtgcaagtgtctgatgagtgctctagagcttagtttgaataacttcttgtgttgaacaaaaaggtgatccttgatatgtagctagttgtttattttatgtagaactgaatgtatttgagtcatgaacctaagaaaagatttggttccttttaaattgttaaatcaaatgttgcaagattctgg

SEQ ID NO: 540 - DNA, 1255 bp, Fagopyrum esculentum
agctatgaaggtcaccgttgttacccgcagtggtagagagcttgtcaagggcggccttgaactcgatgattctgctactgttgccgatctacaagatgctatttacaagagaaccaagaagtactatccttccagacaaaggcttacccttcctttgccatcagggtcaaagggaaaacctgttgtcctcaacagccagaagagtatcaaagactatagtgatggaaactccagtgaattctctgttgtgtttaaggacctaggaccgcaggtttcctaccgtacgcttttctttttcgagtacttgggtcccctctttatctacccaattttctactactttcctgtttatgaatttttcggctacaaaggagagcgtgtgatacacccagttcagacatatgcaatgtactactggtgtttccactatttcaagcgtattatggagacgtttttcgtgcatcgctttagccatgcaacttccccgctatctaacgtgttcaggaactgcgcatattattggacttttggagcttacattgcttactatgtgaatcatccactttatactcctgtcagtgacctccaaatgaagattgggtttggatttggggtgctctgtcaagtctccaacttttactgtcatattctgctgaagaatcttcgctcatctgatggaggaggataccaaattcctacagggtttttgttcaacattgtgacctgtgcaaactacactactgaaatttatcagtggttgggcttcaatattgcaacccaaactgtggcaggttatgtcttcctcattgttgcaacttcaatcatgactaactgggcacttgctaagcaccgacgtctgaagaggctatttgacgggaaagatggcaggcctaagtatccacgaagatgggtaatattgcccccattcctgtaaaaaggaagaagataacgaggcaagaactacccgagttgtggatccctgcacgatcatatatatctacgcttgctgcctcgtaaagttgaaaatttgaaataattaagatttcacttcagctgtgttgctacttgtttttgaactcaataatactgtcagccatttttaagttagtctgttgttgcttttggttcgtagctgcgttgggacgatattgttgctagtcttagtagtagcttaaaccatgtttcgtttcagttgctttcaggtttgattgctataaaaggatgtaagactgtcacttaatgtggtatttggaaa

SEQ ID NO: 541 - DNA, 1263 bp, Flaveria ramosissima
tgaaagcccgttattcgcaaacagaggctaacgtcagttagttgcctccgctcatctaccccaactacacgcctttaaaactctatcaaaatcacacttcatccttaaattaatccaaccatccccatttcgccaataacttccacccagatctcatctcaaccattgttttctccgtttcctcttaaattcctttatcttccattttccgatcgccggaaagatgaaggtcaccgtcactacacgaagcggtagagagctaatcgacggtggtcttgttcttgatagctccgctactgtggccgatttgcagaaggcaattcatcagcgaatcaagaaatactatccttctagacaacgtctgaccctgcccctcgaaccgggatcaaagaagaagcctgtagttcttcaatacaagaaaagtctcaaagagtacacaagtggaaactccgacgacattaccgtagtgtttaaggatttgggcccacaagtttcataccgtacactcttcttttttgagtacttgggcccattaatcctctaccctgtcttctattatttcccagtgtaccaattttttgggtacaaaggtgaacgggtcatccatccagtccaaacatatgccatgtattactggtgtttacactatttcaaacgtataatggagacctttttcgtgcaccgcttcagtcatgcaacttcaccactttcaaatgtttttaggaattgtgcttattattggacctttgggtgttacattgcttattatgttaatcatcctctttacacacctgtaagtgatcttcagatgaagattggatttgggtttgggttgattatgcaagttgcaaacttgtactgccacatcatactgcgaaaccttaggagcccgagtggggatggagggtaccaaattccgcgagggtttttgtttaatattgtgacttgtgcaaattacacaaccgagatttatcagtggttgggatttaatatcgcaacacagactgttgcgggttacgtttttcttgtggtcgctgcttccatcatgactaattgggccctagctaaacatcgtcgactcaggaggctcttcgatgggaaggaaggaagaccaaagtacccccgccgctgggtgatattgcccccattcctgtaaacgactataaacatgggttgcatgtcattttcaatggctctggtttatcagttagaattggttctatcatgagtttgtttttagtcaacatatgttttacttgttta

SEQ ID NO: 542 - DNA, 1541 bp, Humulus lupulus
aggaagttaagaatcgaaagttagctctcctaccccaactgcatcccattaatttacttaccatcttccaaactaattcctaccctgagtgagccttgattgtcccattttggatcccatctttagtcccattcattctctctctctctctctgtgcttcagcttatttatggatcttgcataagattgctcgccaaagtacagagcttattgttttttggaatttggtcatttgggtctttccaagatgaaggtgagcgtaatctcacgaagcggtagagaagtaatcaggggtggccttgagctcaatgactctgccactgtgtctgatctacaggaggcgattcataagcgaacaaaaaagttctaccctgctaggcagcgacttaccctccctgtccaaccgggatcaaaagagaggcccgttgtcctcagctccaaaaagggtctcaaagaatataccagtggaaactcgaatgacttgactgtagtgttcaaagaccttggcgcgcaagtttcataccgtactctcttcttcttcgaatacttgggtcctctgatcatttatcctctattttactactttccggtgtatcgatactttggcttcaaaggcgagcgtgtcatccaccctgtgcagacgtatgccatgtactactggtgtttccactacttcaaacgcattatggaaacatttttcgttcatcggttcagccatgccacctcaccactctccaatgtttttcgcaattgtctttactattggtccttcggatcttacatagcttactatgtgaatcacccactttacacccctgttagtgacctacaaatgaagattggctttgggtttgggatactatgtcaaatctcaaacttctattgccatatcttgctcagtaatctgcgtggtgctgatgggagtggaggatatcaaattccacgcgggtttttgttcaacatcgtcacttgtgcaaactacacaactgagatttatcagtggttgggtttcaacattgccacacagacagtcgctggttatctcttccttgtggttgctgcttttataatgaccaactgggcccttgcaaagcaccgccggttgaagaagctattcgatggaaaagatggaaggccaaagtatccacgcagatggataatactacctccatttctgtagaacattttggtgagcgagcgagcgagcagcgtctactatttcttcttgcccctagttggtatcatgttttgcctccaactgtatgaattgttagagctccattttcaccagagctgatatttttgtttttgcatttcagtcctagtgtttttagtttcagtttaaaaatgtaatggatttcaaaggatgattatcatcttttcttttttctttctctgctatttattctagatggctgtgttgttctctgtactcttggattgaaaccttctcctaaataatgactttatactcctagcagataaagacttgggaagattgtagaggttccaaaacttatatacatacatatatttatatt

SEQ ID NO: 543 - DNA, 1290 bp, Actinidia deliciosa
ctccggcgctccgcatataaaatgcgctctcgctttgctccctcggattcctgaactcgcattttgatctctcaatcctctctctctctcatacccgaagatgaaagtggtcgtcgtcacgcggagcggtagagaactcatcaagggtgggctcgagctcgatgactccgcaaccgtggctgatctgcaagaagcaattcaccggcgaacgagaaaatactatccatctagacagcgcctgaccctctccctccaacctggatctaaggaaaagccaactgtccttcactaccggaaaagtctcaaggaatattgtagcggaaactctgataacttgactgtggtgttcaaggacctgggtccacaagtttcctaccgaaccctcttcttctttgagtacttgggtcctctactcatctatccaattttttactacttgcccgtttaccaatactttggctacaaaggagagcgtgtcgtccacccagttcagacatatgccacgtactactggtgcttccactactttaaacgtatcatggagacattctttgtacatcgcttcagccacgcaacttcaccactctctaatgtgttccggaactgcgcttattactggacatttggtgcttatgttgcttactatgtgaatcacccgttttatacacctgtttgtgaccttcaaatgaagatcgggtttggttttggattactttgtcaaatctcaaacttctattgccacatcttgctgaggaatctccggagacccgatgggaacggagggtaccaaatcccgtgcgggtttttattcaatattgtgacgtgtgccaattacacaacagagatttatcaatggcttggcttcaacattgcaacacaaacagttgcaggctatgtctttcttgtggttgctgcttctatcatgaccaattgggcactcgctaagcaccgccgattgaggaggctatttgatgggaaggacggaagacccaagtatcctcgacgatgggtcatactgccaccattcctgtagaagggattcgcaagccagcaatttggagcaacactttaaagttatcacaggtcattcttatcaaatttggtaataatggatcggattttcaccttttctctcaatcttttgccttttaaaggggttaggcctcgatttatctttctattaaatcttatgcggattgatcttaatcttgtagttgtaactggtgcattggatgccttctagactgtctttgatattttaatcggttgcatcattctctctttcaatct

SEQ ID NO: 544 - DNA, 1567 bp, Populus trichocarpa
atcgtcaattaaggatgatggttggctctcctaccccaaccacacacctttaatgcacaagcacgagcacttgcctacacagtacacactgacactgctatttctattatttgtcttgcggagacatcgaagaaccaaatcccatttggagcttcagttccgagtttctagttctgtccgaatcttgaacagaattctttgaaattcaaagggtttgctttttctgacatttggcgaaccgtgtctcgctcatttgatcttcagaatgaaggtgaccgtagtttctcgcagtggtagagaggtcattaaagggggccttgagcttagtgattcggcaacagtggctgatctgcaagaggctattcataagcgaaccaaaaaattctaccctgcaagacagcgactgaccctacctcttccaccggggtcaaaggaaaggcccactgtactcaactacaagaagaacctcaaagaataccaagatgggaatttagacagcttaactattcttttcaaggacctgggtccgcaagtttcctaccgcacactctttttctttgaatacttgggtcctttggtgctctatccttttttttactacttcccagtctaccagtttttgggctacaagggagagcatatcatgcacccagttcagacatatgcattgtactactggtgcttccactatttcaaacgcatcatggaaacattttttgtgcaccggtttagccatgcaacctctccgctctccaatgtgtttagaaattgtgcttattattggacctttggttcctatatcgcttactacgtgaaccatccactttacacccctgttggtgatcttcaaatgaagattggctttggctttggcttggtttgtcaacttgcaaacttttattgccatatcttgctgaggaatcttcgccgtccagatgggaatggcggctatcaaatcccaagtggatttctcttcaatattgttacatgtgcaaattacacaacagagatttatcaatggttaggtttcaacattgcaacccagactgttgctggctacatttttctcgtggttgctgcttccatcatgaccaattgggcccttgcaaagcatcgaagattgaagaagctattcgatggaaaggatggaagacctaaatatccacgcagatgggttatactgcccccagtcctgtagattaactggtatctcagccacaagtcagctgctttggtgtgtcgtctaatttgttatcaggaatctcatgtttcggtgcttgtctagtagaaagtggagttcacgttcccattcaattgcccgaggatcgtaggcttttattctagacagcttaaattaatggaaacttagcaacgaggatagttcgtcgtcaaacctttatttcctttcttgtattgaattatttggaatagttttttgaatcgtattggtttagctaatttgttgaaatggtggcttcgttacgatgtttggtacttttttatttcttttatttccattcgcttgctgttgatgccaattaaggccatgtagcagttgtttactgag

SEQ ID NO: 545 - DNA, 1499 bp, Papaver somniferum
atcgttggttctcctaccttccaactactcacccttaaaaccctggacagagaaactatgtactggtcaaataaataagaactgtcattcaaatctcaattctttacagctcgacaaatcaaattcaaactagggttaggcaatttaatcaataaactaactacccattttctccgttgtctctaaaacaaaaaagagagattggattgagattcaatttgtgtggagaaatatgaaggtcactgtggtttctcgaagtggtagagaaatcatcaagggtggaattcaactcaatgattcggctactgtgagtgatctacaggaagctattcatgctagaacaaaaaagtactatccttcgagacaacgtctcactctgcccctcaatcctggatccaaggacaaacctactgtcctcaactccaagacgagtttatgtgattactgtgatgctaagaaggataacctgacagtggtgttcaaggatcttggtccacaggtttcataccaaatacttttcttctgggaatacgtcggccctctagttatctatcctctcttttactacttaccagtgtacaagttcttaggctacaaagaggagcgtgtaattcgcccagtccagacctacgccatgtattactggtgtttccactacttcaaacgtattatggaaacattcttcattcacagatttagccatgcaacttctcccatttcgaatgtctttaggaactgcgcatactattggtcatttggtgccttcatagcatactatgtgaatcacccactttacaccccagtcagcgacctccaaatgaagataggctttgggtttggtataatttgtcaagtttctaacttatactgccatctcttactaaggaatcttcgaagccccagcggtaatggaggataccaaatcccatatggatttttgttcaacatagtgacttgtgcaaattacacaactgagatctaccagtggctgggtttcaacattgcaacacagactgttgcaggttatgtattccttgtggtcgctgcttccatcatgtctaactgggcacttgcaaagcaccgacgtctgagaaggttatttgatggcaaggagggaaggccaaaatatcctcgaagatgggttattcttcctccattcctctgaaaatttcagtgagacacctgcctccagtgagtccagtcgatatccagctgcaaagtaagattagtgaattctcagtactcgttgaatataaactattcacgtgtctgtaccaccttaatcatgtctcgccaaatttcttgttaatttgaatcagatcagatcctgtaggttttacagaaaagttagaccttccgttttcttttatttatttttaatgacaattgtggaactagcgagttcatctaattcatgtaatttattgtacttgagctattttgaaggttcctttgatgatgagattcattttcatataaaagaggtaaaaattcaatcc

SEQ ID NO: 546 - DNA, 1276 bp, Papaver somniferum
ctaactacccatttcctccattgtctctaaaacaaaaaagagagattggattgagattcaatttgtgtggagaaatatgaaggttactgtggtttctcgaagtggtagagaaatcatcaagggtggaattcaactgaatgattcggctactgtgaatgatctacaggaagctattcatgctagaactaaaaagtactatccttcgagacaacgtctcactcttcccctcagtcctggatccaaagacaaacctactgtgctcaactccaagactaatttatgtgattactgtgatgctaagaaggataacctgacagtggtgttcaaggaccttggtccacaggtttcgtaccaaatacttttcttctgggaatatgtcggccctctcgtcatctatcctctcttttactacttaccagtgtacaagttcttaggctacaaagaggagcgtgtaattcatccagtccagacctatgccatgtactactggtgctttcactacttcaaacgtattatggaaacattcttcattcacagatttagccatgcgacttctcccatttcaaatgtctttaggaactgtgcttactattggtcatttggcgctttcatagcttactatgtgaatcacccactttacaccccagtcagtgacctccaaatgaagataggcttcgggtttggtatactttgtcaagtttctaacttatattgccatcttctacttcggaatctccgtagccccagcggcaatggaggataccaaatcccatatgggtttttgttcaatatagtgacttgtgcaaattacacaactgagatctaccagtggttgggtttcaacattgcaacacagactgttgcaggttatgtattcctagtggttgctgcttctatcatgtctaactgggccttggacaaagcaccgacgtctaagaaagttatttgatggcaaggagggaaggccaaagtatcctagaagatgggttattcttcctccattcctctgaaaaattctgtgagaaatctgcctccagctacaaagtaagattactgaatggtcagtactctttgaatgtaaacccattcatgttgatttaatctgtttccttgtctgtatgtctctccaaattcctagtttattttgaattagatcaatttctgtaggttttgcagaaaagttagacctccaattatatatctcgtctttttatgacaattgttaaactagagatgcatcaatttgtgtaatttactgtaattgaggtattttgaa

SEQ ID NO: 547 - DNA, 1142 bp, Raphanus sativus
aatctcctcatccgtgtcttcctcgttttctccgctttaagccatgaaagtcaccgtcgtctcccgcagcggcagagacgttctcaaagcccccctcgacctccccgattcggcgactgttgctgatctgcaggaagcttttcacaagagagctaagaagttttacccatcgaggcaaagactgactcttcccgtggctcctgggtcaaaggacaaacctgttgtcctcaacagcaagaagtcactcaaagagtactgcgatgggaacacagactccttaaccgtagtcttcaaggacttgggagcacaagtctcgtaccgcacgctcttcttcttcgagtacctaggcccactcttgatctaccctgtcttctactacttccctgtttacaaatacctcggctatggccaagaccgtgtgatccacccggtccagacctacgctatgtactactggtgctttcactacttcaaacgcatcatggagacgttcttcgtccacaggttcagccacgcaacttcacctatcgggaacgtgttcaggaactgtgcttactactggacctttggtgcttacattgcgtattacgtgaaccatcctttgtacacaccggttagtgaccttcagatgaagattggtttcgggtttggtttggtttgccaagtcgcgaacttctactgtcacattctgttgaagaatctcagagaccctagtggagctggagggtaccagatcccgcgtggtttcctcttcaacattgtcacgtgtgctaattacacgaccgagatttaccagtggctaggattcaacatcgctactcagaccgttgcaggatatgtttttttagctgttgctgctctgattatgaccaactgggctcttggcaagcacagccgtctgagaaagatatttgatgggaaagatgggaagccaaagtatccaagaagatgggtcatattgcctccattcctgtagaagactcatcgttgtgatcttcgttctatcagtttaaaagctttcttaataagcttgtaaaagagatttgaaagatgttcgctttcctctgtatttgttatcacttttgttttgacatgtttttaagtttagagattttagacacttgcttctttaatcgtttctc

SEQ ID NO: 548 - DNA, 1305 bp, Tripterygium wilfordii
cgcagcttctgatcttttgggaagtcatttcgagaattgggtttctctccaaaatgaaagtcactgttgtttcacgcagcggtagagaagtcatcaaaggaggactcgaggtcaatgactcggcaacggtggctgatctacaggaggcaatccatcggcgaactaaaaagttctacccttcaaggcagaggcttaccctcccccaaaaacctggaatgaaggagaggcctgttgtccttaactataagaagagtctcaaagaatactgtgatgggaatgcagagaacttaactgttgtgttcaaggaccttggcccacaagtctcctaccgtacactttttttctgcgagtattttggtcctctcttcctctatccagtcttttattacttccctgtgtatcaattcttcggctaccagggagagcgtgtcatccacccagtgcagacatatgctgtgtactactggtgtttccactatttcaaacgtattatggaaacattttttgtgcaccgtttcagccatgcaacctcgccactagcaaacgtgttccgaaattgtgcttattactggtcttttggttcttacattgcatattatgtgaaccaccccctctacactcctgttggtgacctccaaatgaagattggctttgggattgggttggtttgtcaacttgcaaatttctattgccacattttattgaggaatcttcgtagccctgatgggaatgggggatatcagattccacgaggatttctcttcaacattgtgacttgtgcgaattacactacagaaatttaccagtggctgggattcaatattgcaacacaaactgttgctggttatatctttatggtagttgctgctcttatcatgaccaattgggcccttgcaaagcaccgtcggttgaagaagctgtttgacgggaaggagggaaggcctaaatatccacgacgatgggtgatattgcctccatttctgtagaaattacttgtgatgctgcctcgctcagtcccttcatacctggtttgtaatcagctgcatcaataatgacttgtatcaagttccattctggtcacgtgcaaaaagtcttggatccattttggaagcaaatttctccgagttgttgggatacttatctgacgtttctttctttcttttgttttgctttcattttgtgcaagtatctgacgagtggcttagtttgattaatttattggattgcacctcaaaaagatgatccttgatatgtagctagtagtttattttatgtagaattgaatgtatttgagtcatgtaccct

SEQ ID NO: 549 - DNA, 1672 bp, Citrullus lanatus
ctttgattcactaatccatggcaaatttttgctgcaattaagaatttatgttcacgttcatcccaataaatttattcagttgggtgtcggcctccatcctcacaagccgaacgatgtgtcgaattgcaataaggagatgattagcgacacggttcatcggtcatcggaattagctctcctaccccaactgcaccccatttaatagcctacttcccaacctcccacttcaaacccagaaactttttccaattttaaattcacacccatttgcggatctcttcatatagccatttcttggttctgggtcttctcattctgctcttttcaggatctgggtacaaataattggcttacttcctcaactggttctctaaattggctgcaaaaatgaaggtctcggtagtttctcgcagtgggagagaggttgttaaagggggtattcaactgagcgactctgcttcggtggcagatctacaggatgcgatttataagcgaaccaaaaagttctacccggctaggcaaaggttaactcttcccgttcaacctggttcaaaggagaggcctactgttctcaactacaagaaaagcctccaagaatattgtagcgacaactcggacaacttaactgttgtcttcaaggacttgggcccacaagtttcttatcgtacactctttttctgggaatatttgggtcccttgatcctctaccccatcttttactacttccctgtatatcagttctttggctacaaggcagaacgtgtcattcatccggttcagacgtatgcaatgtactactggtgttttcactattccaaacgaatcatggaaacatttttcgtgcatcggttcagccacgcaacctcaccactttcgaatgtgtttcggaactgtgcttactactggtcctttggctcgtatattgcatattatgtcaatcacccactttatacccctgttggtgaccttcaaatgaagattggctttgcatttggtttgctgtgtcaagtgtcaaacttctactgtcatatcttgctgagaaaattgcggagccctgagggcaatgggggatatcaaatccctaaagggtttctgttcaacattgtgacatgtgctaattacacaaccgaaatatatcagtgggtaggcttcaatctagctacacagactgttgctggttatgtctttcttgtggttgctactcttatcatgaccaactgggcccttgcaaagcaccatcgcctcaagaagttgtttgatgggaaagagggaaggccaaagtatccacgcagatgggtgatacttcctccatttctgtagaaggatttagtggcctcagtatccattcaacctcaagctggtagctttagattaaaagtgtcccttgaaagacatagacaaggcacagacatcattttttccaaatgcaatttatgttcttttgttgttgacttaacattatggacaatggtccttttgttttgctttggcatttagtgtaatgttggtgattgatggttgcatgttttcttttcatacatagcctttccaactctctctggttgttgttcttttatgttagtttgaggagacattctttctatttcttttttgttttgacatattttagatgttttaagtttattgttctaacagaactttggcaccacaa

SEQ ID NO: 550 - DNA, 1534 bp, Phaseolus vulgaris
agctgtccaaccccaactgcatcacattaatgtttgaatgtgcatatgcatgtcttcatcttctactcaccacacttcacattaattcatcatctcccatctttaatctttatctatataaatatattatattcaaattcaatttttgtaagctaacatttcctttctgtttgtcagtagcaacaactgtcaaacacacacacacacatcctttcttcttctctctctgtccaattctgacccatagtgctctcggatcttgcatatcgcaaagatgaaggtcactgtggtttctcgcagtggaagagaagtggttaaaggtggtattcacctcagcgattctgctactgtagcagatctgcaggaggcaattcataagcaaaccaagaagtacccatcaaggcagcgcttgacacttcccgtccaacccggatcaaaggaaaggcctgttgtccttaattacaagaagagtctgcaagactataccagtggaaactcagactccttaactgttgtattcaaggacttgggccctcaagtttcttatcgaacactttttttctgcgagtatttgggacctttgcttctctacccagtgttctattatttccctgtttacaaatattttggttacaaaggtgaacgtgtcatccaccctgtgcagacatacgccttgtactactggtgcttccattatgccaaacgaattctggaaactttttttgtgcatcgcttcagccatgcaacctcacccctttccaatgtgttccgtaactgtgcttattactggacctttggatcatatattgcttattatgtgaaccaccctctttatactccggtaaacgacctccaaatgaagattgggtttgggtttgggatactttgtcaaatttcaaatttctattgccatattatactgaagaatctccgcagccctggtggtgaaggtggataccaaatcccaaaaggctttctcttcaatattgttacctgtgcaaattacacaaccgagatctatcagtggctgggcttcaacattgcaactcaaactgtcgcaggttatattttccttgcagttgctactttcatcatggccaactgggctcttgccaagcacaggcgtttaaagaagttatttgatggaaaggaggggagacctaggtatcctcgtcgatggataatattgcccccattcctgtagaagccaaagcaactgatcagaccagtactctgctcacaggattctgagatttatagttgtagcataatggaattttcgtgatctcttttcattaaatatggatttgtcttgcaatgcttttgactacgaagttgattactaaattgtttaatcagtgttttaaagaatatttgtaatcatttcaagattgtagttctgaggacccctgtttcttcaaagtcttcatcttgtgataaccgtattcattttgctgtttaatatttgttggctactttactgtttccaaattattatcattttagaaaatgaaagctcatttttctagctcat

SEQ ID NO: 551 - DNA, 1396 bp, Catharanthus roseus
atcaaatccccaccgttgccttctctctctataaacccaactgctcactcccaaacttcccgcattcaaatctctctctctcttcatagtccattctcttacagctatatcttctcccagatcttccaaccaaaatcagtcatcgtcttcaaggatgaaggtttctgtcgttactcgtagcggcagagaactcgttaagggtggccttgagctcaatgattcagctaccgtcgctgatttgcaggaggcaatccataagcgaaccaagaaatactatccttcaaggcagagacttactctccctctccaacctggatcaagggagaagcctactgtacttcaatataaaaagagtctcaaagagtacagcagcgggagtgaaaatcagttaactgtggttttcaaggacctaggtccgcaagttaaatacagcacactgttcttttttgaatacttgggtccacttgtcttgtatcctgttttctacttcttcaatgtctaccaatacctgggattcaaaggggagcgtgtcatccacccagttcagacatatgccctatactactggtgtttccattattccaaacgtataattgagacattctttgtccaccgtttcagccatgccacttcaccactttccaatgttttccgtaattgtgcttattactggagctttggctctttaattgcatactatgtcaatcatcctctttacactccggtaagcaatctccaaatgaaaattggatttggatttgggttggcttgtcagattgcaaacttctactgccacatcttgttgagaaatcttcgaagtactgatggcagcggagggtaccaaatcccccgtggcttcttgttcaacattgttacctgcgcaaattacacaaccgagatctaccagtggctgggattcaatattgcaacacagactgtagctggctatgttttcatggttgttgcagcttccataatgactaactgggcccttggaaagcatcgacgtttgagaaagatatttgacggaaaggatggaagaccaaagtatcctcgaagatgggtgatattgcctccattcctgtaggaagcaactggaagagcaggcacaatctgtgttcattgatgagatcatgaatttagctttacatctcaaaacatgctcatttcggattaaattattagatcagatttattcatttcctcttttcatatgatgatagattgattaacaatgggaaatgtaatgaatctgagatgctagattagccctttcttgctttctattagatgatgatctttgacttgttacatctgaattggctttattaagatcatcatcttaaacaaatcatgtaactgcagatttgtttgtctaaagatacgattcattttc

SEQ ID NO: 552 - DNA, 1192 bp, Cleome gynandra
gtttggatcgttagttctcctacttccccaactacacgccttcaatgccgtctctctcaccttcatcctctctataagtttcttcctttcttcttctctctccgccttcttatacgggttttgaagcttcttcgatttcttcgactgggtcttcctcgttttctcctgaaactatgaaggtcaccgtggtttcgcgcactggcagagatgtcatcaagggtggtctggacctccctgattcggcgacggttgctgatctacaggaagcaattcacaagagaaccaagaaattttacccttctaggcaaagactaactctcgctgtggctcctggatctaaggagaagcctgtcgtcctcagcagtaggaagtctctcaaagattattatggtggaaacacagatagcttaaccgtagtcttcaaagacctgggccctcaagtttcctaccgcactctcttcttctttgagtatctcggtcctttgtttatctatccaatcttttattacttaccggtttacaagtactttggctatggagaggagcgtatgattcatcctgttcagaaatatgctatgtactactggtgcttccactactttaaacggattcttgaaacattcttcattcatcgcttcagccatgccacctcacctctctcgaatgtgttccgcaactgtgcttattactggacatttggtgcttacatagcttattatgttaatcacccgttgtacacccctgttagcgacctccagtggaagattggttttgggttcgggttggtttgccaggttgcaaacttctactgccatattattctaaagaaccttcggagtcctgatgggagcggaggctaccagattcctcgtggtttcctcttcaacgttgttacatgtgccaattatactaccgagatctatcagtggctcggattcaatatcgccactcagacagttgcaggatatatcttccttgtcgttgcctctcttatcatgaccaactgggccctcgggaagcaccgtcgtctgagaaagctattcgatggaagagacgggcggccgaagtacccacgcagatgggtgatactgcctccattcctctagaagaaaacactatgccattgttgtgagcctcatttaatgagtcaagtagatcataacttctctgtgtatctgctcagtacttgttt

SEQ ID NO: 553 - DNA, 1423 bp, Echinacea purpurea
aagaaaccatagatatcaagtggcacacgtgcgtggttcttgaatagcgttaagatgtagttagactaccctttcatccacatttattcaggctcgttcgccagtggttgcatctgctcatctacccaaccatacatctttaaaatccattaaaatcactcatatttcatcaatcccagatctcaaaacatcccaattattaccattgttttctccgctcaattccagttcctaatcgccggaaagatgcaggttaccgttactacaagaagtggtagagaactaatcaacggtggccttgttcttgactcctctgctactgttgctgatttgcaggaagcaattcatcagcgaatcaagaaatactatccatcccgacaacgtctgaccctacccctccaaccgggctcaaaggaaaaggccgttgttcttcaatccaagaaaagtctaaaagagtatacagatggaaactctgacacccttactgtagtgtttaaggatttgggcccacaagtttcataccgcacactcttcttttttgagtatttgggcccgttaatcctctatcccgtcttctactacttcttcccagtgtaccaattttttgggtacaaaggcgaacgggtcatccatccagttcaaacatatgcattatactactggtgtttccactacttcaaacgtatcatggaaactttctttgtgcaccgtttcagtcatgcaacttcacctctttcaaatgtgtttagaaactgtgcttattactggacctttgggtgttacattgcttattatgttaatcatcctcattacacacccgtaagtgacctccaaatgaagattggatttgggttcgggttgattatgcaatttgcaaatttgtattgccacatcatactcagaaatctcaggagcccgagtgggaatggagggtaccaaattccacgagggtttttgtttaatattgtgacttgtgcgaattacacaactgagatttatcagtggttgggttttaatatcgcaacacagactgttgcgggttatatctttcttgtggttgctgcttccattatgactaattgggccctggctaagcatcgtcgtctcagaaggctctttgacgggaaggaaggaagaccgaagtaccctcgccgatggataatattgccaccgttcctgtaaacgactgcaaacacgaacgtgtgctgtacctcatcttcctttgttttggatttggttgtatcctgagcttattcgagtcaaacagattgtttagaacttttgttccttttgaattgtgaatcatacagctgaattgtatttgttagttttgaatcttttatctttgtggtatctggatctttagcaactttgcatgatactgatgtgtttcttgcaatttaaatatgcctttatttacgtc

SEQ ID NO: 554 - DNA, 1401 bp, Flaveria ramosissima
ttcacaacagaggctaacgtcagttagttgcctctgctcatctacccccaactacacgcctttaaaactctatcaaaaccacacttcatccataaattaacccaacaatccccatttctccaatcacttcatctcagatctaatctccaccattgttttctccctttttctcttcaattcctttatcttacagcttccgatcgccggaaaagatgaagatcaccgtcactacacgaagcggtagagagctaatcgacggtggtcttgttcttgatagctccgctactgtggcggatttgcagaaggcaattcatcagagaatcaagaaatactatccttctagacaacgcctgaccctgcccctggaaccgggctcaaagaagaagcctgtagttcttcaatacaagaaaagtcttaaagagtacacaagtggaaactctgacgacattaccgtagtgtttaaggatttgggcccacaagtttcataccgaacactcttcttttttgagtacttgggcccattaatcctctatcctgtcttctattacttcccagtgtaccaattttttgggtacaaaggtgaacgggtcatccatccagtccagacatatgccatgtattactggtgtttacactatttcaaacgtatcatggagacctttttcgtacaccggttcagtcatgcaacttcacctctttcaaatgtttttaggaactgtgcttattactggacttttgggtgttacattgcttattatgttaatcatcctctttacacacctgttagtgatctccagatgaagattggatttgggttcgggttgattatgcaagttgcaaacttgtactgccacatcatactaagaaaccttaggagcccgagtggggatggagggtaccaaattccacgagggtttttgtttaatattgtgacttgtgcaaattacacaaccgagatttatcagtggttgggatttaatatcgcaacacagactgttgcgggttatgtctttcttgtggttgctgcttccatcatgactaattgggctctggctaaacatcgtcgtctcagaaggctctttgatgggaaagaaggaagaccaaagtaccctcgccgatgggtgatattgcccccattcctgtaagcgactataaacatgggttgtatgtcattttcaatggctctggtttatcagtgagaattggttctatcatgagtttgtttttagtcaacatatgttttacttgtttagaacttttgtttctttttgaaatgtgaatcataccatgtgtgattgccacatagtactttttgaattagctgatttgtatttgcaagtttgagtctttctttcatgtgatatggatgttcctcaaatttgcaaaatcatgatgtttttc

SEQ ID NO: 555 - DNA, 1526 bp, Ipomoea nil
gagcagataggtttattcaatggaggaaagcaaggtagttcatcggcccaactactcgccatttattgttcaaccacgccattgaagcttccgtttcctcgcatacaaaaaacactcctctcccagcttctccttcgcagattcagtagaaatgaaggtcgtcgtgaacagccggagcggcagagaactcatcaagggcggccttgacctcgccgataccgctacagttgccgatctacaggaacaaattcataaacagactaagaaatactatccttccagacagcgacttactctccctcttccgcctggctcaacacagaggccaactgttcttcactacaaaaagagtcttaaagagtatactgatgggaacaaaaatgagttaactgtaatttttaaggatcttggtccacaagtcagctatcgcacacttttcttctttgagtatctgggtcctctgattatctatcctctcttctattacttgccggtctacaagttctttggctatgaagggaagcgtgttatccacccagctcagacatatgctatgtattactggtgctttcattactttaaacgaatcttagaaacattctttgtgcaccgatttagccatgccacttctccgctttccaatgttttccgcaactgtgcctattactggtcctttggcgctttcattgcttactttgtgaatcacccactttacactcctgtaagtgatctccaaatgaagattggctttggctttgggttgatatgtcaagtttcaaacttttattgtcacctactgttgagaaaacttcgaagtcctgatggtagtggagggtaccaaatcccacgtggattcttgttcaacattgttacttgtgcaaattacacaacagagatttatcagtggttaggatacaatattgcaacacagactgttgcaggctatatcttcatggttgttgctgctggcatcatgactaactgggcacttgcaaagcatcgtcgtctgaagaagctatttgatggaaaagaaggaaggcctaaatatcctcgccgatgggtgatcttgcctccattcctgtagatccagcatctaccatttcagtaaaggattaagaagtcaattcttattagcaaattacaattgccaatcagttttttcccgttgttgctttttcctgtttcgtacccaactgtaatgctcgacatttctgatagttatggttcactactatacgtattctcttctttttgccgccttcaatcagatcatcctgagggtctcaaaattcagagatagcattgcaaagctggccagggagaaacgtccaactctctacatgtttgatatgtataagaatgctcctatttctgcctcatctgtttgtcatttttctaatttaaaatataggaagaatcgacaggatatatgttatgcaatatggtcggtcggggtcggcaagtgtggggtatagaaccttggcctaaatcaaacttcagctgcagtttatatttgtactaaatct

SEQ ID NO: 556 - DNA, 1747 bp, Prunus mume
ggataggatggatagttaaaaccatggcccaccgaagcaagccctattccaaacttgatcagtagtgtagttttcgtttagctggaggttggagtttggggggttaagtggtgttgttgatcagcctccatagttagttaccctaccccaaccgtacgccattaatttctacatccgaaatcgcccaaaccaactcctactctacactaaactgcacacccaaacaaattcaatattcaacatcatcgtcgttattaaagagagccttagcctgcaaccattttcggatctcactctcaatctcatttctttttctttcttctcattcattcgtgctctgcaatttgaatggaagttgcgtgattttgctcacggcttaaagggtttgcttcttgctcgatttgctgaagtgggtctctctcacttgctctgaaaagatgaaggtgaccgtagtttcacggagtggtcgagaagttgttaagggtggccttgagctcagtgattctgccactgtgactgatctgcaggaggcgatccataagcgaaccaaaaagttctatcctgcaaggcagcggcttactctccccgtccaaccaggatcaaaagagaggccagttgtccttaactacaagaagagtctcaaagattatatcagtgaaaactcagacaacttaactgtggtgttcaaggacctaggcccacaagtgtcctataaaacactcttcttctttgagtatttggggcctttggtcctttatcccatcttttactacttcaatgtttaccagtacttgggcttcaaaggagatcgtgtcatccgcccagtccaaacatatgctctatactactggtgcttccactacttcaaacgtattatggagacattttttgtacatcgcttcagtcatgcaacctcaccactcttgaatgtattccggaattgtgcttattattggagctttggctcctacatagcttactatatgaatcacccactttacacccctgttagtgacctccaaatgaagattgggtttgctgtggggataatatttcagatctcaaacttctattgccatatcctgctgaggaacctgcgaagccctgatggaaatggaggatatcaaattccacatggttttctgtttaatattgtgacatgtgcaaattacactacagagatctatcagtggttgggcttcaatattgcaacgcagacagttgctggttatgtcttccttgtagttgctgcatctatcatgacaaattgggcccttgcaaagcaccaccgtttgaagaagatatttgatgggaaggacgggagaccgaagtatccgcgtcgatgggtgatactacctccattcctgtagaattgactggcgactaggctgtcctgcctttgctggtcttttgggtattcaagtgttggatttcatccatgctggatgggtgatgaacttgaagaagtcgaaatcgcatgttcactcaagtccatgatggaccttaacattctgcttagatgttgtaattcatttgaactagttagggatttgcttgtggatctatacaagataggtcaccttgttctttccagttgaactgttttgtcatttgtacttcttgaccgtctatgacatttctgtttcttataattttagaattcaaagcaataatgttgttaacttgttaaatatatcaatcatcataaaattaaacaattaaatggaggttgtcaatcttgcatgaa

SEQ ID NO: 557 - DNA, 1369 bp, Glycine max
gaaatattattagttattcattcttaggttggacagtaaagacccctagttctgttggatcttgcatatagtaaccctttattgattcgcaaagatgaaggtcacagtggtttctcggagtggaagagaagtggttaaaggtggcattgagctcagtgattctgctactatagcagatctgcaggaggcaattcataagcgaaccaagaagtacccatcaaggcagcgcttgacacttccagtccaacctggatcaaaggaaaggcctgttgtccttaattacaaaaagagtctgaaagactatacaagtggaaattcagaaaccttaactgttgtattcaaggatttgggcccacaagtttcttaccggacacttttcttctgcgagtatttgggacctttgcttctctatccagtcttctattatctccctgtctaccaatattttggttacaaaggtgaacgtgtgatccaccctgtgcagacatatgccttgtactactggtgtttccattatgccaaacgaattctggaaacattttttgtgcatcgcttcagccatgcaacctcacccctttccaatgtgtttcgtaactgtgcttattactggacctttggctcctatattgcttattatgtgaaccaccctttatatacccctgtaaatgacctccaaatgaagattgggtttgcaattggaatactttgtcaaatttcaaatttctattgccatattattctgaagaatcttcgtagtcctggtggtgaaggtggataccaaatcccaaggggctttctcttcaatattgttacctgtgcaaattatacaactgagatctatcagtggttgggattcaacattgcaacacaaactgttgcaggctatattttccttgtggttgctacttttatcatgaccaattgggctttagccaagcacaggcgtttaaagaagttatttgatggaaaggaagggagacctaggtatcctcgtcgatgggtaacattgcccccattcctgtagaagccaaagcaactgatgaagtcaccactctgctcacaggattctgagatttaaattgtagcataatggaattttcgtgatctctttttataagatatggatttgtcttgcaatgcttttgactatgaagttgattgctaaatcattgaatcagtgttttgcagaatatttgtaatcatttcaagattgtagttctgaggattcttgtttcttcaaaatcttcaccttgtttctgtttaatttatgctggctatttccttttactgtctccaatgtttcattaatcattttagaaaattaaagttcaattttgtagctcatacactatgcaatgatgaggcttca

SEQ ID NO: 558 - DNA, 1399 bp, Solanum lycopersicum
gaacattgattttgaaggagatggtagttcatcaaacataaaattggttcgttcagctactttctacccaactactataccgccattaattgcttgctattactacttatctagaaccgtcaaagatctcacattcgtcatcatttctcagaaaaattgttgtttttcgtagatcccaaagtttggggagcgaaaatgaaggttttagtggttacacgtagcggcaaagaactcatcaagggtggacttgaactcaatgagtcggctacagttgctgatctgcaggaggcaattcataaacgaaccagaaaatactatccttctagacaacgactcactctgcctattcaacctggttcaaaagagaggccaactgttcttcactaccagaagagcctaaatgagtatactaaaggtagcacaggcgaattgactgtagttttcaaggatctaggtccacaagtcaagtatagtactcttttcttctttgaatatctggggcctctgctactctatcctatcttttactacttcccagtctacaagttttttggttacaaagaagagcgtgttatccaccctgtccagacttatgccttgtattactggtgtttccactacttcaagcggatcatggagaccttctttgtgcaccgtttcagccacgccacttctccaatttccaatgttttccggaactgtgcctattattggtcttttggagctttcattgcttacttcgtgaatcatcctctttatactcctgttagtgatctccagatgaagattggatttggatttgggatagtttgtcaagtggcaaacttgtattgtcatttattgttgagaaatcttcgaagtcccagtggtaatggaggttaccaaataccccgtggcttcttgttcaatattgtcacctgtgcaaattacacaacagagatctaccagtggttgggcttcaacattgctactcagactgttgcaggctatatcttcatgattgttgctgctagcattatgactaactgggctcttggaaagcatcgtcgtctgaagaagctctttgatggaaaggaaggaagaccaaagtatcctcgacgatgggtgatattgcctcctttcctgtagaccatttcctcgacgatgtgagaaaaagcccaagacttatttatttagttgatcattttctgtgaacctgcaaacttttgaaggtttatgtttctcactaaaggaagcaatactcagatttttcttttgtattactgttccatgtcttgcctctttttataccagatgatctgacttccatgatattttgtagttcccacttctttgtgatggcttcaagaaccatctttgtttaatctattgtttatgagttatgaaagtgatccttata

SEQ ID NO: 559 - DNA, 1669 bp, Trifolium pratense
atggaaattggtatgttaaatggatgatgacaagtctaaccagttagtagttgtcctaccctaaccatattccattaatgcatacataaactcatacctcacctcatcttctactaaccatacctcacattcattttcccttctccttcataaattctccatatttctatccaattattaaaacccctcattttctttgtaattcccaattgggtctttgatactaagtttttctgggttatagttctgttggatcttgaatataatctttcagtgatttgtgtgaagtgtgttgctgacactgtttggtgaagtgggtgtgttttggttttgaagatgaaggtcactgtggtttctaggagtggaagagagattgttaaaggtggaattgagctcaatgattctgctactgtagcagatctgcaggaggcaattcacaagcgaaccaagaagcatccatcgaggcagcgcttgacacttcctgtccaaccaggatcaaaggaaaagcccgttgttcttaattataaaaagagtctgaatgactatacaagtggaaattcagaaaccttaaccgtaacattcaaggacttaggtccacaagtttcttatcgtacactattcttcttcgagtatttggggccgttgcttctctatccagtcttctattacttccctgttgtctaccagtattttggctacaaaggtgaacgtgtcatccaccctgtgcagacatatgccttgtactattggtgtttccattacgccaaacgaattctggaaacatttttcgtgcatcgcttcagccacgcaacctctcccctttccaatgttttccgcaactgtgcgtattactggacctttggcgcgtatattgcttattatgtaaaccatccactttatacccccgtaagtgaccttcaaattaagatcgggtttgggtttggggtactctgtcaaatttcgaatttctattgccatattatattgaggaatctccgtggacctgctggagaaggtggatatcaaatcccacgtggctttctcttcaatattgttacttgtgcaaactatacaacagagatctaccagtggttgggcttcaacattgcaacgcaaaccattgctggttatatattcctcgctgttgctacttttatcatgaccaactgggctcttgctaagcacaggcgcttgaagaagttgtttgatggaaaggaagggagaccgaggtatcctcgccgatgggtgatattgcctccattcctgtagaagcctaagccactagcaattacgaggtcaccgttatgtgctcacaggattctgagacttagaaatatagcataatgaacctttagtcaattattcctctagatatgaatttgtctttcaatgtttgatctatgaagttgatttccaagttatttcaagttgtttttattggatatttgtaatcgtttatcttattgaggaatcttgtttcttaagaatcttatttgatgtttctattgtattttggttggcttcctcctttaatgtctgcataataagagttcaatttctagctcaaacacagcaacgctaaaacttcaaaattactggtcttttaatatatttttcccctaaatttgtattttttaacaagatcaaatagaaaagctgatttgagttt

SEQ ID NO: 560 - DNA, 1311 bp, Arabidopsis thaliana
actcccaactacatcctcttcaatgctcaatctcgtcttcttcttcctctctatttaatttcccttgtctctctatctctctcaatttcctcatctgggtcttcctcgttttctccgcttaagcaccatgaaggtcaccgtcgtctcccgcagcggcagagaagtcctcaaagctccccttgacctccccgattcggcgactgttgctgatctgcaagaagcgtttcataagagagctaagaagttttacccgtcgaggcaaagactgactcttcccgtgactcctggatcgaaggacaaacctgttgtcctcaatagcaagaaatcactgaaggagtactgtgatggaaacaacaactccttaactgtagtcttcaaagacctgggggcacaagtttcctaccgcacactcttcttcttcgagtatcttggccctctccttatctaccctgtcttttactacttccctgtttacaagtttcttggttatggagaggactgtgtgatccatccggtccagacgtacgctatgtactactggtgctttcactacttcaaacggatcttagaaacgtttttcgtacatcggttcagccacgcaacctccccaatcgggaatgtgttcaggaactgtgcttattactggagctttggtgcttacattgcttattacgtcaaccatcccttgtacactccagttagtgaccttcagatgaagattggtttcgggtttggtttggtttgccaagtcgcaaacttttactgtcacatattgctgaagaatctgagggaccccagtggggctggaggctaccagattccacgcggtttcctcttcaacattgttacatgtgccaattacactaccgagatttaccaatggctaggattcaacattgctactcagaccattgcaggatatgttttcctcgctgttgctgctctaatcatgactaattgggctcttggaaagcacagccgtctgagaaagatatttgatggaaaagatggaaagccaaagtatccaagaagatgggtgatacttcctccattcctttagaagccattgttgcttatcagtaaaagctcttaataaagctgaaaatgagactttctttgggttctctgtatcgtttccttttttgttcggtctatgtattggttataacatgtttattccttttgtttcaatatgttttgatttttgaagttagagagatttagaaatgtacttgtgtagttgtttctcacgcaaaccaattcctctttatgtatcgcatacatgagtcaataataaatatgattactagt

SEQ ID NO: 561 - DNA, 1387 bp, Musa acuminata
cttgtgaaccgtaagcggcgaggaggaatcgaagtacgcctcttccgacccaaactgcgctcattaaagccggccaacgccctcggatcaagtcgagatccgtcggcataaatggtgcagatgagccgtcgtctctgattgtgatccgcgagggccgtccgcttcttctcctcgtttggccgcgctgagttgggcgcattccgaggtcgggaaggatgaaggtaacggttgtttcgcgcagcgggagggaggtcatcaagggcgggattgagctccacgatgaggccactgtgagcgatctacaggaagctatccatgcccgaaccaaaaagtactatccttcaagacagcgacttaccttgccaatgcaagctgggatccagggaaaaccaattgtccttagtccaaagaaaaagcttgtagactattgtgatgggaatgtcaagaatctgactgtggtcttcaaggatttaggagtgcaggtcttatacagaacacttttcttctgggagtacttgggtcctttggttatctaccctatcttctactattttccagtatacaagtacttcggctatgagggtgaacgtgttgtttacccagtccagacatatgctatgtattactggtgtcttcattactccaagcgtatcatggagactttcttcgttcacagattcagccatgcaacatcacctctctccaatgtcttcaggaactgtgcctattattggacttttggtgcatacattgcatactatgtgaatcaccccatgtatacacctgtcaatgatctgcaaatgaagattggttttggatttgggttgatatgccaggtttcaaacttttactgccatatattgttgaggaacctcagaaaccccaatggtaatggtggttatcagattcctcatgggtttttgttcaacatagtgacttgtgcaaactacacaacggagatctatcaatggcttggtttcaatattgcaacccaaacaatagcaggttacgtgttccttgtggtggctgctctcattatgactaactgggccctcgcgaaacaccgtcggctcaagaagttatttgatggaaaagaaggacgaccaaggtatccacggcgctgggtgatacttcctccattcatctaagtaacagctgctttgtcggtacttgcttctagagtttggaacttaaaaagcatcaacatgatatggggatttggaacaacaatcgattaccgaactatgtatttgcaatgtatcactgaaatgtcttcttgagcaagatctctagttgtttgatttcttgatgaacaaacattaaactttatgaactgtcttttaatttactgatgcactgtttcatgcaaggaaacaattttaaaagg

SEQ ID NO: 562 - DNA, 1223 bp, Cleome spinosa
agccattctcatcgattcttcaagcctcttcgatttcgccaactgggtctttctcgttttcgcccttgctggaagccatgaaggtcaccgtcgtttctcgcagtggcagagaagtcatcaagggtggtctcgacctccccgattcccaggggacagttgctgatctgcaggaggcaattcataagagaactaagaagttttacccgtctaggcaaaggctgactcttcccgtggctcctagatccaaggagaagcctgtcgtcctcaacagcaggaagcccctcaaagattattttggtgggaacacggatagtttaactgtagtcttcaaagacttgggccctcaagtttcctaccgcactctctttttcttcgagtatcttggtcccttgtttatctacccgatcttttattacttcccggtttacaagtactttggctatggagaggagcgtgtgatcaatccagttcagacgtatgccatgtactactggtgcttccactacttcaaacggatcctagaaacgtttttcattcatcgtttcagccatgccacctcgccactctcgaatgtattccggaactgtgcctattactggacattcggtgcttacattgcctattatgtcaatcaccctctctacaccccggttagcgacctccagtggaaaattggttttgggtttggtctggtttgccaagttgcaaacttttactgccatatcattctgaagaaccttaggagccctgatgggagcggaggctaccagattccccgtggtttcctgttcaacgttgttacatgtgccaactacactaccgaaatctatcagtggctggggttcaatatcgccactcaaactgttgcaggatatgtcttccttgtggttgccgctctcatcatgaccaactgggccttagggaagcaccgccgtctgagaaagattttcgatggaaaagatggaagaccgaagtacccaaggcgatgggtgatactgccaccattcatctagaagaagatgtcattgttatgagcagccctctctctctctcttgtcggttaagtagaccataaatttgtcaaagaggatagcatcgttgaggatgtttcgtttgtgttattcacgttgtcttgttccttgttttacttcctgtttcgttcccttgtttttagtaggtacacggcagagattcttgttaaaagacttgccatgataagattc

SEQ ID NO: 563 - DNA, 1729 bp, Eucalyptus grandis
catcgcgcacgtaagaaatacaaatcaaacaaaaaaaaggccaaatcagaaaaataaaaaaagctcgagttataatggcgtgtggttcatcagctagatgaggcaacgcattggcagaggcaggggagcagtaccagttggagagttagctctcccacctccccaaccatccgcctttaatatcatcgcccgcgcccatcgctccagctctctctccctctccgtttctgtataaatcgcgtccctcgtctcgcccccccttcgacctgctaccggccatagccaaaatctccccttttcttgccgctttgagcctcggattctcgagctggtttggcggatctggagcgaaatcgccggggggagcagaagggtcgccgtttttctccattcggtgaagtgggtctgtcgtttttgtccatttggtgaggtgggtcggtctccaacatgaaggtctccgtcgtctcgcgcagtggcagggaagtggtcaagggcggcgtcgagctcaacgactcggccaccgtggctgatctgcagaaggagattcatcgcaggaccaagaaattctatccttcgagacagcggctaacactccctctccagcctggatcaaaggagaaacctatcgctcttaactacaaaaagagccttgaaagttacactgaaggaaactcagccaatttaactgttgtattcaaggaccttggaccacaggtttcttaccgtactcttttcttctgggagtacctcggtcccttgatcctctatcccatcttttacttctttcctgtgtaccgctactttggctacgctggggagcgcatcatccacccagtacagacttatgctctgtactactggtgtttccactacttcaaacgaattatggagacatttttcgtgcaccgtttcagccatgcaacctcacccctttctaatgttttccggaactgtgcctattattggagttttgggtcatacattgcttattatgtcaaccatccgctttacactcctgttagtgacctccaaatgaagattggtttcgcatttggggtgctttgtcaagtttcaaacttttattgtcatatcttgctgagaaatcttcggagcccagatgggaatggaggatatcaaattcctcgtggcttcttgttcaacatcgttacttgcgccaattacactactgagatttatcagtggttgggtttcaacattgcgacccaaaccattgctgggtatgtcttccttgtggttgctgcttttatcatgaccaactgggcccttgcgaagcatcgccgcttgaagaagctgtttgatggaaaggaaggaagaccacgatatccaagacgctgggtgatcctacctcccttcctgtaggaaattccacgttatgtcggcatctccatttagctgtggtctgattctggatcagctccttatttagccagcagtcctagacaaatctttgtaatccaactgaattagttttgtctagctgtcgctctgcttctccttttatatgattacatggattatggcgtgaaccttatgggttcaattgttttattggcaaggttctggattgatcttcatgtgctattgcctttccaatgtctattcatttatcatcttttcccacagaacgatgccccttaggctgaacttgcattatcaattatttgtagtgtcaattgtgataacggccatgagctgtcaatattatcgg

SEQ ID NO: 564 - DNA, 1183 bp, Flaveria ramosissima
tcacttcatctcagatctcatctccaccattgttttctccgtttttctcttcaattcctttatcttacaccttctgatcgccggaaaagatgaagatcaccgtcactacacgaagcggtagagagctaatcgacggtggtcttgttcttgatagctccgctactgtggcggatttgcagaaggcaattcatcagagaatcaagaaatactatccttctagacaacgccttaccctgcccctggaaccgggctcaaagaagaagcctgtagttcttcaatacaagaaaagtctcaaagagtacacaagtggaaactctgatgacattaccgtagtgtttaaggatttgggcccacaagtttcataccgaacactcttcttttttgagtacttgggcccattaatcctctatcctgtcttttattacttcccagtgtaccaattttttgggtacaaaggtgaacgggtcatccatccagtccagacatatgccatgtattattggtgtttacactatttcaaacgtatcatggagacctttttcgtgcaccggttcagtcatgcaacttcacctctttcaaatgtttttaggaactgtgcttattactggacttttgggtgttacattgcttattatgttaatcatcctctttacacacctgttagtgatcttcagatgaagatcggatttgggtttgggttgattatgcaagttgcaaacttgtactgccacatcatactaagaaaccttaggagcccgagtggggacggagggtaccaaattccacaagggtttttgtttaatattgtgacttgtgcaaattacacaaccgaaatttatcagtggttgggatttaatatcgcaacacagactgttgcgggttatgtgtttcttgtggttgctgcttccatcatgactaattgggctctggctaaacatcgtcgtctcaggaggctctttgatgggaaagaaggaagaccaaagtaccctcgccgatgggtgatattgcccccattcctgtgagcgactataaacatgggttgtatgtcattttcaatggctctggtttatcagttagaattggttctatcatgagtttgtttttagtcaacatatgttttacttgtttagaacttatgtttcttttgaaatgtgaatcataccatgtgtgattgccacatagt

SEQ ID NO: 565 - DNA, 1261 bp, Flaveria ramosissima
tccataaattaatccaaccatccccatttcaccaatcacttcatctcagatctcatctccaccattgttttctccgttttttgtttcttcaattcgttatcttacagcttccgatcgccggaaaagatgaagatcaccgtcactacacgaagcggcagagagctaatcgacggtggtcttgttcttgatagctccgctactgtggcggatttgcagaaggcaattcatcagagaatcaagaaatactatccttctagacaacgcctgaccctgcccctggaaccgggctcaaagaagaagcctgtagttcttcaatacaagaaaaatctcaaagagtacacaagtggaaactctgacgacattaccgtagtgtttaaggatttgggcccacaagtttcataccgaacactcttcttttttgagtacctgggcccattaatcctctatcctgtcttctattacttcccagtgtaccaattttttgggtacaaaggtgaacgggtcatccatccagtccagacatatgccatgtattactggtgtttacactatttcaaacgtatcatggagacctttttcgtgcaccggttcagtcatgcaacttcacctctttcaaatgtttttaggaactgtgcttattactggacttttgggtgttacattgcttattatgttaatcatcctctttacacacctgttagtgatcttcagatgaagattggatttgggttcgggttgattatgcaagttgcaaacttgtactgccacatcatactaagaaaccttaggagcccgagtggggatggaggctaccaaattccacgagggtttttgtttaatattgtgacttgtgcaaattacacaaccgagatatatcagtggttgggatttaatatcgcaacacagactgttgcgggttatgtctttcttgtggttgctgcttccatcatgactaattgggctctggctaaacatcgtcgtctcaggaggctctttgatgggaaggaaggaagaccaaagtaccctcgccgatgggtgatattgcccccattcctgtaagcaactataaacatgggttgtatgtcattttcaatggatttggtttatcagttagaattggttctatcatgagtttgtttttagtcaacatatgttttacatgtttagaacttttgtttcttttgaaatgtgaatcataccatgtgtgattgccacatagtacttttgaattagctgatttgttatttgcaagtttgagtct

SEQ ID NO: 566 - DNA, 1628 bp, Vitis vinifera
caattaattacctttgtatggacattggacaccacctcacaataatatccacgatcaacaataaaggcctcctccgagcctccaactactcaacccatcatctttcaagtctcgtatttaacgaccttgggttgggctctcctcacatcagagaggtgggttttgcgcctgatttctcctcctctgcttcttgttttgatcttctaggagatattgttttgcagatccagagtccatttctttctctttctattctctctcatttgaaccttttatcacatcttggagatgaaggtcacggtggttacgcggagtggtagagagctcatcaagggtgggcttgagctcgatgagtcggctactgtggttgacctgcaggaggcaattcatcggcgaaccaaaaaatactatccctccagacagcggctaaccctacccctccaaccgggctcaaaggagaggcctgttgcacttaactacaaaaagagtgtcaaagattattgtgatggaaactcaagcaacttaactgtagtgttcaaggatctgggtccacaaatctcctataggacacttttcttctgggagtacttgggtcctcttctcatatatcccatcttctacttcttccctgtttaccagtacttcggttataaaggggagcgtctcatccacccagttcagacgtatgccttgtactactggtgcttccactacttcaaacgtatcatggaaaccttttttgtgcatcggttcagtcatgcaacttcaccgctctctaatgttttcaggaattgtgcttattattggacctttggctcttatattgcttactatgtgaaccacccactttacacccctgttagtgacctccaaatgaaaattgggtttgggtttgggttggtttgtcaggttacaaacttctattgccatatcttgttgaggaatcttcgaagccctgatggaaatggagggtaccaaattcctcatgggtttctattcaatattgtgacatgtgcaaattacacaacagagatctatcagtgggtgggcttcaatattgcaacacagactgttgcgggctatgtctttcttgttgttgctgctgctatcatgaccaactgggcccttgcaaagcaccgtcgtttgaggaagctatttgatggaaaggagggaagacccaagtacccacgccgatgggtgatactacccccattcctgtagaagtgggaagcaggcctgccattcggttagtctcttttcattcaagggtctggattcacagcatgattgggatccttgaaggtcaattcttgtgggaaatgaactaaaaagagatgacattcaatgcctgttttctcttggtgagcttagttttctatttagacagtgtaatccatttgaatttgttcccatccttgggatcctacttggggatattctcttatttcttcttatcaaattatcgtttggagagttctacatctacttattttggtacccttctggtttgcatgttgaaatactcggatagctcttcagagaggaaaaaaaaatgtgagcaagttcataaagatgatgcattgaaattgtatcaatttccttgccctgattgtttttccaagtctttt

SEQ ID NO: 567 - DNA, 1500 bp, Medicago truncatula
atattccattaatgcatacattgacttggcctcatcttgtactaaccatacctcacattaatccatccttccccatcataaattctccatttttctatccaaattttcaaacccacattttcctttctttcttagaagaaatattacactcttcccccaattcaggtgctagttctattggatctagtgtatgatctgttagtgatttgtgaagtgtgttggttacactgtttggtgaagtgggtgtgttttggttttgaagatgaaggtcactgtggtttctaggagtggaagagagattgttaaaggtggcattgagctcaatgattctgctactgtagcagatttgcaggaggcaattcacaagcaaaccaagaagcatccatcaaggcagcgcttgacacttcctgtccaaccgggatcaaaggaaaagcctgttgttcttaattacaaaaagagtctcaatgactatacaagtggaaattcaaaaaccttaactgtaacgttcaaggacttaggtccacaagtttcttaccgtacgctttttttctttgagtatttggggccgttgcttctctatccagtcttctactacttccccgttgtctaccagtatttcggctacaaaggcgaacatgtcatccaccctgtgcagacatatgccatgtactattggtgtttccattacgccaaacgaattctggaaacattttttgtgcatcgcttcagccatgcaacttcacccctttccaatgttttccgcaactgtgcttattactggacatttggctgttatattgcttattatgtgaaccatcccctatacacccctgtaagtgaccttcaaatgaagataggcttcggatttgggatactttgtcaagtttcaaacttctattgccatattatactgaggaatcttcgtggacctgctggagaaggtggatatcaaatcccacgtggctttctcttcaatattgttacttgtgcaaactatacaacagagatttaccagtggttgggcttcaacattgcaacgcaaaccattgccggttatatatttctcgccgtcgctgcttttatcatgacgaactgggctcttgcaaaacacaggcgcttgaagaagttgtttgatggaaaggaagggaggccgaggtaccctcgtcggtgggtaatattgcctccattcctttaggagcccaagccattgaagtgatggttatgaagtcaccactctgctcacaggattctgagatttagaactatagcataatgaatttttagttaattattcttattttattagatatgaatttgtctttcaatgttttctctatgcagttggtttccaagttattgaagttgtttttgttggatatttgtaatcgtttatcgattatcgtaatgtggatcattgtttcttaagaatctttatcttgtgttgattgtatttgatgtttctatcatattttggttgtcttccctcctttagtgtctgca

SEQ ID NO: 568 - DNA, 1139 bp, Parthenium argentatum
gcctttaaaatccatctaaatcactcctccttcctcatacactgggacctcacccttaaatcccttgttcctagatctcaaactttcttacttctgcattgttttctccgtttcatcttaatccctgcaaagatgaaggttaccgttactacacggagcggtagagagctaatcaacggcggccttgttcttgacagctctgctactgttgctgatttgcaggaagcaattcatcagcgagtcaagaagtactatccatctagacaacgtttgaccctacccctccaaccgggctcaaaggaaaaggccgttgtacttcaatccaagaaaagtcttaaagagtacacaagtggaaactctgacacccttaccgtagtgtttaaggatttggggccacaagtgtcataccgcacactcttctttttcgagtatctgggcccattaatcctctatcctgtcttctactatttcccagtgtaccaaatatttgggtacaaaggcgaacgggttatttatccggttcaaacatatgcattatactattggtgtttccactatttcaaacgtatcatggagaccttttttgtgcaccgtttcagtcatgcgacttcacctctttcaaatgtgtttaggaactgtgcttactactggacttttggttgttatattgcttattatgttaatcatcctcaatacacacccgtaagtgacctccagatgaagatcggattcggttttgggttggttatgcaagttgcaaacttgtattgccacatcatactcagaaatctcaggagcccgagtgggaatggagggtaccaaattccacaagggttcttgtttaatattgtgacttgtgcaaattacacaactgagatttatcagtggttgggttttaatatcgcaacacagactgttgcgggttatatctttctcgtagttgctgcttccatcatgactaattgggccctggcaaagcatcgccgtctcaggaggctctttgacgggaaagaaggaagaccgaagtaccctcgccgatgggtgatattgcccccattcctttaaacgactgcagttatgggctgtacctcatcttcctttgttttggattatcaactagatttggttgtatcctgagc

SEQ ID NO: 569 - DNA, 1598 bp, Prunus persica
cagtagtgtagttttcttttagctggaggctggagagtgttgttgttgatcagcctccatagttagttatcctacccccaaccatacgccattaatttctacatccgaaatcgcccaaaccaactcctactttaaactacactacacgcccaatcaaattcaatattcaacatcatcatcgttattaaagagagccttagcctgcaccaattttcggatctcactctcaatctcatttctttttctttcttctcattcttcgtgctctgcaatttgaatggaagttgcgtgattttgctcacggcttaaagggtttgcttcttgctcgatttgctgaagtgggtctctctcacttgctctgaaaagatgaaggtgaccgtagtttcacggagtggtcgagaagttgttaagggtggccttgagctcagtgattctgccactgtgactgatctgcaggaggcgatccataagcgaaccaaaaagttctatcctgcaaggcagcggcttactctccccgtccaaccaggatcaaaagagaggccagttgtccttaactacaagaagagtctcaaagattatatcagtgaaaactcagacaacttaactgtggtgttcaaggacctaggcccacaagtgtcctacaaaacactcttcttctttgagtatttggggcctttggtcctttatcccatcttttactacttcaatgtttaccagtacttgggcttcaaaggagatcgtgtcatccgcccagtccaaacatatgctctatactactggtgcttccactacttcaaacgtattatggagacattttttgtacatcgcttcagtcatgcaacctcaccactcttgaatgtattccggaattgtgcgtattattggagctttggctcctacatagcttactatgtgaatcacccactttacacccctgttagtgacctccaaatgaagattgggtttgctgtggggataatatttcagatctcaaacttctattgccatatcctgctgaggaacttgcgaaggcctgatggaaatggaggatatcaaattccacgtggttttctgtttaattttgtgacatgtgcaaattacactacagagatctatcagtggttgggcttcaatattgcaacgcagacagttgctggttatgtcttccttgtagttgctgcatctatcatgacaaattgggcccttgcaaagcaccgccgtttgaagaagatatttgatgggaaagacgggagaccgaagtatccgcgtcgatgggtgatactacctccattcctgtagaattgattagcgactaggctgtcctgcctttgctggtcttttgggtattcaattgttggattccatccatgctggatgggtgatgaacttgaagaagttgaaatcgcatgttcactcaattgatggatcttaacattctgcttagatgttgtaattcatttgaactagttagggatttgcttgtggatctatacaagataggtcacctttttctttccagttgaactgttttgtcatttgtacttcttgaccgtctatgatatttctctttcttataattttagaattcaaagcaataa

SEQ ID NO: 570 - DNA, 1382 bp, Chenopodium quinoa
tgcatcaaataaattgacctcattcataagaggccatgctcaataaacgggtggttgatcagttttggggaagttaggtattaagatttcctactcctaactacacaccattaatatgacaagctaattatagcccaattatttgcccttttaaaccaggaatttctctctcttatgaactgactacttcgttatgctctagatttaagctcatcatttggatctccgccaaaattacccagaaaaaattaaagggtttgctgcaaattcaattttctgtactgggtttctcttaatcttctcccaaaatgaaggttttggttgtgacgcgtagtgggaaggagttattgaagggcggaatcgagctcaatgattcggcgactgtttctgatctacaggaagcaattcacaagagaaccaagaaatattatccttcccgacaacgactaactcttcctgtccaatcgggatcaaaggaaagaccaactgtgctaaacagcaagaagagtctcaaagagtattctgatggtaattcaaacaccttaactgtggtgttcaaggacctgggaccccaggtttcttaccgtactcttttcttttttgagtacttgggtcctttggtaatctaccccatttttcactacctccctgtctatcggtactttggctacaaagaggaacgtgtcatacacccagtgcagacatatgcttgttattactggtgttttcactatttcaaacgtatcatggaaacattttttgtgcatcgcttcagccatgcaacttctcctctgtccaatgtgttccgcaattgcttgtactactggacctttggagctttcattgcatactacgtgaatcacccactctacacccctgttagtgagctgcaatggaagattggatttggatttgggttgctctgccagctttcaaacttctactgccatatcttgttgaagaatctgcggaggcctgatggaaatggaggttaccagatacctcgtgggtttttgttcaatattgtgacttgtgccaattacaccacagagatttatcagtgggtaggcttcaatattgctacccaaactgtggcaggttatgtctttgccgtggttgctgccggtattatgactaactgggcacttgcgaagcatagacgtctcaagaagttgtttgacggtaaggatggaaaacccaagtacccacgcagatgggtgatattgcctccattcctgtagaaaagagctgcagtaaatttcctgaatcaacactgtctccatcgttctgtccctgtttcagctagcccaataattcaagctacatcttgctataagttattcaagcttcatgttcaagctgcccgattaatcatgttctcg

SEQ ID NO: 571 - DNA, 1264 bp, Helianthus annuus
ttgcatctacccaaccatacgcctttattcctccaccaatccctatatttcttcttccaagatctcaaactttctcccttaccattgttttctccgttacctcttaatcgccggaaacatgaaggtgacagttactacacggagcggtagagagctaatcaacggtggccttgttcttgacagttctgctactgtcgctgatttgcaggaagcaattcaccaacgaatcaagaaatactatccatcccgacaacgtctaaccctaccactccaaccgggctcaaaggaaaaggccgttgtgcttcaatccaagaaaagcctaaaagagtacacaaatggaaactctgacacccttaccgtagtgtttaaggatttgggcccacaagtctcataccgcacactcttctttttcgagtatctgggcccgttaatcctctatcctgtcttctactacttccccgtgtaccaaattttcgggtacaaaggcgaacgagtcatccatccggttcaaacatacgcattatactactggtgtttccactacttcaaacgtatcatggagacttttttcgtgcaccgtttcagtcatgcgacgtcacctctatcaaacgtgtttaggaactgtgcttattactggacttttggatgttatatcgcttattatgttaatcatcctcattacacacccgtaagtgacctccagatgaagattggattcgggtttgggtcggttatgcaagttgcgaacttgtattgccacatcatactcagaaatctcaggaacccgagtgggaacggagggtaccaaattccgaaagggtttttgtttaatattgtgacgtgtgctaattacacaactgagatttatcaatggttgggttttaatatcgcaacacagaccgtcgcgggttatatcttccttgtcgttgcggcttccatcatgactaattgggccctggctaagcatcgccgtctcaggaggctctttgacgggaaggaaggaagaccgaagtaccctcgccgatgggttattttgccaccgtttctgtaaacgacattatcaactggatttggttgtatccgtagcttattctagtcatcggattgtttagaacttttgttccttttgaattgtgaatgatacaactgatttgtatttgttagttttgaatcttttatctttgtgtaatctggacctttagcaactttgcaggatactgatgtgtttcttgcagtttaaatgagcctatgtccttttttggtg

SEQ ID NO: 572 - DNA, 1178 bp, Eutrema halophilum
agattcctcatctgggtcttcctcgttttctccgcttaagcaatgaaggtcaccgtcgtctcccgcagcggcagagaagtcctcaagggtcccctcgacctccccgattcggcgactgttgctgatctgcaggaagcatttcataagagagctaagaagttttacccgtcgaggcaaagactgactcttcctgtggctcctggatcgaaagacaaacctgtcgtcctcaacagcaagaaatcactcaaagactactgtgatggaaacacagactctttaactgtagtctttaaagacttgggggcacaagtctcttaccgcacgctcttcttcttcgagtatctcggtccactcttaatctacccgctcttttactacttccctgtttacaagttccttggctatggagaagaccgtgtgatccatcgagtgcagacgtacgctatgtactactggtgctttcactacttcaaacggatcttagagacgttttttgtccatcggttcagccacgcaacctccccaatcgcgaatgtgttcaggaactgtgcttattactggagctttggtgcttacattgcttactacgtgaaccatcccttgtacacaccggtcagtgaccttcagatgaagattggtttcgggtttggtttggtttgccaagtcgcaaacttttactgtcacattctgctgaagaatcttagagaccccaatggctctggaggctaccagattccacgtggtttcctcttcaacattgttacatgtgctaattacactacagagatttaccaatggctaggattcaatatcgctactcagaccattgcaggatacgttttcctcgctgtcgccgctctaatcatgaccaattgggctcttggaaagcacagtcgtctgagaaagatatttgatggaaaagatggaaaaccgaagtatccaagaagatgggtgatattgcctccgttcctgtagaagccattgttatgaccttcgtttgtcagttatacagctcttaataaggttgaaaaaggagattctaaagatctgtggtttctctgtattggttgtaacacttttgtttattccttttgctttaaaatgttttttatttgagttagagatttagaaatgtgctccttttattattcctcaagcaaaccagtttctccattgta

SEQ ID NO: 573 - DNA, 1650 bp, Beta vulgaris
acttgacctccccatctctgaaaagtgaaatcccatgcctaaaatacgagggtagtaagtagttgatcagttttggggaagttaggtgtcaagatatcctactaacctactcccaactacatgccatcaatatgataaccgaaggccacaatacaggagagaaattggcgttttaaataccctttaacgaatccttctcttattaactgactggttcatttatgctctagatttgagggcaccattttcatttagatctccgccacaaatttacaattagggcgtaaaattaaaagggtttactgcaaatttcatcttctgaattgggtttttctcaatttactcaagaaatgaaggtcttggttgtaactcgaagtggaagggagcttttgaaaggcggaatcgagcttaatgattccgctactgttgctgatctacaggaggcaattcacaagaaaaccaagaaattctacccttccaggcaacgattgactcttcctctccaaccgggatcaaagggaaggccaactgtcctggacagcaagaagagcctcaaagagtattctgatggtaatcccaacaacataactgtggtgtttaaggacctagggccccaggtttcttatcgtactcttttcttttgcgagtatttgggacctctgatcatctaccccatctttcactacctccctgtttatcagtactttggttacaaagaggaacgtgtcatacacccagttcagacatatgcttgttattactggtgtttccactatttcaaacgaatcatggagaccttttttgtacatcgcttcagtcatgcaacatctcccctgtccaatgtgttccgcaattgcatgtactactggactttcggagcttttattgcgtactatgtgaaccacccactgtacaccccagttagtaatgaccttcaatggaagattggatttggatttggcttgctctgtcaactttcaaacttctactgtcatatcttgctgaagaatctgcggggtcctggtggaagtggagggtaccagatacctagtgggtttttgttcaatattgtgacctgtgctaattacaccacagaaatttatcagtgggtaggcttcaatattgcaactcaaactgtcgcaggttatgtctttcttgtggttgctgccggaattatgactaactgggcacttgcaaagcatcgccgtctcaagaagttatttgacggaaaagatggaaaacccaagtacccacgacgatgggtaatattacctccattcctgtagaacagaggcggtttcatcttcattcaggctctatttgagttagctcaatatcttaagctatgtcttgcataaattatttgagcttcttgttcaagctgctcaattaatcactgctcaattaatcatgttctcgttgctgcaaacttacttcagtttagtcatcacttctgtcatatctctagaatcatttaagcaaacttttatccctttttggtatttccattactcaatcttggtattcccatctttcaggatgtaatagttaatcattcaaatccatatttatggatcttcaaacgtttattagttgcataactttatgtcaatcactttaccgatggaaatgctggatagttgggtgagg

SEQ ID NO: 574 - DNA, 1261 bp, Musa acuminata
atcgtatcactggaagtgtgccttggaacgggacaccgctcaccgaagccggccaacgccaccaggtccgaccaccatccggagttttcttcctcgttgagttggtagcattttgaggtgggaaggaatgaagatcatccttgtttcccgcagcgcaaaggaggtcatcaagggtgggattgagctccacgatgaggccactgtgagcgatctgcaggaagcaatttatgcccgaaccaaaaaattctatccttcaagacagcgcctcaccctgccattgcaatctgggaaccagggaaagccagttgtccttagtccgaagaaaaaactggtagaatattgtgatgggaatgtcaagagtctcactgtggtattcaaggaccttggagtacaggttttatacagtactcttttcttctgggagtacctgggtcctttaattatctatcctatcttctactactttccagtgtacaagtactttggttatgagggtgaacgggtcatatacccagtccagacatatgctacgtgttactggtgcctccattacttcaaacgtattatggagactttcttcgttcacagattcagccatgctacttcacctctctccaatgtgttcaggaattgcgcctattactggactttcggcacatacattgcatatcatgtgaatcatcccctgtacacacctgtcagtgatctgcaaatgaagattggatttggatttgggttgatttgccaagtctctaacttttattgccatcttatattgaggaatctcagaagccctgatggtaatggtggttaccagattcctcgtggctttctgttcaacatagtgacttgtgcaaactacacaacggagatctatcaatggcttggtttcaatattgctactcaaacaatagcaggttacgttttcctcgtggtggctacactcatcatgacaaattgggccctcgccaaacaccgtcgcctcaagaagttattcgatggaaaagacggacggcctaggtatccacggcgctgggtgatacttcctccattcatctaagcagagatggaaaagacggacagcctaggtatccacggcgctgggtgatacttcctccattcatctgagcagagacattttacttgcttctaaagtctgaaatttcaagccaaacatgttatgggagttggaaaatactcatcttaggcagctgaattatgtaattgccatgcacaactgaaatgcttgttgctgcatgca

SEQ ID NO: 575 - DNA, 1653 bp, Cannabis sativa
tcccatttattctctcttttggttatggatcttgcataaagattggtacttaaagttaagagctttattgttgtttttctagaaatttgttcaattgggtcttttccaagatgaaggtaaacgtaatctcacgaagtggtagagaagtaatcaagggtggccttgagctcaatgactctgccactgtggatgatctacaggaggcgattcataagagaacaaaaaagttctacccttcaagacagagacttacactccccgtccaacagggatcgaaagagaggcccgttgtcctcagctcgaaaaagagtctcaaagaatacaccaatggaaattccaatgacttgactgtagtgttcaaagatctcggtccacaagtttcataccggactctctttttcttcgagtacttgggccctttgatcatttaccctctattttactacttcccggtgtataggtactttggattcaaagacgagcgtgtcatctaccccgtgcagacgtttgccctttactactggtgtttccattacttcaaacgcattatggaaacgttctttgttcatcggtttagccatgctacctcaccactctcaaatgtttttagaaattgtctttactattggtcatttggatcttacatagcttactatgttaatcaccctctttacacacctgttagtgacctacaaatgaagattggtttcgggtttggaatactatgtcaaatctcaaacttctattgccatatcttgcttagtaatcttcgcggtgctgatgggagtggagggtatcaaattccacgcgggtttttgttcaacattgtcacttgtgcaaattacacaaccgagatttatcagtggttaggtttcaacatcgctacacagacaatcgccggttatatcttccttgttgttgctgcttatataatgaccaattgggcccttgcaaagcaccgtcgcttgaagaagctattcgatggaaaagacggaaggcctaagtatcctcgcagatggataatactaccaccatttctgtagaacagtttagcgagctagctagcgatcgatcgagcaatgtctactatttactttttgccctccaaacagtatgaattgttagagctccattttcaccagagctgattttttgttgttgttgttgttgttgcatttcagacccaaattttctagtgtttttagtttaagtttacagatgtaatggatttcaatgaataattattctagttggctaagttgttctcttgcattgaatcttctcttaaataagaatatgactttaatatgtaacatatttatgtcatatatgtgcatggagttacagtttgaaagctaaatcgcttcggtttggagggtcgccataactaagactgaacgctttgcaccatgtaccacaccagcagtgatcgcgctttttgcagatgaacgaacacacaacacgattcttgacagcccgtgagatggatttcgcagctgctaatgtcggtgttgcttaatcatcaaaccaagtttgtgttttcttgaatggaaaaatcaatcttattaaccatcaaaatcagctaccaaacaaggtagcaaatctactggaactttctccaggtgaaaagtacaatcaaagtaaaatagggaa

SEQ ID NO: 576 - DNA, 1824 bp, Cannabis sativa
agctttgtatatctaatctaagaaagttaagagcctaaagttagctctcctaccccaactacactccattaattttttcacttactatcttccaaaccaatttcctaccttcattatcccattttggatccccatcttcattcccatttattctctcttttggttatggatcttgcataagattggtacttaaagttaagagctttattcttgtttttctagaaatttgttcaattgggtcttttctaagatgaaggtaaacgtaatctcacgaagtggtagagaagtaatcaagggtggccttgagctcaatgactctgccactgtggatgatctacaggaggcgattcataagagaacaaaaaagttctacccttcaagacagagacttacactccccgtccaacagggatcgaaagagaggcccgttgtcctcagctcgaaaaagagtctcaaagaatacaccaatggaaactccaatgacttgactgttgtgttcaaagatctcggtccacaagtttcataccgaactctctttttcttcgagtacttaggtcctttgatcatttaccctctattttactacttcccggtgtataggtactttggattcaaagacgagcgagtcatctaccccgtgcagacgtttgccctttactactggtgtttccattacttcaaacgcattatggaaacgttctttgttcatcggtttagccatgctacctcaccactctcaaatgtttttagaaattgtctttactattggtcatttggatcttacatagcttactatgttaatcaccctctttacacacctgttagtgacctacaaatgaagattggtttcgggtttggaatactatgtcaaatctcaaacttctattgccatatcttgcttagtaatcttcgcggtgctgatgggagtggagggtatcaaattccacgcgggtttttgttcaacattgtcacttgtgcaaattacacaaccgagatttatcagtggttaggtttcaacatcgctacacagacaatcgccggttatatcttccttgttgttgctgcttatataatgaccaattgggcccttgcaaagcaccgtcgcttgaagaagctatttgatggaaaagacggaaggcctaagtatcctcgcagatggataatactaccaccatttctgtagaacagtttagcgagctagctagcgatcgatcgagcaatgtctactatttactttttgccctccaaacagtatgaattgttagagctccattttcaccagagctgattttttgttgttgttgcatttttcagacccaaattttctagtgtttttagtttaagtttacagatgtaatggatttcaatgaataattattctagttggctaagttgttctcttgcattgaatcttctcttaaataagaatgactttaatatgtaacatatttatgtcatatatgtgcatggagttacagtttgaaagtttaatcgcttcggtttggagggtcgccataactaagaccgaacgctttgcaccatgtaccacaccagcagtgaccgcgctttttgcagatgaacgaacacacaacacgaatcttgacagcccgtgagatggattttgcagctgctaatgtcggtgttgcttaatcatcaaaccaagtttgtgtttttttgaatggaaaatcaatcttattaaccatcaaaatcagctaccaaacaaggtagcaaatctaccgaaactttctccaggtgaaaagtacaatcgaagtaaaatagggaagtttttgcaaaagtatgagcaatcttattcactgatcgttt

SEQ ID NO: 577 - DNA, 1439 bp, Vigna unguiculata
ggatcacattaatgtttgaatatggatttgcatgccttcatctactactcaccacacttcacattaattcatcatcttccatccataatctttttctatatatgatatattatatacaaattcaatttttgtaagctaatatttcctttgtgtttgtcagtaactacatacaactgtccaacacacacatcttctccttctctatctctttccaattcagacacatagtgctgttggatcttgcatataaaaaccctttatcccttcgcaaagatgaaggtcactgtggtctctcgcagtggaagagaagtggttaaaggtggtgttcacctcagcgattctgctactgtagcagatctgcaggaggcaattcataagcaaaccaagaagcacccatcaaggcagcgtttgacactccctgtccaacccggatcaaaggaaaggcctgttgtccttaattacaagaagagtctgaaagaatataccagtggaaactcagaaaccttaactgttgtattcaaggacttgggccctcaagtttcttatcgaacactatttttctgcgagtatttgggaccattgcttctctatccagtgttctattacttccctgtttacaaatattttggttacaaaggtgaacgtgtgatccaccctgtgcagacatacgccttgtactactggtgtttccattacgccaaaagaattctggaaacgtttttcgtgcatcggttcagccatgcaacttcacctctttccaatgtgttccgtaactgtgcttattactggagttttggatcatacattgcttattacgtgaaccaccctctgtacactcctgtgagcgaccttcaaataaagattgggtttgggtttggcatactgtgtcaaatttcaaacttctattgtcatattatactgaagaatctccgcagtcctggtggtgaaggtggataccaaatcccaaaaggctttctcttcaatattgttacctgtgcaaattacacaaccgagatctatcagtggctgggcttcaacatcgcaacgcaaactgtcgcaggttatattttccttttggttgctactttcatcatgaccaactgggcttttgccaagcataggcgtttgaagaagttatttgatggaaaggatgggagacctaggtatcctcgtcgatggataatattgcccccattcctgtagaagacgtagcactcatctctgctcacggattgagatttataattgtagcataatggaattttcgttatctctttttattagatatggatttgtcttgcaatgcttttgactatgaagttgattgctaaattgttgaatcagtgttttttgcagaatatttgtaatcatttcaggattgtagtactgagatccctgtttcttcaacgtcttcatcttgtgctaaaaaaaaaaaaaaa

SEQ ID NO: 578 - DNA, 1036 bp, Echinacea purpurea
caatcccagatctcaaaacatcccaattattaccattgttttctccgctcaattccagttcctaatcgccggaaagatgcaggttaccgttactacaagaagtggtagagaactaatcaacggtggccttgttcttgactcctctgctactgttgctgatttgcaggaagcaattcatcagcgaatcaagaaatactatccatcccgacaacgtctgaccctacccctccaaccgggctcaaaggaaaaggccgttgttcttcaatccaagaaaagtctaaaagagtacacagatggaaactctgacacccttactgtagtgtttaaggatttgggcccacaagtttcataccgcacactcttcttttttgaatatttgggcccgttaatcctctatcccgtcttctactacttcccagtgtaccaattttttgggtacaaaggcgaacgggtcatccatccagttcaaacatatgcattatactactggtgtttccactacttcaaacgtatcatggaaaccttttttgtgcaccgtttcagtcatgcaacttcacctctttctaatgtgtttagaaactgtgcttattactggacctttgggtgttacattgcttattatgttaatcatcctcattacacacccgtaagtgacctccaaatgaagattggatttgggttcgggttggttatgcaatttgcaaatttgtattgccacatcatactcagaaatctcaggagcccgagtgggaatggagggtaccaaattccacaagggtttttgtttaatattgtgacttgtgcgaattacacaaccgagatttatcagtggttgggatttaatgttgcgacacaaactgttgcgggttatgtttttcttgtggttgctgcttccatcatgactaactgggcactggctaaacatcggcgtctcaggaggctctttgatgggaaggaaggaagaccaaagtaccctcgccgatgggtaatactgcccccatttttgtaagcgactgcaaacatgggtcgtatatca

SEQ ID NO: 579 - DNA, 1373 bp, Nicotiana benthamiana
agttaatctacacaaatggttcgttcagctaacttctacccaactatacacagccattaattacctgtcccaactccttcaaagatctcacatcccactacaattcaacccccaattattcatttctcagaaaaattgctctttcgtagatcccaaagtgtgaaaaaatgaaggttttggtagttacacgtagcggcaaagaactaatcaagggtggccttgagcttaccgattccgccacggttactgatctgcaggaggcaattcataaacgaaccagaaaatactatccttctagacaacgactcaccctgcctgtccaacctgggtcaaaagagaggccaactgttcttcactacaagaagagtctcaatgaatatactaatgggagcacaagtgagttaaccgtagttttcaaggatcttggtccgcaggttaagtatagtacacttttcttctgggagtatctaggtcctctggtactctatcctatcatttactactttccagtctacaagtttttcggctacaaagaacaacgtgttatccaccctgtccagacatatgccatgtattactggtgtttccactacttcaaacggatcatggagaccttctttgtgcaccgcttcagccatgccacttctccactttccaatgtttttcggaactgcgcctattattggtcttttggagctttcattgcttactatgtgaatcaccctctttacactccagtaagtgatctccagatgaagattggatttggttttgggttagtttgtcaagttgcaaacttctattgccatttattgttgagaaatctccgaagtcccagtggtaatggaggttatcaaataccatacggcttcttgttcaatattgttacctgtgccaattacacaacggagatctaccagtggttgggcttcaacattgctactcagacagttgcgggctatgtcttcatggttgttgctgctagcattatgactaactgggcccttggaaagcatcgtcgtttgaggaagctctttgatggaaaggaaggaagaccaaaatatcctcgacgatgggtgatattgcctcctttcctgtagaaatatgggtaagccggagaattgttcatttagcttaccattttctgtgaacctgcagcatttgaaggtttatgattctcgtttaaggatttaatacttaatcagatttttcccttggttctcttgtatttctgttccatgtcttagcttctttttagaccagatgatgtctgagtgagttcatttttgtagttctcacttccttgtgatgttttcaagaaccatctttgttagcctctgttgttgaattagtctattgtttatctaacaaaa

SEQ ID NO: 580 - DNA, 1614 bp, Olea europaea
gtaggtttaatacggtgcaaaatggttgggccaatctaccccggctacacgccattagtcacccgttcccccatcgttggacttcttcaccttcaaataaatttcccctcctggctaaatccgagcccatatctataatcttgagcagaaaaataactgggtctctttaatcttggaacagagatgaaggtggtagtcacgactcgtagcggcagagaactcataaagggtggccttgagctcagtgattctgctactgtggctgatctgcaggaagcaatatacaagcgaaccaagaagtactatccctctagacagcgattgaccctgcctattccgccgggttcaaaagagaagcccactgtccttcactacaagaagagtctcaaagaatacacagatgggaatggagacacattgactgtggttttcaaggatctaggtccccaagtcaagtacagcacccttttcttctgggaatacttgggccctttgatcctctatcctatgttctattactaccctgtgtaccagtttttcggctacaaaaaggagcgtgtcatctatcctgtccagacgtatgccttgtattactggtgtttccactactttaaacgtataatggaaaccttttttgtgcaccgtttcagccatgctacgtcacccctttccaatgtctttcggaactgtgcttattactggagctttggtgcttacattgcttattatgtcaaccacccactttacacaccagtcagtgatctccaaatgaagattgggtttgtgtttgggttgctttgtcaaattgcaaatttctattgccatatcttgttgagaaatctccggggtgctgatagtggtggagggtaccaaattccacatggctttttattcaacattatcacgtgtgcaaattacacaaccgagatttatcagtggctaggcttcaacattgctacacagactgtagcgggctatatatttatggttgttgctgcctccataatgacaaactgggctctcgcgaagcaccgtcgactaaagaagctatttgatggaaaggagggaagaccaaaatatccccgacgatgggtaatactgcccccattcctgtagatttacgggcaatcatgcacttgatttcttgtggagtacgaattaagcagcatcgtcgaagttcgaaagaggtcaattatcacaagagctttaataatggatcagattatctgttattttgctttccatgaaaggttggacaatggcaaaccctggcattgtgccactcctttggtgatatctttttaggacttatttaatatgttgagcaataggatttcagtttcttgaaatttgggtcgatgcaaagaaattcctgctgttgtgatcttgattattaagtgttcagttactcgataatacttgatcgattgcttgtgcattcagaactagtttgtcataaatcatctttacatactgaattgtgcatgcgattctaaatctgtgtctgtggaatgggaattctgaatagttgatgatcagattagcattactctagtttcctataaacacgaagtgtgtttgagacttgttcaatgcataaatgatgtgtttagt

SEQ ID NO: 581 - DNA, 1812 bp, Populus trichocarpa
caacaataaactaattccttataggaacctacatgcatcatcaattagggagggtgtgcagttcatcaatccacatggttagctctcctgccccaaccaaactcctttaatacacaagtacttgcttacactgccatttctatattttgttttacggagagatcgaagtaccaagtctcatatggaggttcagttctaagcttcttgttctgtctgaatcttgaacagaatcctttcaaattcacagggtttgcctttttttttttttcttttggtgaactgggtctctctcatttgatcttcaaaatgaaagtgactgtagtttctcgcagtggtagagaggtcattaaagggggccttgagctcagtgattcggctacagtggctgatctgcaagaggctattcataagcgaaccaaaaaattctacccttcaagacagcggctgaccctacctcttccaccgggatcaaaggaaaggcccgttgtccttagctacaagaagaacctcaaagaatactgtgatgggaatttgggcaacttaactgttgttttcaaggacctgggtccgcaagtttcctaccgcacactctttttctgtgaatacttgggtcctttggtgctctatcctgttttttactacttcccagtctacgagttttttggctacaaggggaagcgaatcatccacccagttcagacatatgcattgtactactggtgcttccactatttcaaacgcatcatggaaacattttttgtgcaccgatttagccatgcaacctcgccactctccaatgtgtttcgaaattgtgcttattattggacctttggttcctttatcgcatactatgtgaaccatcccctttacacccctgttagtgatcttcaaatgaagattggatttggatttggtttggtttgtcaactcgcaaacttgtattgccatatgttgctgaggaatcttcgccgtccaggtgggaatggtggctatcaaattccaagtgggtttctcttcaatattgtgacatgtgcaaattacacaacagagatttatcagtggttaggtttcaacgttgcaacacagactgtttcaggctacttttttcttgtggttgccacttccatcatgaccaactgggcccttgcaaagcatcggagattgaagaagctatttgatggaaaggacggaagacccagatatccacgccgatgggttatactgcccccattcctgtagaataactggtatctcagccactagccagctgctttggtgcatcatctgattcggtgtcaggaatctcatatttctggtacctgtgccccctgtccaatagaaagtggagcacacgttctcattgaattctcgaagatctttaagtcttttattgtagacaacataaattaacggagacacttggcatggggatacttctctccaagcccttatttctgttcctgtcttgaattatctggaatagatttacttaatcgtgttggtttagttcacttattgaaatggtggcttggttatgagtttggtacttctttagctctctttttttttttttccattcaaagtgggatgtattattccatggatcttgcataaacccatggcccatgtcttcaacttgcaatatgggttaggttggctgataagtgatatttttgcacactgaccattgctaggtgccgcattatgaaacccaacttcatggtctcgatgtagacattgaactacagttcattaaatacaaattttcaaagcatgcagagtataagccacgacaatggagggctgatgtcc

SEQ ID NO: 582 - DNA, 1140 bp, Primula obconica
aagcgtggaagatgaaggtggcggtggttacgaggagcgggagagagttagtcaagggcggtctcgacctccatgactcggctactgttgctgatctgcaggaagcgattcacaagcgtacaaaaaaatattatccttctagacaacgcttgaccctccctgtccagcctggatcaaaggaaaagcctgttgttcttcagtacaagaaaagtctcaaagactatagtgatggaaacatcaacaacttgactgtgcagttcaaggaccttggtccacaagtttcatatcgtacactcttcttcttcgagtatctgggccctctattgatttatccgattttctactactttcctgtgtaccaatattttggctacaaagagaatcgtgtcatccaccaagttcagacatatgccatgtactattggtgtttccattatttcaaacgtataatggaaactttctttattcaccgctttagccatgcaacctctccactctctaatgtctttcgcaattgcttttattactggacatttggtgcttatattgcttattatgtaaatcatcccctatatacccctgttggcgacctccaaatgaagattggatttgcgtttggagtgctgtgccaaatctcaaatttctattgccacatcctgctaagcaaattacggagcccaggtggcgaaggagggtaccaaattccgcgtggctttttattcaatatcgtcacatgtgcaaactacacaactgagatttatcagtggttgggcttcaacattgcaacacagacaattgcaggctacatctttatggtggttgcggcttctataatgactaattgggcttttgctaagcaccgtcgtttgaggaagctatttgatggcaaggatggtcgacccaaatatcctcgacgttgggttatcctacccccattcctgtaaaagccaatggcaaggttctatttggtgcatttgattcgcatttatggaaactctataccttgattgcagctagtggtcaataacagttggtgatcagttcctcggtctctcttttactttagaatgcctgaagtagttatgtttcattcacaggataatcctttttttcctttccaattctatgaaattgttcgag

SEQ ID NO: 583 - DNA, 1901 bp, Chenopodium quinoa
cataaaccaaatacaagctcaacatgacccgaccttttgccagctcttatcttgccaaattggaagaatccaattgaatactcaaatcaataaggtgtttggaatgcatcaaatagattgacctttctcataaaaggccatgctcaataaacgggtggttgatcagttttggggaagttaggtattaagatatcctactcccaactacacgccattaatatgacaagctaattacagcccaattatttgcccttttaaaccaggaatttctctctcttatgaactgactacttcgttatgctctagatttaagctccccatttggatctccgccaaaattacccagaaatattaaaagggtttgcagcaaattcaatcttctgtactgggtttctcttaatcttcaccaaaaatgaaggtttcggttgtaacgcgaagtggaaaggagctcttgaagggcggaatcgagctcaatgattcggcgactgtttctgatctacaggaagcaattcacaagagaaccaagaaatattatccttccagacaacgtctaactcttcctgtccaaccgggatcaaaggaaagaccaactgtcctaagcagcaagaagagcctcaaagagtattctgatggtaattcaaacaccataactgtggtgttcaaggacctgggaccccaggtttcttaccgtactcttttcttttttgagtacttgggtcctttggtaatctaccccatttttcactacctccctgtctatcggttcttcggctacaaagaggagcgtgtcatacacccagtgcagacgtatgcttgttattattggtgttttcactatttcaagcgtatcatggaaacattttttgtgcatcgcttcagccatgcaacttctcctctgtccaatgtgttccgcaattgcttgtactactggacctttggagctttcattgcatactacgtgaatcaccctctctacacccctgttagtgacctgcaatggaagattggttttggatttgggttgctctgccaactttcaaacttctactgccatatcttgctgaagaatctgcggaggcctgatggaaatggaggttaccagatacctcgtgggtttttgttcaatattgtgacttgtgccaactacaccacagagatttatcaatgggtaggcttcaatattgctacccaaactgtggcaggttatgtctttgccgtggttgctgccggtattatgactaactgggcgcttgcgaagcatagacgtctcaagaagttgtttgacggaaaggatggaaaacccaagtacccacgcagatgggtgatattgcctccattcctgtagaaaagagctgcagtatatttcctggatcgacactgtctccatcgttctgtccctgtttgagttagcccaataattcaagctacatcttgctataagttattcaagcttcatgttcaagctgcccgattaatcatgttctcgtcgctgcaaacttacttcagtgtagtaatcaatcctgtcacatctctagatcatttaagcaaacttgtatccctatttttgtatttccataagtctttctttgtttcccgtctttcaggataatgaaatagcattcgaaaccaatcatattaataccttatttatcaatgcttaaacatatcttaattttaaacctttctgtcaatcaatttagtgataattttgttacttttttccttatctttacaatgagaaatgttggccttaaagttggatctgcctttttttcctgctttagaattttataattcctttataatatgaacgtgcaatatgcacatactattgttagcctgtaaggtctgtaggtatctccagctaagaagaatgcagaactttatttttttgaagtgag

SEQ ID NO: 584 - DNA, 1387 bp, Solanum phureja
ggtggttcatccaacataaaattggttcgttcagctactttctacccaactactatagcgccattaattgcttacttatactgctactactacttatctagacccatcaaagatctcacattcttcatcatttctcagaaaatagttgttttttcgtagatcccaaagtttgggggagcaaagatgaaggttttggtggttacacgtagcggcaaagaactcatcaagggtggacttgaactcaatgattctgctacagttgctgatctgcaggaggcaattcataaacgaaccagaaaattctatccttctagacaacgactcactttgcctgttcaacctggttcaaaagagaggccaactgttcttcattaccagaagagcctaagtgagtatactaaggggagcacaggcgaattaactgtagttttcaaggatctgggtccacaagtcaagtatagtacacttttcttctttgagtatctgggtcctctgctactctatcctatcttttactacttcccagtctacaagtattttggctacaaagaagagcgtgttatccaccctgttcagacttatgccttgtattactggtgtttccactacttcaaacggatcatggagaccttctttgtgcaccgcttcagccacgccacttctccaatcgccaatgtttttcggaactgtgcctattattggtcttttggagctttcattgcttacttcgtgaatcatcctctttatactcctgttagtgatctccagatgaagattggatttggatttgggatagtttgtcaagtggcaaacttgtattgccatttattgttgagaaatcttcgaagtcccagtggtaatggaggttaccaaataccccgtggcttcttgttcaatattgtcacctgtgcaaattacacaacagagatctaccagtggttgggcttcaacgttgctactcagactgttgcaggctatatcttcatgattgttgctgctagcattatgactaactgggctcttggaaagcatcgccgtttgaagaagctctttgatggaaaggaaggaagaccaaagtatcctcgacgatgggtgatattgcctcctttcctgtagaccatttcctcgacaatgtgagaaagcccgagagttatttatttagttgatcattttctgtgaacctgcaacttttgaaggtttatgtttctcactaaaggaagcaatactcagatttttcttttgtattactgttccatgtcttacctcttattataccagatgatctgactttcatgatatttgtagttctcacttctttgtgatggcttcaagaaccatctttttttatatctattgtttatgagttatgaaagtgatccttataata

SEQ ID NO: 585 - DNA, 1335 bp, Eutrema parvulum
gaaggtatcaaactaaatgggtccaaaagttcttaagttgggagatttgttagttgtcctactcccaactacacaacttcaatgcccaatctcatcttcttcttcttcctctctatttaattttccttatctcttacattttcctcatctgggtcttcctcgttttctccgcttaagctatgaaagtcaccgtcgtctcccgtagcggcagagaagttctcaaaggtcccctcgacctccccgattcggcgactgttgctgatctgcaggacgcgtttcataagcgagccaagaagttttacccgtcgaggcaaagactgactcttcctgtggctcctggatcgaaggacaaacctgttgttctcaacagcaaaaaatcactcaaagagtactctgatggaaacacggactccttaactgtagtcttcaaagacttgggggcacaagtttcttaccgtacgctcttcttctttgagtatctcggcccactcttaatctacccggtcttctactacttccctgtttacaaattccttggctatggagaagaccgtgtgatccatccggtccagacgtacgctatgtactactggtgctttcactacttcaaacgtatcttagaaacgtttttcgtccatcggttcagccacgcaacctctccaattgcgaatgtgttcaggaactgtgcttattactggagctttggtgcttacattgcttattacgtcaaccatcccttgtacacaccggtcaatgaccttcagatgaagattggtttcgggtttggtttgctttgccaagccgcaaacttttactgtcacattctgctgaagaatcttagggaccccaatgggtctggaggctaccagattccacgcggtttccttttcaacattgttacctgtgccaattacacgacagagatttaccaatggctaggattcaatatcgccactcagaccattgcaggatacgttttcctcgctgtcgccgctctaatcatgaccaactgggctcttggaaagcacagtcgtctgagaaagatatttgatggaaaagatggaaaaccaaagtatccaagaagatgggtgatattacctccgttcctgtagaagccattgttatgaccttcgtttgtcagttatacagctcttaataaggttgaaaaaggagattctaaagatctgtggtttctctgtattggttgtaacacttttgtttattccttttgctttaaaatgttttttaagttagagatttagaaatatgcttctttaattgtttctcacgcaaaccaaatcctccattgtattgcatagtaagtcaatcacaaac

SEQ ID NO: 586 - DNA, 1256 bp, Nicotiana tabacum
atctaagcaaatggttcgttcagctaacttctacccaactatacacagccattaattacctgtcccaactccttcaaagatctcacacccctactacaattcaacccccaattattcatttctcagaaaatttgctctttcgtagatcccaaagtgtgaaaaaatgaaggttctcgtagttacccgtagcggcaaagaactaatcaagggtggccttgagctcaccgattccgccacggttactgatctgcaggaggcaattcataaacgaaccagaaaatactatccttctagacaacgactcaccctgcctgtccaacctgggtcaaaagagaggccaactgttcttcactacaagaagagtctcaatgaatatattaatgggggcacgaatgagttaaccatagttttcaaggatcttggtccgcaggttaagtatagtacacttttcttctgggagtatctaggtcctctggtactctatcctatcatttactactttccagtctacaaatttttcggctacaaagaagaacgtgttatctaccctgtccagacatatgccatgtattactggtgtttccactacttcaaacggatcatggagaccttttttgtgcaccggttcagccatgccacttctccactttccaatgttttccggaactgtgcctattattggtcttttggagctttcattgcttactatgtgaatcaccctctttacactcctgtaagcgatctccagatgaagattggatttggttttggcttagtttgtcaagttgcaaacttctattgccatttattgttgagaaatctccgaagtcccagtggtaatggaggttaccaaataccatacggcttcttgttcaatattgttacctgtgccaattacacaacagagatctaccagtggttgggcttcaacattgctactcagaccgttgcgggctatgtcttcatggttgttgctgctagcattatgactaactgggcccttggaaagcatcgtcgtttgagaaagctctttgatggaaaggaaggaagaccaaagtatcctcgacgatgggtgatattgcctcctttcctgtagaaatatggggaagccagagaattgttcatttagcttaccattttctgtgaacctgcagcttttgaaggtttatgtttctcattagagtatttattacttaatcagattttcccttggttctcttgtatttctgttccatgttttagcttctatttagacc

SEQ ID NO: 587 - DNA, 1522 bp, Centaurea maculosa
tggcgagatgatgtagttaaactatatacactttcaccaccatttattcatccataagtcaatagagaagagctcagtagcagcagttcatctaccccaactacacgcctttaaaatccccatcaaattgcaaacttggctcatcatccctccccataactactgataccgcggggggcccttattacttttccttacccataaataaatctccccaaccatcgcctacatttcattaatcccattttcttagatctcaatttctcatacttcacattgttttctccgctttgggtttctcccctgataccgatctgatcgccggaaacatgaaggtcaccgttaccactcgtagtggtagagagttaatcaacggcggtcttgttcttgattcctctgctactgtggctgatttgcaggaagcaattcatcaacgaatcaagaagtactatccttccagacagcgcctgaccctccccctccaaccagggtcaaaggcgaagccagttgtcctccaatccaagaaaagtctcaaagagtatactaccggaagttccgacaacattaccgtagtctttaaggacttgggcccacaagtttcgtatcgtacgctcttctttttcgagtatttgggcccactgatcctctatcccgtcttctattacttcccagtgtaccagttctttggttacaaagttgaagaacgtgtaatccgtccaattcagacgtatgcaatgtactactggtgtttccattatttcaaacgtatcatggagaccttctttgtgcaccgtttcagtcacgcaacctcgcctctttcgaacgtctttcgaaactgtgcttattactggagcttcggctgttatatcgcttattatgttaaccaccctctttacacaccagtgagtgatctccagatgaagatcgggttaggatttgggttgattatgcaactttcaaacttgtattgccacatcatactgagaaatcttcggagcccaagtgggaacggaggataccaaattccacaagggtttttgttcaatatcgtgacttgtgcaaattacacaaccgagatttatcagtggctgggatttaacatagcaacacagacagttgctggttatatctttctcgtggttgctgcttccatcatgactaattgggcactggctaagcatcgtcgtctcaggaggctatttgatgggaaggaaggaaggcccaagtatcctcgccgatgggtgatattgcccccattcctgtaagcaattggttacaaatatgggtttggttctggattatatcagctagatttggttcgtatcttgagttcattctagtcgacatatttctaaaaaggatcaccagcagatgttttacttgtttagaacattagtttcttgttgatttgtgaatcatactgcttaataggtctttcatcatgtgtacttgccacatcagatggcttttgaatttacctgatttgtattagtttgagtatttcttctgtgaaatcttgtta

SEQ ID NO: 588 - DNA, 1263 bp, Trigonella foenum-graecum
ggtgctagttctattggatcttgtgtatgatctgtcagtgatttgtcaattttgttgcttacactgtttggtgaagtgggtactgggtgtgttttggttttgaagatgaaggtcactgtggtttctaggagtggaagagagattgttaaaggtggcattgagcttaatgattctgctactgtagcagatctgcaggaggcaattcacaagcgaaccaagaagcatccatcaaggcaacgcttaacacttcccgtccaaccaggatccaaggaaaagcctgttgttcttaattataaaaagagtctcaatgactatacaagtggaaattcagaaaccttaaccgtaacattcaaagacttaggtccacaagtttcttaccgtacgcttttcttctttgaatatttggggccgttgcttctctatccagtcttctactacttccccgctgtttaccagtatttcggctacaaaggcgaacgtgtcatccaccctgtgcagacatatgccatgtactattggtgtttccattacgccaaacgaattctggaaacgtttttcgtgcatcgtttcagccatgcaacttcacccctttccaatgttttccgcaactgtgcttattactggacctttggctgttatattgcatattatgtgaaccatccactatatacacctgtaagtgaccttcaaatgaagattggcttcggatttgggatactttgtcaagtttcaaacttctattgccatattatactgaggaatcttcgtggacctgctggagaaggtggatatcaaatcccacgcggttttctcttcaatattgttacttgtgcaaactatacaacggagatttaccagtggttgggcttcaacgttgcaacacaaaccattgccggttatgtatttgttgcagtcgctacttttatcatgaccaactgggctcttgcaaagcacagacgcttgaagaagttgtttgatggaaaggaagggaggccgaggtaccctcgtcggtgggtgatattgcctccattcctgtaggagccacagccactgaagtgatggtcatgaagtcaccactctgctcgcaggattctgagatttagaattatagcataatgaatttttagttaattattcttatttcattagatatgaatttgtctttcaatgttttctctatgcagtttgtttccaagttattgaagttgtttagttggatatttgtaatcgtttatcgattatcgtaatatggattattgtttc

SEQ ID NO: 589 - DNA, 1547 bp, Tabernaemontana elegans
aggacttgcaacaagtagatgagctatacgagtggactggtacaggcgtaactctgatctgatgagtgatatgacaaggcgaaaacggcggcgcatgggcgctaaggcgctgctggttcgttcatctgccccaaccacacgccattaatttacttgttactccttcaaatcacgccattggtctgactctccttcactgtctgtatacccaactgctcacacccaaactttcggcatttaaagctctctatcactcttccaagttattgcagcaacgcatagcccattcccccagaagaaattctcctcagatcttcaaaccgaagcccgccgctctctttcgtcaaggatgaaggtggctgtggttacgcgtagcggcagagaactcgtgaagggtggccttgagctcaatgattctgctactgttgctgatctacaggaggcaatccataagcgaactaagaaatactatccttcaagacaacgacttactcttcctctccaacctgcatcaaaggagaagcctactgtacttaacgataaaaagagtctcaaagagtacaccagggggagcgaaaaccagttaactgtagttttcaaggacctaggtccacaagttaactatagcacactattcttctgggagtacttgggtcctcttgtcctgtatccagttttctactacttcaatgtctaccaatacctgggctacaaaggggagcgtgtgatccccccggttcagacatatgccttatactactggtgtttccactacttcaaacgcataatggaaacattctttgtccaccgtttcagccatgccacttcaccactttccaacgtttttcgcaattgtgcttattactggagctttggctctttcattgcatactatgtgaatcacccactttatactccagtaagtgatctccaaatgaaaattggatttggatttggttggtttgtcaattagcaaacttctattgccacatcttgttgagaaatcttcgaagctctgatggcaacagagggtatcaaattccccgtggcttcttgttcaacattgttacctgtgccaattacaccactgaaatttaccagtggctgggcttcaatattgcaacacagactgtagctggctatgttttcatggttgttgctgctgccataatgactaactgggcccttgcaaagcaccgacgtttgagaaagatatttgatggaaaggatggaagaccaaagtaccctagaagatgggtgatattgcccccattcctgtaggaagcaactggtaaagcaggcatgattccttcactgatgagtttgcaagttcagccccacatctcaaaaggttgtttgcactcattttgaattaaattattccaaacataggtcagatttttctcatttcctctttcatattatagacttctatggaaatgtatgcatctgagactctatttatttgctttgctgcaagttagcctttcttactttctattagatcgttgttgatttgttacttctggattggctgactttaagat

SEQ ID NO: 590 - DNA, 1372 bp, Lotus japonicus
attttcataacccccattttcatttgtgtctatgattatgaggaactagcaaacacagacccaactctcttccaccaattcagctcttctgtcagatcttgcatcgcaaagtgttgctgacagtgtttggtgaagtgggtctgtttcggttttgaagatgaaggtcactttggtttctaggagtggaagggaaattgttaaaggtggcattgggctcagtgattctgctactgtagcagatctgcaggaggcaattcataagagaaccaagaagcacccatcaaggcagcggttgacacttcctgtccaaccaggatcaaaggagaagcctgttgttcttaactacaaaaaaaatctgaaagactacacagatggaaattcagaaaccttaactctagtattcaaggacttaggcccacaagtttcttatcggacacttttcttctttgagtatttggggcctttgcttctctatccagtattctattacttccctgtctaccagtactttggctacaaaaatgaacgtgtcatccgcccggtgcagacatatgccatgtactattggtgtttccactacgccaaacgaattctggaaacatttttcgtgcatcgcttcagccatgcaacctcacccctttccaatgtttttcgcaactgtgcttattattggacctttggctcatacattgcttattatgtgaaccatcctctatatacccctgtaagtgacctccaaataaagattgggtttggatttggaatactctgtcaagttgcaaatttctattgccatattatactgaggagtcttcgtggacctgggggagaaggtggatatcaaatcccgcgcggctttctgttcaatattgttacttgtgcaaattacacaactgagatctatcaatggctgggcttcaacattgcaacgcaaactgttgctggttatatctttctcgccgttgctacttttatcatgaccaattgggctttggcaaagcacaggcgtttgaagaagttatttgatggaaaggaagggagaccaaggtatcctcgtcgatgggtaatattgccgccatttctgtagaagcctaaggcactgatgaggtcaccactctgcagtgttctgagatttagaattgtagcttattgaacttttggtgatctagtcctgtcagataaaaaaaaattcttccaatgctattgactatgaagttgatttccaagttgttgaagcagcattttgtaggatacttgtattcatttctaaattatcaaactggggatacttgtttcttctgaatcttcatcttgtgttagtcatatttaatgtttctgttttattatgattggcttcgtcgtttactgtctg

SEQ ID NO: 591 - DNA, 1270 bp, Olea europaea
atcttgaacagaaaaagattgggtttctcttctatcttgaaagaaagatgaaggtcgtagtcacgactcgtagcggcagagaactgataaagggtggcattgagctcagtgattctgatactgtggctgatctgcaggaagcaattcacaaacgaaccaaaaagtactacccctctagacagcgactgaccctgcctattccacctggatcaaaagagaagcctactgtccttcactacaagaagagtctcaaagaatacactgatgggaatggagacactttgactgtggttttcaaggacctaggtccacaagtcaagtacagcacccttttcttttgggaatacttgggtcctttaatcctctatcctgtcttctattactaccctgtgtaccggttttttggctacaaaggggagcgtgtcatccaccccgtccagacttatgccttgtattactggtgtttccactacttcaaacgtataatggaaacctttttcgtgcaccgtttcagccatgcaacctcacctctttccaatgtctttcgcaactgtgcatattattggagctttggtgcttttgttgcttattatgtcaaccacccactttacacaccagtaaatgatctccaaatgaagattgggtttgggtttgggttgctttgtcaaattgccaatttctattgccatatcttgttgagaaatctccggggtgctgatagtggtggagggtaccaaatcccacgtggctttttattcaacatcgttacatgtgcgaactacacaactgagatttatcagtggctaggcttcaatattgctacacagactgtagcaggctatgtcttcatggttgttgctgcctccataatgacgaactgggcccttgcaaagcaccgtcgactaaagaagctgttcgatggaagggagggaagaccaagatatccccgacgatgggtaatactgcccccattcctgtagattacaggcaatcatgcacttgttttcttgtgattgagttcgaattcagcagcatcattgaaggtcaaaagagatcgtttatcactagagatttaatactgggttaggttttttctctcctttcataatacatcgcgccattctcctttggtggtatctttctaggacttctgttgggatttttaatatgtggagtgatcggatttcattttgttgatgtaagcgtttttatcatgactgctaagcacactagataacttcgatccatggaaacaattcctactgttgaa

SEQ ID NO: 592 - DNA, 1721 bp, Picea glauca
aaccagaaacgtaacctcaaggaaatcctcttttggacagagacctcttaccctggtacgaaccctcacgttgaaggtcaatggtgagcttctaatggcataaaagagctatttgtcgtcgatggcagaaggcatcatggttggctaattgaatttttgttaatgaatttggtatggtagctctcctaccctcacccaattgaatttcatttcgtgaggttctcaccaatgcatttagcatctcaccctccaaaccagccacaaaacaaattcacaccaatattgctttcctcaccaatcaccataacaaagcagactttcgaccaccaatggtctgtcatacccatttaatgcttcattcactcaaagctatagctcagacttcactcatcaatacggccacttgtactgctgccacatattccacctacaagcaataattcattcattgaggccaacgcccaacactatattttgtgcttcagcaaatccctggtggtcataccgataacagaagggattgcaaagatgaaggtctcggtagtatctcgaagtggcagagaaattatcaagggtggcatcgatctgagtgataatgccactgtggatgatctgaaatcctcgatacaccaaagagtcaagaaatattatcctgctcggcagcgacttactctgccgcaacctggaaaagggaaaccagttgttctggaaaggggcaagaggctcaaagattattttgaaaaagacgagggaaagttagtggtggtgttcaaggatttagggccacaggtagcctacagcactctttttttctgggaatatgtcggccctctgttcatttatcccatcttctattacttccctgtctacaagtactttggatatcccgcagaaagagttatacacccagttcagacatatgcaatgtactattggtgctttcactatgccaaacgcattttagagaccttttttgttcacaggttcagccatgcaacttcgccactttctaatgtgtttagaaactgctgttactactggacctttggtgcagtcatagcttattttgtcaatcatcccctctatacccctgtgagtgagaaacaaataaagattgggtttgggctggggattgtatgtcaggtagcaaacttttactgccatattttgttgaggaatcttaggatccctggaggtaaaggaggatatcaaattccaggtggattcctgtttaatatagtcacatgtgctaactacaccactgagatctatcaatggttgggattcaatatcgcaacacagacagttgctggctacacctttctggctgtagcaacctttattatgactaactgggctcttgccaagcaccgccgtttgaagaagttgtttgatggcaaagatggcagacccaaatatccaaggcgatgggtgatattacctcctttcctatgaaaggaatgtttattattgcacaggacacttttgttgaattctatattgaattgttaacaaaaacttgggcctttttctggttcgacaatgtctaaaatttgtttcctttagtatgatacgacgttgtaactcactgttttgtggctgtaatttatttagttgtgcttgcttaagaagctcgtaggagtgaatttttcatctgggtatgttctcgctattttaaatggagtattttttattactatttttgctgattttgaaagtca

SEQ ID NO: 593 - DNA, 1742 bp, Picea glauca
atagtaaagtattccgagcaaaaaaactttgcttacacgaggtctcccgaacatccctattttttaaccagaaacgtaacctcaaggaaatcctcttttggacagcgacctcttaccctggtacgaaccctcacgttgaaggtcaatggtgagcttctaatggcataaaagagctatttgttgttgatggcagaaggcatcatggttggctaattgaatttttgttaatgaatttggtatggtagctctcctaccctcacccaattgaatttcatttcgtgaggttctcaccaatgcatttagcatctcaccctccaaaccagccacaaaacaaattcacaccaatattgctttcctcaccaatcaccataacaaagcagactttcgaccaccaatggtctgtcatacccatttaatgcttcattcactcaaagctatagctcagacttcactcatcaatacggccacttgtactgctgccacatattccacctacaagcaataattcattcattgaggccaacgcccaacactatattttgtgcttcagcaaatccctggtggtcataccgataacagaagggattgcaaagatgaaggtctcggtagtatctcgaagtggcagagaaattatcaagggtggcatcgatctgagtgataatgccactgtggatgatctgaaatcctcgatacaccaaagagtcaagaaatattatcctgctcggcagcgacttactctgccgcaacctggaaaagggaaaccagttgttctggaaaggggcaagaggctcaaagattattttgaaaaagacgagggaaagttagtggtggtgttcaaggatttagggccacaggtagcctacagcactctttttttctgggaatatgtcggccctctgttcatttatcccatcttctattacttccctgtctacaagtactttggatatcccgcagaaagagttatacacccagttcagacatatgcaatgtactattggtgctttcactatgccaaacgcattttagagaccttttttgttcacaggttcagccatgcaacttcgccactttctaatgtgtttagaaactgctgttactactggacctttggtgcagtcatagcttattttgtcaatcatcccctgtatacccctgtaagtgagaaacaaataaagattgggtttgggctggggattgtatgtcaggtagcaaacttttactgccatattttgttgaggaatcttaggatccctggaggtaaaggaggatatcaaattccaggtggattcctgtttaatatagtcacatgtgctaactacaccactgagatctatcaatggttgggattcaatatcgcaacacagacagttgctggctacacctttctggctgtagcaacctttattatgactaactgggctcttgccaagcaccgccgtttgaagaagttgtttgatggcaaagatggcagacccaaatatccaaggcgatgggtgatattacctcctttcctatgaaaggaatgtttattattgcacaggacacttttgttgaattctatattgaattgttaacaaaaacttgggcctttttctggttcgacaatgtctaaaatttgtttcctttagtatgatacgacgttgtaactcactgttttgtggctgtaatttatttagttgtgcttgcttaagaagctcgtaggagtgaatttttctaaaaaaaaaaaaaaaagagctctt

SEQ ID NO: 594 - DNA, 1924 bp, Picea glauca
tagtaaagtattccgagcaaaaaaaactttagcttacacgaggtctcccgaacatccgtattttttagccagaaacgtaacctcaaggaaatcctcttttggacagagacctcttaccctggtacgaaccctcacgttgaagggcaagggcaatggcataaaagagctatttgtcgttgatggcagaaggcatcatggttggctaattgaatttttgttaatgaatttggtatggtagctctcctaccctcacccaattgaatttcatttcgtcaggttctcgccaatgcatttagcatctcaccctccaaaccagccacaaaacaaatacacaccaatattgctttcctcaccaatcaccataacaaagcagactttcgaccaccaatggtctgtcatacccatttaatgcttcacactcaaagctatagctcagacttcactcatcaatacggccacttgtactgctgccacatattccacctacaagcaataattcattcattgaggccaacgcccaacactatattttgtgcttcagcaaatccctggtggtcataccgataacagaagggattgcaaagatgaaggtctcggtagtatctcgaagtggcagagaaattatcaagggtggcatcgatctgagtgataatgccactgtggatgatctgaaatcctcgatacaccaaagagtcaagaaatattatcctgctcggcagcgacttactctgccgcaacctggaaaagggaaaccagttgttctggaaaggggcaagaggctcaaagattattttgaaaaagacgagggaaagttagtggtggtgttcaaggatttagggccacaggtagcctacagcactctttttttctgggaatatgtcggccctctgttcatttatcccatcttctattacttccctgtctacaagtactttggatatcccgcagaaagagttatacacccagttcagacatatgcaatgtactattggtgctttcactatgccaaacgcattttagagaccttttttgttcacaggttcagccatgcaacttcgccactttctaatgtgtttagaaactgctgttactactggacctttggtgcagtcatagcttattttgtcaatcatcccctctatacccctgtgagtgagaaacaaataaagattgggtttgggctggggattgtatgtcaggtagcaaacttttactgccatattttgttgaggaatcttaggatccctggaggtaaaggaggatatcaaattccaggtggattcctgtttaatatagtcacatgtgctaactacaccactgagatctatcaatggttgggattcaatatcgcaacacagacagttgctggctacacctttctggctgtagcaacctttattatgactaactgggctcttgccaagcaccgccgtttgaagaagttgtttgatggcaaagatggcagacccaaatatccaaggcgatgggtgatattacctcctttcctatgaaaggaatgtttattattgcacaggacacttttgttgaattctatattgaattgttaacaaaaacttgggcctttttctggttcgacaatgtctaaaatttgtttcctttagtatgatacgacgttgtaactcactgttttgtggctgtaatttatttagttgtgcttgcttaagaagctcgtaggagtgaatttttcatctgggtatgttctcgctattttaaatggagtattttttattactatttttgctgattttgaaagtcacacagatatgctctacatgtaccatcctggtacttgctcgactattttctcacatataactgctgcttgcattagtgtgattactgctttgggatatgactattgcctaaactcagtttttcctcctataggaatacgtcaacgttg

SEQ ID NO: 595 - DNA, 1135 bp, Tripterygium wilfordii
gattcttagattccgctctctagggaggtcatttgaggagttgggtctctctctctctctctctgcaaaatgaaagtcactgttgtttcgcgcagcggtagagaagttatcaaaggaggactcgagctcagtgactcggcaacggtggcagatctgcaagaagcaattcatcggcgaactaaaaagttctacccttcaaggcagcggctgaccctcccccagaaacctggatcgaaagagagacctgttgtatttaactataagaagagtctcaatgaatactgtgatggaaattcagagagcttaactgtagtgttcaaggacctgggtccacaagtttcctaccgtacacttttcttctgggagtatgttggtccttttgttctctatcccatcttttactacttccctgtgtaccaattatttggctatgagggagagcgtgttatccgcccggtacagacatatgccgtatactactggtgtttccactatttcaaacgtattatggaaacattttttgtgcatcatttcagtcatgcaacctcgccactctcaaatgtgttccgaaattgtgcttattactggtcttttggtgcttatattgcatattatgtgaaccacccactttactctcctgttggtgacctccaaacgaagatcggctttgggattgggttggtttgtcaacttgcaaatttctattgccacattttgctgaagaatcttcgtagccctgatgggaatgggggatatcagatcccacgaggatttctgttcaacattgtgacttgtgccaattacactacagaaatttaccagtggctgggattcaatattgcaacacaaactgtcgctggttatatctttatgatagttgctactcttatcatgaccaattgggcccttgcaaagcaccgtcggttgaagaagctatttgatgggaaggagggaaggcctaagtatccacgacgatgggtgatattacctccatttctgtagaaactacttccaatgccgactcattcagtctcttcataatcgtgactggtttgtattcaactgcatcggtacagacctgtatcaagtttcattctgctcagatacaaaaagtcttggatccattttgaagcaa

SEQ ID NO: 596 - DNA, 2083 bp, Hordeum vulgare
acatatgatgatgcagtatatagtattgtttaatgtatgaaatgccaccagtctgaacttttgagatgcagattagattaatattgtcctgatggttttgtgcctctgaattaagaaacagctatatcctggaacatagtgataatccatgtcctgatcttggtcaaatattttttctagaggacttgctcaaatatgttagaaacttgaaaacaattccatcctcattctgcaacctttttgcttgttgtagtttatttttgtttgttgccataaatagctccatttttcaacattgtctagcatttctaattctgatcataccagagaagtgtagcatgccctgctagatgcatactgttgctgttctgcttttgagcctgcaccataagctgctaatgttgagaacaatgttatcattagatcttccctatgcatgaaacccacttctctggtggatttctgtgggtgaattattaatgagctagattgacatgattgatcgtattttcctttatgcttctgtgctttctgtatgaagagcacatgttttcccttaagatgtatgggttggtaatcacttgtgtctacaccaagcactaagaagtattatcctgctaggcaacggctcaccctccctgcacaacctggaaaatctggaaagccagttgtcctcaatcaaaaggccagcctatcagaatactgtgagaagggttccgggtccctgacagtagtcttcaaagatttaggcccgcaggtctactacagcacgctcttcttctgggaatacgtcggccctcttatcatctaccccatcttctattacctgcccgtctacaaatactttgggtatgagggagagcgggtcatccaccccgtccagacctacgccatgtactacttctgtttccactacttcaagaggatcatggagaccttcttcgtccaccgcttcagccacgcgacttcccccgtgtcaaacgtcttcagaaactgtgcctactactggacctttggagcctacattgcctactactgcaaccaccctctgtacacccccgtgagtgacctgcagatgaagattgggttcggcatcggggtcgtgtgccagatcgcaaacttctactgccacatcctgctgaggaacctcaggagcccgaccggcagcggcggctaccagatcccacggggcttcctgttcaacatcgtgacatgcgcaaactacaccaccgagatctaccaatggctcgggttcaacatcgccacccagaccgtggcgggttacgtcttccttgccgtggcggcggccatcatgaccaactgggcgcttggaaagcacagccgcctgaggaagctgttcgacgggaaggatgggcggcccaagtaccctcgccgatgggtgatccttcctccattcctgtgaagaagacactgtgcttgcaaggctggtatctagagattcaacatttattctgttccagtgttcaaaagttgaaagccatcattcgatttcacgcaaacattcctactaatcgtgccctgtaccagctgtcaaacctcaattatgtagcccaaatgttcttatccgaaggatgtattttcttatcctattgttgaaaaaaattctctggggtttgtcgcgtcgtgttgtcatagtcaagtccaacctcaagatggttcatctgatatgtgtcggcccgtgttccgtgcttctgaaccgtaggatgatgcaagcatattgccattccgatgctttaccatcattcctgcctatgtcatctcatttgaagtttgacaaaatgttccatgtgcctgcttgacattgctgtgtgtgctcatctacaaagtcattagaagaagaagtcaattagggcacggcacattagaagatgatttgctggtcaattaatttatggttggtgatggcacggccactctgctcttgctctctaccagtcacctttttttttgacagtactctctgccagtcagcttccctgtgacttgtcagcctatcttatcaccaccggtcaatgtttttttctctcagaaataaataaattaataccagtcacacaaaacc

SEQ ID NO: 597 - DNA, 1202 bp, Cirsium arvense
cccattttcctagatctatctcattgttttctccgcttgggtttctctggtcgccggaaacatgaaggtcaccgtcaccactcggagtggcagagagttaatcaacggcggtcttgttcttgatagctctgctactgtggctgatttgcaggaagctattcatcaacgaatcaagaagtactatccttccagacaacgcctgaccctcccaatccaaccagggtcaaaggccaagcctgttgtcctccaatccaagaaaagtctcaaagagtatactaccggaagttcagacaacattaccgtagtctttaaggacttgggcccacaagtttcgtatcgcacactcttctttttcgagtatttgggcccactgatcctctatcccgtcttctattacttcccagtgtaccaatttttcggttacaaaagtgaagaacgtgttatccgtccaattcagacgtatgcaatgtactactggtgtttccattatttcaaacgtatcatggagaccttctttgtgcaccgtttcagtcacgcaacctcccctctttcgaacgtcttccgaaactgtgcttattactggagctttggatgttatatcgcttattacgttaaccaccctctttacacacccgtaagcgatctccagatgaagattggattaggatttgggttgattatgcaactttcaaacttgtattgccacatcatactaagaaatcttcggagccccagtgggaacggaggataccaaattccacaagggtttttgttcaatatcgtgacttgtgcaaattacacaaccgagatttatcagtggctgggatttaacatagcaacacagacagttgctggttacatctttctcgtggttgctgcttccatcatgactaattgggcattggctaagcatcgtcgtctcaggaggctatttgatgggaaggaaggaagacccaagtatcctcgccgatgggtaatattgcccccattcctgtaagcgattgattacgaatatgggtttggttctggattatatcagctagatttggttcgtattgttgatttcattctagtcgacatgttcctaaaaaggatcagcagatgttttacttgtttagaacattagtttcttgttgagttgtgaatcatactgcttaataggtcttttatcatgtgtacttgccacagctccatcagatggc

SEQ ID NO: 598 - DNA, 1207 bp, Zostera marina
gggggcagaccataactacgctctctgactgacaggttggagaagatggaggggtattatatatagatcgagaggtgcgaccgtcgtgaagtgtacttctggatttctagggcaaaggattggttggtttctgttcaatccttcaaatcaagcggctgtacggttggttcggtgggtgagataggctgtaatgaaggtttctgttgtctcccgcagtggtagggagatcatcaagggagggatcgacctcaatgattcggcactggtgagcgatctgcaagatgcgatttattcgaggacaaaaaattctatccggctagacaacgtcttacccttccgttggcatctggaacccaggggaagcctgtcgttctgaactcaaaaaaaactcttcgagattacagcgacaaaggaaatgcagataatttaacagttgttttcaaggacttaggaatgcaggtttactacagtacccttttcttctgggagtacctgggaccattgattatctacccactcttttaccaccttcctctttacaagtattttggctataaaggcgagcgtgtcattcacccggttcagacctatgccatgtactactggtgtttccattacttcaagcgtatcgtggagacttttttcgtgcatcgttttagtcatgcaacctctcctctatcaaacgtgttcagaaattgtgcatactactggtctttcggagcatatattgcctattacgtcaatcacccattctatactcctgttggcgatcttcgaataaagattggtctgatttttggattgatctgtcaagtttcaaacttctattgccatatcatattgcggaatctcagaagtcctagtggcaatggtggatatcagatcccacgtggattcttattcaacatagtaacttgtgcaaactacacaacagagatttatcagtgggtgggattcaatatcgcgacacaaacatttgctggttatttgttcttggtagtggcagcttctataatgactaattgggcatttgctaaacacaaccgcctgaaaagaatatttgatggcaaagaagggcgacccaagtatccacgacgctgggttattattccaccttttatctgataattgaaatggattgagccagcgtggatactgcttgttttcaggattatggtattattagaaaacttttggtttcagtctg

SEQ ID NO: 599 - DNA, 1338 bp, Ambrosia trifida
actaacctttcatttacatctcattcattactcagaccggactggttcgacctcaagtggttgcatctactcatctacccaaccatacgcctttaaaattcccatctaaatctctcctatttcatccgttactgggacctcactccattaatccctccctcctccctatattattattctctagatctcattgttttctccgtttcatcttaatagctgcaaaacatgaaggtttccgttactacacggagcggtagagagctcatcaacggtggccttgtccttgacacctctgctactgttgctgatttgcaggaagcaattcatcagcgaatcaagaaatactatccatccagacaacgtcttaccctacccctccaaccgggctcaaaggaaaaggccgttgttcttcaacagaagaaaagtcttaaagagtacacaagtggaaactctgacacccttactgtagtgtttaaggatttggggccgcaagtgtcataccgcacactcttcttttttgagtatctgggcccgttaattctgtatcctgtcttctattacttccccgtgtaccaaatacttgggtacaaaggtgaacgggttatccatccagttcaaacatatgcattatactactggtgtctccactatttcaaacgtatcatggagaccttttttgtgcaccgtttcagtcatgcaacttcacctctttcaaatgtgtttaggaactgtgcttattactggacttttgggtgttatattgcttattatgttaatcatcctcattacacacccgtaagtgacctccagatgaagattggattcgggtttggattggttatgcaagttgcaaacttgtattgccacatcatactcagaaatctcaggagcccgagtgggaatggagggtaccaaattccacaagggtttttgtttaacattgttacttgtgcaaattacacaactgagatttatcaatggttgggtttcaatattgcaacacagaccgttgcgggttacgtctttcttgttgtggctgcttccatcatgactaattgggccctggctaagcatcgccgtcttaggaggctctttgatgggaaggaaggaagaccgaagtaccctcgcagatgggtgatattgcccccgttcctgtaaacgactgcaaacatgggttgtacctcattttcctttgttttggactatcaactggtttgattgtatcctgagcttattctagtcagcagattgtttagaacttttgaattgtgaatcatacagctgatttgtatttgttagttttgaatctttatctttgtgaaatctggatatttagca

SEQ ID NO: 600 - DNA, 1400 bp, Eschscholzia californica
gagaagttggtactagtcagtcagataactccaatctggatctcacctataaacaatctagaaagcacagcagtctgataaagttcattgaattgaataaattgggggattgggttttcatggatttgagtttctattttaggttattgtgatcttgttcaaaacatctactactctttgcaaaattcaactacccatttctctgtttctgtagtttgtggtttcctcttatcgtagcctcgaagatgaaggttactattgtttctcgaagtggtagagaaatcgtcaaaggtggaattgagctcaatgattcggctaaggtgactgatcttcaggaggctattcatgtccaaaccaagaagtactatccttccagacaacgtctcactctccccctcaatcctggatcgaaagagaaacctgttgtcctcaactccaagaacaacattcgtgattattgtgatggaaaccaagataacttaactgtggtattcaaggatctaggcccacaagtttcctaccggacgcttttcttctgggaatatgtgggtcctttgattatctaccccatcttttactacttccccgtctaccaactcttgggctacaaagagaagattattcacccatttcagacatatgctatgtattactggtgcttccattacttcaaacgtatcatggagacgttctttgtccatagattcagccatgcaacatcacctgtctccaatgtgtttaggaactgtgcctactactggacattcggggcatatattgcttactatgtaaaccacccattttacacccctgttagcgatctccagatgaagaccggattcgtgtttggtttagtttgccagatttctaatttatattgccatcttttgctgaggaaccttcggagccctagcggcaatggaggatatcaaatcccgcaaggttttctattcaatttagtgacgtgtgcaaattacacaacagaaatatatcaatggttgggttttaatattgcaacacagacagtcgctggttatgtttttcttgtggtggctgcatctatcatgaccaactgggctcttgcaaagcaccgtcgtctgagaaagttatttgatggcaaggaggggagaccaaaatatcctcgacgatgggttattcttccaccattcctctgaggagcttctagagagatcttcggctggtaccgttgctacgaacttctttggttttactttttctgttcacctttgtcatgggacagaaatctattcaagtcatgctgtttaggtactgaagaaaagtattaatctctgatgtctttttgtttcgtcacaagcgtatgatcgatcatttggagtccccattctactccttttaatttaatgtaacctaatgatttt

SEQ ID NO: 601 - DNA, 1583 bp, Pinus taeda
cgttgttggcagaaggatcatggttgggtaattgaatttttgtcgatgaatttggtagggtagctctcctaccacattcaattgaatttcatttcgtcaagttctcaccaatgcatttagcaactccaccctccaaaccagccacaaaacaaatacacaccaacattgctttactcacaccgtaacaaaaccgattttcgatctccaatggtctgtcatacccatttaatgcttcattcactcaaagccacagcacagggttcagtcatcaatacgcccacttgttctgctgccaaacttcaccaacaggcaaccattcattcattgaggccaacgcccaacactatattttgtgcttcagccaatcccttgcagtcataccgataacagagggtattgggaagatgaaggtctccgtggtatctcgaagtggcagagaaattatcaagggtggcatcgatctgagtgataatgccactgtggatgatctgaaagcctcgattcaacaaagagtcaagaaatattatacggcccggcagcgacttactctgccacaatctggaaaagggaaaccagttgttctggaaagaggcaagaggctcaaagattattttgaaaaagatgagggaaagttagtagtagtgttcaaggatttagggccacaggtctcctacagcactctttttttctgggaatatgtcggccctctgttcatttatcccatcttctattacttccctgtctacaagtactttggatatcctgcagaaagagttatacacccagttcagacatatgcaatgtactattggtgctttcactatgccaaacgcattttagagaccttttttattcacaggttcagccatgcaacttcaccactctctaatgtgtttagaaactgctgttactactggacctttggtgcagtcatagcttattttgtcaaccatcccctctacacccctgtgagtgagaagcaaatgaaaattgggtttgggctggggattgtatgtcagttagcaaacttttactgccatattttgttgagaaatctcaggagcccggaaggtaaaggaggatatcaaattccaagtggattcctgtttaatatagtcacatgtgctaactacaccactgagatctatcaatggttgggattcaatatcgcaacacagacagttgctggctacacctttctggttgtagcaacctttattatgactaactgggctcttgccaagcaccgccgtttgaagaagttgtttgatggcaaagatggcagacccaaatatccaaggcgatgggtgatattacctcctttcctatgaaaaggatgcttattaattctggggacactttcgttgatttctatattgaattgtcaacaaaacttgggcccttttctggttctacaatgtctaaaatttggtggctttagcatgatcggacgttgtaattgactgttttgtggctttaatttatttaattgtgcttgcttaagaagctagtaagagtgaatttctcacctgggtatgttcccggtatttcaaatggagtatttttaattactatttttgctg

SEQ ID NO: 602 - DNA, 1322 bp, Ambrosia trifida
tttactcagactagactggttcgccctcaagtggttgcatctactcatctaccaaccatacgcctttataatccccatctaattctttcctatttcatccgttactgggacctcactccatttatccctccctatattattctctagatctcattgttttctccgtttcatcttaatccctggaaacatgaacgttaccgttacttcacggagcggtagagagctcatcaacggtggccttgtccttgacacctctgctactgttgctgatttgcaggaagcaattcatcagcgaatcaagaaatactatccatccagacaacgtcttaccctacccctccaaccgggctcaaaggaaaaggccgttgttcttcaacagaagaaaaagtcttaaagaatacacaagtggaaactctgacacccttactgtagtgtttaaggatttggggccgcaagtgtcataccgcacactcttcttttttgagtatctgggcccgttaatcctgtatcctgtcttctattacttccccgtgtaccaaatacttgggtacaaaggtgaacgggttatccatccagttcaaacatatgcattatactactggtgtctccactatttcaaacgtatcatggagaccttttttgtgcaccgtttcagtcatgcaacttcacctctttcaaatgtgtttaggaactgtgcttattactggacttttgggtgttatattgcttattatgttaatcatcctcattacacacccgtaagtgacctccagatgaagattggattcgggtttgggatggttatgcaagttgcaaacttgtattgccacatcatactcaggaatctcaggagccctagtgggaatggagggtaccaaattccacaagggtttttgtttaatattgtgacttgtgcaaattacacaactgagatttatcaatggttgggttttaatatcgcaacacagactgttgcgggttacgtctttcttgtggtggccgcttccatcatgactaattgggccctggctaagcatcgccgtctcaggaggctctttgatgggaaggaaggaagaccgaagtaccctcgcagatgggtgatattgcccccgttctgtaaacgactgcaaacatgggttgtacctcatcttcctttgttttggattatcaactgggtttgattgtatcctgagcttattctagtcagcagattgtttagaacttttgaattgtgaatcatacagctgatttgtatttgttagttttgaatctttatctttgtgaaatctggatatttagcaactttgcattatcttgtgttt

SEQ ID NO: 603 - DNA, 1312 bp, Papaver somniferum
gcaaaaagagagattggattgagattcaacttgtgtcgagaaatatgaaggtcactgtggtttctcgaagtggtagagaaatcatcaagggtggaattcaactcagtgattcggctactgtgagtaacctacaggaagctattcatgctaaaacaaaaagtactatccttcgagacaacgtctcactcttcccgtcagtcctggatccaaagacaaacctactgtgctcaactccaagacgaatttatccgattactgtgatgctaagaaggataacctgacagtggtgttcaaggatcttggtccacaggtttcataccaaatacttttcttctgggaatatgtcggccctctcgtcatctatcctctcttttactacttaccagtgtacaagttcttaggctacaaagaggagcgtgtaattcatccagtccagacctatgccatgtactactggtgtttccactacttcaaacgtattatggaaacattctttgttcacagatttagccatgccacttctcccatttcaaacgtctttaggaactgcacttactattggtcttttggcgctttcatagcttactatgtgaatcacccactttataccccagtcagtgacctccaaatgacgataggctttgggtttggtataatttgtcaagtttctaacttgtattgccatcttatactgaggaatcttcgtagccccagcggtaatggaggataccaaatcccatatgggtttttgttcaatatagtgacttgtgcaaattacacaactgagatctaccagtggttgggtttcaacattgcaacacagactgttgcaggttatgtattcctagtggttgctgcttctatcatgtccaactgggccttcgcaaagcaccgacgtctgagaaagttatttgatggcaaggagggaaggccaaaatatcctcgaagatgggttattcttcctccattcctctgaaaatgtcagtcagaaacctgcctccagctacaaagtaagatgaatgctctactcattgaatagactgcttcctcgtctgctgtacctttatcatgcctcgccaaaaatctagttaatttgattcagatcagattctgtaggttttgcagaaaagttaaccttggattttctcatcttttttatgacaattgttaaactagagattgcatctacttggtgtaatttactgtaattggactattttgaaggttactttcgtgatgatcttcatttttatttcatgcaaaagaggtaaaacattaatccatggctgtatgatttaaacaccttctagcc

SEQ ID NO: 604 - DNA, 1422 bp, Musa acuminata
cggaccggcaatttccaacggctgttaatcaccaaagggcgtggtaacgatgcgctgccgcaagatctcgcttttccttcccttatcgtatcactggtagtgtgccttggaacgggacaccgctcaccgaagccggccaacgccaccaggtccgaccaccatctcgctttttcttcctcgttgagttggtagcattttgaggtgggaaggaatgaagatcatccttgtttcccgcagcgcaaaggaggtcatcaagggtgggattgagctccacgatgaggccactgtgagcgatctgcaggaagcaatttatgcccgaaccaaaaaattctatccttcaagacagcgcctcaccctgccattgcaatctgggaaccagggaaagccagttgtccttagtccgaagaaaaaactggtagaatattgtgatgggaatgccaagactctcactgtggtattcaaggaccttggagtacaggttttatacagtactcttttcttctgggagtacctgggtcctttaattatctatcctatcttctactactttccagtgtacaagtactttggttatgagggtgaacgggtcatatacccagtccagacatatgctacgtgttactggtgcctccattacttcaaacgtattatggagactttcttcgttcacagattcagccatgctacttcacctctctccaatgtgttcaggaattgcgcctattactggactttcggcacatacgttgcatatcatgtgaatcatcccctgtacacacctgtcagtgatctgcaaatgaagattggatttggatttgggttgatttgccaagtctctaacttttattgccatcttatattgaggaatctcagaagctctgatggtaatggtggttaccagattcctcgtggctttctgttcaacatagtgacttgtgcaaactacacaacggagatctatcaatggcttggtttcaatattgctactcaaacaatagcaggttatgttttcctcgtggtggctacactcatcatgacaaattgggccctcgccaaacaccgtcgcctcaagaagttattcgatggaaaagacggacggcctaggtatccacggcgctgggtgatacttcctccattcatctaagtaagatggaaaagaccggcggcctaggtatccatggcgctggctgatacttcctccattcatctaagcacaggcattttacttgcttctaaagtctgaaatttcaagccaaacatgttatgggagttggaaaatactcatcttaggcagctgaattatgtaattgccatgcacaactgaaatgcttgttgctgcatgcacattttagctttatgaaatctgttgtttgatttattaaccaactgttgcactcaaagtagttcatttttaggttaatc

SEQ ID NO: 605 - DNA, 1591 bp, Pinus pinaster
aaggcatcatggttgggtaattgaatttttgtcgataaatttggtagggtagctctcctaccacatccaattgaatttcatttcgtcaagttctcaccaatgcatttagcaactccaccctccaaaccagccacaaaacaaatacacaccaacattgctttactcacaccgtaacaaaaccgattttcgatctccaatggtctgtcatacccatttaatgctgcattcactcaaagccacagcacaggcttcactcatcaatacgcccacttgttctgccgccaaacttcaccaataggcaaccattcattcattgaggccaacgcccaacactatattttgtgcttcagccaatcccttgcagtcacaccgttaacagaggggattgtgaagatgaaggtctccgtggtatctcgaagtggcagagaaattatcaagggtggcatcgatctgagtgataatgccactgtggatgatctgaaagcctcgattcaacaaagagtcaagaaatattatacggcccggcagcgacttactctgccacaatctggaaaagggaaaccagttgttctggaaagaggcaagaggctcaaagattattttgaaaaagatgagggaaagttagttgtagtgttcaaggatttagggccacaggtagcctacagcactctttttttctgggaatatgtcggccctctgttcatttatcccatcttctattacttccctgtctacaagtactttggttatcctgcagaaagagttatacacccagttcagacatatgcaatgtactattggtgctttcactatgccaaacgcattttagagaccttttttattcacaggttcagccatgcaacttcaccactctctaatgtgtttagaaactgctgttactactggacctttggtgcagtcatagcttattttgtcaaccatcccctctacacccctgtgagtgagaagcaaatgaaaattgggtttgggctggggattgtatgtcagttagcaaacttttactgccatattttgttgagaagtcttaggagccccgaaggtaaaggaggatatcaaattccaagtggattcctgtttaatatagtcacatgtgctaactacaccactgagatctatcaatggttgggattcaatatcgcaacacagacagttgctggctacacctttctggttgtagcaacctttattatgactaactgggctcttgccaagcaccgccgtttgaagaagttgtttgatggcaaagatggcagacccaaatatccaaggcgatgggtgatattacctcctttcctatgaaaaggatgcttattaattctggggacactttcgttgatttctatactgaattgtcaataaaacttgggcccttttctggttctacaatgtctaaaatttggtggctttagcatgatcggacgttgtaattgactgttttgtggctgtaatttatttaattgtgcttgcttaagaagctagtaagagtgaatttctcacctgggtatgttcccggtatttcaaatggagtatttttaattactatttttgctgttttttgaagtatctgttc

SEQ ID NO: 606 - DNA, 1279 bp, Quercus alba
tcgattacttttattgcattgcaaattgcaattcccaaatcccaagcaagcatgaaggtcactgttatcactcggagcggtagagaaatcatcaaaggcggcctcgacctcaatcactctgctacggtgagtgatctgcaggaggctatacatcgacgatgcaaaaaatactatccttcaagacagcgtattactctacccgtccaacctggatccaaagaaagacctgttgttctgaatcccaaaaaaaaaattgaagattactacgatggaaaatcagatcacttgactgtaatattcaaagacctgggtccacaggtctcctaccgtacactcttcttctgggagtatttggggcctttgataatctatccaatattctactactttccagtatatcagtactttggttatggaggggagcgtatcatccacccggttcaaacatatgccttgtactactggtgcttccattacttcaaacgtattatggaaactttttttgtgcataggtttagccatgcaacttcacctctatccaatgtgtttcggaactgtgcatattattggacttttggctcactcattgcatactatgtgaaccacccattatacaccccagtgagcgacctacagatgaagattgggtttggatttgggttaatatgtcaaattgcaaacttctattgccatcttattctgaaaagccttcgcagccctgatggaagtgggggatatcaaatcccacatgggtttttgttcaatattttgacctgtgcaaattacaccactgagatttatcagtggctgggctttaatattgcaacacaaactgttgctggttctgtattccttgtggtggctgcttttataatgactaattgggccctcgcaaagcaccgtcgcttgaagaagctttttgatgggaaggaaggaaggccaaaatatccacggcgatgggtgattctgcctccatttctgtaaaaattaaagaatacttaccataattggaccacaggtaatggtgttattttaagaatgttcaaggacacaatctttcttttttttgggtaatcattccgtccaaagtcatttccttagtctgatttatttattagacaattgaaaaatgtaagtagagccataggaatgattaactatggctggacctccttttcataaaaattgtgatgagctcttaatgttcaattttgttgttttggaggattctttctgtattgttgagaatgtattggtcctacttatatttgactatact

SEQ ID NO: 607 - DNA, 1201 bp, Petunia hybrida
agtgttgttggaaagaaaagaaatgaaggtttcagtggttacacgcagtggcaaagaactcatcaagggtggccttgatctctctgattctgccacagttgttgatttgcaggaagcaattcataaaagaaccagaaaatactatccttctcgacagagactcaccttgcctgtccaacctgggtcgaaggagaggccaacagttcttcactacaagaagaatctccaggaatatgctgctggaagcaaaagcgagttaaccgtagttttcaaggatcttggtccgcaggtcaactatagtacacttttcttctgggagtatttgggtccactgctactctatcctatcttttactactttccggtctacaagttttttggctacaaagaagagcgtgttatccaccctgcccagtcttatgccatgtattactggtgtttccactacttcaaacggatcatggagaccttctttgtgcaccgcttcagccatgccacttctccactttccaatgttttccggaactgtgcctattattggtcttttggagctttcattgcttactatgtgaatcatcctctttatacccctgtaagcgatctccagatgaagattggatttggttttgggatagtttgtcaagttgcaaacttctattgccatttatcgttgagaaatctccgaagtcccagtggtaatggaggtcaccaaataccacgtggcttcttgttcaatattgttacctgtgcaaactacacaacagagatctaccagtggttgggcttcaacattgctactcagacaattgcaggctatgtcttcatgattgttgctgctagcatcatgacaaactgggcccttgctaagcatcgccgtttgaagaagctctttgatggaaaggaaggaagagcaaagtatcctcgacgatgggttatattgcctcctttcctgtagaaatgtggagaagcctgagaattattcatttagttgaccattttctgtaaaccctgcggcctttgaaggcttatgtttctcattaaaggttttaacactcatcagatttttcccttcttgtatttctgttccctatcttagcaatctttttagaccagatttctgtatttctcaacttcttgtaatggcttctagaccatctttgttatcctaaatagttgcagtaatcgattatttatgaaaccc

SEQ ID NO: 608 - DNA, 1464 bp, Cajanus cajan
aaccccaactgcttcacattaatggatgcatatgaatgccacacctcacattaatttatatattattactatggaaattcaattttcttaagctcacatttcctttgtgttgtgtttgtgagtaactggcaaagccaaacacacacacaacacaaaccttctctctctcttcgtccaattcagtccttggtgctgttggatcttgcttataacccttgattgattcgcaaagatgaaggtcacggtggtttctcgcagtggaagagaagtggttaaaggtggcattcagctcgacgattctgctactgtagcagatctgcaggaagcaattcataagcgaaccaagaagcacccatcaaggcagcgcttgacacttcccgtccaacccggatcaaaggaaaggcctgttgtccttaattacaaaaagagtctgaaagactttacaagtggaaattcagaaaccttaactgttgtattcaaggacttgggccctcaagtttcttatcgtacacttttcttctgcgagtatttggggcctttgcttctctatccagtcttctactatttccctgtgtaccaatattttggttacaaaggtgaacgtgtcatccaccctgtgcagacatacgccttgtactattggtgtttccactatgccaaacgaattctggaaacatttttcgtgcatcgcttcagccatgcaacctcacccctttccaatgtgtttcgcaactgtgcttattactggacttttggttccttcattgcttattatgtgaaccaccctctttatacccctgtaggggatctccaaatgaagattggctttggctttgggatactctgtcaaatttcaaatttctattgccatattatactgaagaatcttcgcagacctgatggcgaaggcgggtaccaaatcccaaagggctttcttttcaatattgttacctgtgcaaattatacaactgagatttatcagtggttgggcttcaacattgcaacgcaaactatcgcaggttatattttcctcgtagttgctacttttatcatgaccaattgggcttttgcaaagcacaggcgtttaaggaagttatttgatggaaaggatgggagacctaggtatcctcgtcgatggataatattgcccccattcctgtagaagccatagccactgatgagggtcaccactctgctcacaggattctgagatttagaaatgtagcataatggaattttggtgatctatttttattagatatggatttgtcttgcaatgcttttgactacgtagttgattacgaaattgttgaattagtgttttgcagaatatttgtaaccatttcaagattgtagcactactggggattcttgtttcttaatcttcttgtgatgaccgtattcatgtttctttttaatttttgttcgctacttccgttactgttaagtaatgtttcatcaatc

SEQ ID NO: 609 - DNA, 1191 bp, Solanum tuberosum
ggtggttacacgtagcggcaaagaactcatcaagggtggacttgaactcaatgattctgctacagttgctgatctgcaggaggcaattcataaacgaaccagaaaattctatccttctagacaacgactcactttgcctgttcaacctggttcaaaagagaggccaactgttcttcactaccagaagagcctaagtgagtatactaaggggagcacaggtgaattaactgtagttttcaaggatctgggtccacaagtcaagtatagtacacttttcttctttgagtatctgggtcctctgctactctatcctatcttttactacttcccagtctacaagtattttggctacaaagaagagcgtgttatccaccctgttcagacttatgccttgtattactggtgtttccactacttcaaacggatcatggagaccttctttgtgcaccgcttcagccacgccacttctccaattgccaatgtttttcggaactgtgcctattattggtcttttggagctttcattgcttacttcgtgaatcatcctctttatactcctgttagtgatctccagatgaagattggatttggatttgggatagtttgtcaagtggcaaacttgtattgccatttattgttgagaaatcttcgaagtcccagtggtaatggaggttaccaaataccccgtggcttcttgttcaatattgtcacctgtgcaaattacacaacagagatctaccagtggctgggcttcaacgttgctactcagactgttgcaggctatatcttcatgattgttgctgctagcattatgactaactgggctcttggaaagcatcgccgtttgaagaagctctttgatggaaaggaaggaagaccaaagtatcctcgacgatgggtgatattgcctcctttcctgtagaccatttcctcgacaatgtgagaaagcccgagagttatttatttagttgatcattttctgtgaacctgcaacttttgaaggtttatgtttctcactaaaggaagcaatactcagatttttcttttgtattactgttccatgtcttacctcttattataccagatgatctgacttccatgatatttgtagttctcacttctttgtgatggcttcaagaaccatctttttttatatctattgtttatgagttaggaaagtgatcttataat

SEQ ID NO: 610 - DNA, 1268 bp, Rhizophora mangle
gggattcaaactcaaaagcccgtctctgagtttgattagatctccgcaatgaaggtcactgtggtttctcgaaatggcagagaggtcgtcaaaggaggccttgagctcagtgattcggcgaaggtgattgatctgcaggaggcaatttaccgtcggaccagggaattctatccttcaagacagcggttaacccttcctctttcaccgggatcaaaggagaggcctgtggtccttaactgcaagaagagtgttaaggaatactgtgatggcaatttggataacttaactgtagttttcaaggacatgggtccacaagtctcctatcagatactttttttctgggagtacttgggtcctttggtcctttaccctgtcttctactacttccctgtataccaatactttggttataagggggagcgggtcatccaccctgtccaaacatatgctttgtactattggtgcttccactacttcaagcgtatcatggaaacgttttttgttcaccgatttagccatgccacttcacctctctcaaatgtgttccggaattgtgcttactattggacatttggctcctacattgcttattatgtgaaccatccactttacacccctgttagtgatcttcagatgaaaattggctttgcctttggtttactttgtcaagtttcaaatgtatactgccatttgattctgaggaatcttcggagtccagatggaagtggagggtatcaaatccctcgtgggtttctctttaatgttgtgacctgtgcaaattacaccacagagatttatcagtggcttggtttcaacattgcaacacagactgttgcaggatatgtctttctagtggttgctactggcatcatgaccaattgggccctaacaaagcaccgccgtttgaggaagctttttgacggcaaggatggacgacctaaatatccacgccggtgggttatactgcctcctttcctgtagaattgatggtacttcagcagcatcaatactggattatggtatctttcatcagacacaaagtggagatcatgttttcacccagttgcttggagacaataggcattacatttagacagcacaaaacagtgactcttcaggaatatcaaacctttcacctcttccagtcttctagtctatggaataatctggggactttaatttcagcacttgcattaatctgttgaattgtgtgtcctttctgatctttgatatatcttgagttattattttcctccattcacaactac

SEQ ID NO: 611 - DNA, 1223 bp, Helianthus annuus
ggaaagatgaaggtgaccgttactacgcggagcggcagagagttaatcaacggtgggcttgttcttgatgactctgctactgtggctgatttgcaggaagcaattcatcagaaaatcaagaagtattatccttcgagacaacgtctgaccctgcctgtagaaccgggctcaaagaagaagcccaccgttctccaacacaagaaaagtctcaaagagtacacaaccgaaaactccgacaccattaccgtagtgtttaaagatttgggcccgcaagtctcataccgtacactcttctttttcgagtacttaggcccgttaatcctctatcccgtcttctactacttcccagtgtaccagtttttcgggtacaaagatgaacgggtcatccatccggttcaaacatacgcaatgtattactggtgtctacactatttcaaacgtatcatggagacctttttcgtgcaccggttcagtcacgcaacatcacctctttcaaacgtgtttcggaactgtgcttattactggactttcgggtgttacattgcgtattacgttaatcatcctctttacacgcctgtaagtgatctccagatgaagattggattcgggtttgggttggttatgcaagttgcaaacttgtattgccacgtcatactaagaaaccttaggagcccgagcgggaacggagggtaccaaattccgcaagggtttttgtttaatattgtgacgtgtgcgaattacacaaccgagatatatcaatggttgggatttaatgttgcgacacaaactgttgcgggttatgtctttcttgtggttgccgcttccatcatgactaattgggccctggctaaacatcggcgtctcaggaggctctttgatgggaaagaaggaagaccaaagtaccctcgccgatgggtgatactgcccccattcctgtaagcgactacaaacatgggttgtatgtcgttattaatagcttgggtttatcagctagatttggctgtatcgtgagttgtttttcgtcaacacatgttttttacttgtttagaacttttgtttcttttgtattgtgaatcataccatgtgtacttgctagttgctacataagacttttggatttagctgatttgtatttgctagtttgagtctttcttttgtgtttacttgtcacatatatgatcaattcctgcttgaaaatcgattgttgacttagtttataatac

SEQ ID NO: 612 - DNA, 1216 bp, Abies balsamea
aatacacaccaacattgcttcctccaccataacaaaggctgtcatacccatttaatgcttcattcacttatcatacccaactcaaagctatagccaagccttcatcaatacacccacttgtcctgctgtcacaaattccacctacaggcaaccattcattcattgaggccaaaccccaacacgatatattgagcttcagcaaatctgttgcggtcttactgataacagtggggattgtgaagatgaaggtctcggtggtatctcggagtggaagagaaattataaagggtggtatcgacctgagtgataatgccactgtggatgatctgaaagcctcgattcaacaaagagtcaagaaatattatgctgctcggcagcggcttactctgccacaatctggaaaagggaaacctgtcattctggaaaggggcaagaagctcaaagattattttgaaaaagatgagggaaatctagtggtggtgttcaaggatttaggtccacaagtagcctacagcactctttttttctgggaatatgtcggccctctgttcatttatcctatcttctattacttccctgtctacaagtactttggatatcctgcagaaagagttatgcacccagttcagacatatgcaatgtactattggtgctttcactatgccaaacgcattttagagaccttttttgttcacaggttcagccatgcaacttcaccactttctaatgtgtttagaaactgctgttactactggagctttggtgcagtcatagcttattttgtcaatcatcccctctacacccctgtgagtgagaaacaaatgaagattggatttggtctggggattgtgtgtcaggtagcaaacttctattgccatattttgttgaggaatctcaggagccctggaggtagaggaggatatcaaattccaagtggattcctgtttaatatagttacatgtgctaactacaccactgagatctatcaatggttgggattcaatattgcaacacagacagttgctggctacacctttctggttgttgcagcctttattatgactaactgggctcttgccaagcaccgccgtttgaagaagttgtttgatggcaaagatggcagacccaaatactccaaggcgatgggtgatattacctcctttcctatgaaagggtgcatattaatgtgtgagactacttttgttcaattctatta

SEQ ID NO: 613 - DNA, 1612 bp, Trifolium pratense
tgtcctaccctaaccatattccattaatgcatacataaacttatacctcacctcatcttctactaaccatacctctcattcatttttccttctccttcataaattctccatttttctctccaattttcaaaacccttaattttgctttgtctttgaggtacttccaaaactcacacactcttcccccaattcagtgatttgtgtgaagtgtgttgctgacactgtttggtgaagtgggtgtgttttggttttgaagatgaaggtcactgtggtttctaggagtggaagagagattgttaaaggtggaattgagctcaatgattctgctactgtagcagatctgcaggaagcaattcacaagcgaaccaagaagcatccatcaaggcagcgcttaacacttcccgtccaaccaggatcaaaggaaaggcctgttgttcttaattataagaagagtctgaacgactatacaagtggaaattcagaaaccttaaccgtaacattcaaggacttaggtccacaagtttcttatcgtacactattcttcttcgagtatttggggccgttgcttctctatccagtcttctattacttccctgttgtctatcagtactttggttacaaaggcgaacgtgtcatccaccctgtgcagacatatgccttgtactattggtgtttccattacgccaaacgaattctggaaacatttttcgtgcatcgcttcagccatgcaacctcccccatttccaatgttttccgcaactgtttgtattactgtacctttggctcatatattgcttattatgtgaaccatccactttatacccccgtaagtgaccttcaaattaagatcgggtttgggtttggaatactctgtcaaatttcgaatttctattgccatattattctgaggaatctccgtggacctgctggagaaggtggatatcaaatcccacgcggctttctcttcaatattgttacttgtgcaaactatacgacagagatctaccagtggttgggattcaacattgcaacgcaaaccattgccggttatatcttcctcgctgttgctacttttatcatgaccaactgggctcttgctaagcacaggcgcttgaagaagttgtttgatggaaaggaagggaaaccgagatatcctcgtcgatgggtgatattgcctccattcctgtagaagcctaagccactagtgattatgaggtcaccgttatgtgctcacaggattctgagatttagaaatatagcataatgaacttttagtcaattattctgatattattagatatgaatttgtctttcaatgtttgatctattaaattgatttccaagttattgaagttgtttttattggatatttgtaatcgtttatcgtatttagaatcttgtttcttaagaatcttcatcttgtgatagattgtatttgatgtttctattgtattgtgtttggcttcctcctttaatgtctgcataataagagttcaatttctagctcagacacaccaatgctaaagcttttatatttatatctataagttgtttccatctttgataagttggtcaccagctcatagagatatgataaggacttgtattaagc

SEQ ID NO: 614 - DNA, 1402 bp, Centaurea maculosa
ctacacgcctttaaaattgtcagacttggctcatcatccccataactgataccgtggtgggcccttattacttttcctccttacccataaataaatctccccaaccatcgcctacatttcataattgttttctagatctcaatttctctcattgttttctccgctttgggtttctcccctgatctgatcgccggagacatgaaggtcaccgttaccactcggagtggtagagagttaatcaacggcggtcttgttcttgatagctccgctactgtggctgatttgcaggaagctattcatcaattaatcaagaagtactatccttcccgacaacgcctgaccctccccctccaaccagggtcaaaggcgaagccagttgtcctccaatccaagaaaagtctcaaagagtatactaccggaagttccgacaacattaccgtagtctttaaggacttgggcccacaagtttcgtatcgtacgctcttctttttcgagtatttaggcccactgatcctctatcccgtcttctattacttcccggtgtaccaattcttcggttacaaagttgaagaacgtgttatccgtccaattcagacgtatgcaatgtactactggtgtttccattatttcaaacgtatcatggagaccttctttgtgcaccgtttcagtcacgcaacctcccctctttcgaacgtctttcgaaactgtgcttattactggagctttggctgttatatcgcgtattacgttaaccaccctctttacacacccgtaagcgatctccagatgaagatcgggttaggatttgggttggttatgcaactttcaaacttgtattgccacatcatactgagaaatcttcggagcgcaagtgggaacggaggataccaaattccacaagggtttttgttcaatatcgtgacttgtgcaaattacacaaccgagatttatcagtggctgggatttaacatagcaacacagacagttgctggttatatctttctcgtggttgctgcttccatcatgactaattgggcattggctaagcatcgtcgtctcaggaggctatttgatgggaaggaaggaagacccaagtatcctcgccgatgggtgatattgcccccattcctgtaagcgattgattacaaatatgggtttggttctggattatatcagctagatttgtttcgtttcttgagttcattctagtcgacatgttcctaaaaaggatcagcagatgttttacttgtttagaacattagtttcttgttgagtactgcttaataggtctttttatcatgtgtacttgccacagctccatcagatggcttttgaatttatctgatttgtattagtttgagtatttcttctgtgaaatcttgattttttcgcaaattggcac

SEQ ID NO: 615 - DNA, 1347 bp, Cirsium arvense
atcccaccataactgataccgtgggccctcattactttatcttacccataaataaatctccccaaccatcgcctacatttcattaatcaatcccaatagaaatagatctcaatttctcacattgttttctccgcttgggtttctctcatcgccggaaacatgaaggtcaccgttactactcggagtggcagagagttaatcaacggcggtcttgtccttgattcctctgctactgtggctgatttgcaggaagctattcatcaacgaatcaagaagtactatccatcccgacaacgcctgactctccctatccaaccagggtcaaaggtcaagccagttgtcctccaatccaagaaaagtctcaaagagtatactaccggaagttcagacaacattaccgtagtctttaaggacttgggcccacaagtttcgtatcgcacactcttctttttcgagtatttgggcccactgatcctctatcccgtcttctattacttcccagtgtaccaatttttcggttacaaagttgaagaacgtgttatccgtccaattcagacatatgcaatgtactactggtgtttccattatttcaagcgtatcatggagaccttctttgtgcaccgtttcagtcacgcaacctcacctctttcgaacgtctttcgaaactgtgcttattactggagcttcggctgttatatcgcttattacgttaaccaccctcattacacgcccgtaagcgatctccagatgaagattgggttaggatttgggttggttatgcaactttcaaacttgtattgccacatcatactgagaaatcttcggagccccagtgggaacggaggataccaaattccacaagggtttttgttcaatatcgtgacttgtgcaaattacacaaccgagatttatcagtggctgggatttaacatagcaacacagacagttgcgggttatatctttctcgtggttgctgcttccatcatgactaattgggcactggctaagcatcgtcgtctcaggaggctatttgatgggaaggaaggaagacccaagtatcctcgccgatgggtaatattgcccccattcctgtaagcgattgattacgaatatgggtttggttctggattatatcagctagatttggttcgtattgttgagttcattctagtcgacatgttcctataaaggatcagcagatgttttacttgtttagaacattagtttcttgttgagttgtgaatcatactgcttaacaggtcttttatcatgtgtacttgccacagctccatcagatggctttttgattttatctgatttgtattagtttgagtctttcttctgtga

SEQ ID NO: 616 - DNA, 1257 bp, Cirsium arvense
cagttcatctaccccaactacacgcctttaaaatccccatcaaattgcaaactttggctcataactcataccgtgggccctcattactttatcttacccataaataaatctccccaaccatcgcctacatttcattcattaatcccaaatagatctcaatttctcacattgttttctccgcttgggtttctgccggaaacatgaaggtctccgttactactcggagcggtagagagttaatcaacggcggtcttgtccttgattcatctgctactgtggctgatttgcaggaagcaattcatcaacgaatcaagaagtactatccatcccgacaacgcctgactctccctatccaaccagggtcaaaggtcaagccagttgtcctccaatccaagaaaagtctcaaagagtatactaccggaagttcagacaacattaccgtagtctttaaggacttgggcccacaagtttcgtatcgcacactcttctttttcgagtatttgggcccactgatcctctatcccgtcttctattacttcccagtgtaccaattttttggttacaaagttgaagaacgtgttatccgtccaattcagacgtatgcaatgtactactggtgtttccattatttcaagcgtatcatggagaccttctttgtgcaccgtttcagtcacgcaacttcgcctctttcgaacgtctttcgaaactgtgcttattactggagctttggctgttatatcgcttattatgttaaccaccctctttacacacccgtaagtgatctccagatgaagattggattaggatttgggttgattatgcaactttcaaacttgtattgccacatcatactgagaaatcttcggagccccagtgggaacggaggataccaaattccacaagggtttttgttcaacgtcgtgacttgtgcaaattacacaaccgagatttatcagtggctgggctttaacatagcaacacagacagttgcgggttatatctttcttgtggttgctgcttccatcatgactaattgggcactggctaagcatcgtcgtctcaggaggctatttgatgggaaggaaggaagacccaagtatcctcgcagatgggtgatattgcccccattcctgtaagcgattgattacgaatatgggtttggttctggattatcagctagatttgattcgtatcttgagttcattctactcgacatgttcctaaaaaggatcagcagatgttttacttgtttagaac

SEQ ID NO: 617 - DNA, 1358 bp, Cocos nucifera
cccctctttgcatgcaaccttatcctaccactcccttccctttgaattgcgatagaatggagcaaatagggaaacggtcttttgtgaatcttttattgatgaagttggcagcatggagagtggcgcataaggctcagccagccgtcctacccccaaccacatgccatgcgtgaaatttgagatctccatgccttccagttgcagccccatcctaacgaaccaaaataaatagaaacaaatggtgagcttctgatccccgaggctcgctggttttttccctttgggtcgcctttcttaaatcctcggcgcgagatgaaggttaccgtcgtttctcgtagcggccgagaggtcatcaagggcggaatcgagctcaaggattccccaaaaagtactatccttccagacaacgtcttatgcttccccggcaaccaggagcccaagggaagccagtcgtcctcaattcaaagtcatgcctgacagattattgtgataaaaatgcaaacagtttgactgtggtgttcaaggatttgggcatacaggtcttttacaggacacttttcttctgggagtacttgggccccttgttcatctaccccatcttttactattttccagtgtacaagtattttggttatgagggtgaacatgtcattcatccggtccaaacctatgctatgtactactggtgcttccactactttaagcgtatcatggaaacattctttgtacacagatttagccatgcaacctcacctttgaccaatgtatttagaaactgtgcctattactggacttttggcgcatacattgcttactatgtgaatcacccactttatatgcctgtgagtgatttgcaaatgaagatcggttttggatttggtttgatctgccaagtttcaaacttctattgccatctcttgttgaggaacctcagaagccctgatagcaatggtgggtatcagattcctcgtgggtttttgttcaacattgtgacatgtgccaactacactacagagatctatcagtggctgggtttcaatattgcaacgcagacagtagcaggttatgtgttccttgtggtggctgctcttataatgactaattgggctcttgcaaagcactgctggctgcagaagttatttgatgggaaagaaggaagacctaggtatcctcggcgctgggttatacttcctccatttatctgagcgatggccttttgagttggtttctctaatgttaagatccactcagtcactgaaccttcttagtaatagtttaggatttctgttttaatgaaaacaactaattgtagcagtttgtatttccaaacctttctgcttgttgagattatacattcc

SEQ ID NO: 618 - DNA, 1586 bp, Aquilegia formosa
gggtttcattcgttcggttaccagttctcctaccccaactacacaccattaaactagacttgttaagcttaacttcctcagatcttcccaactacattccaccagcttcatacttcccattaaattcgcataacacttcaagtgcatgagcaatctcacttcagaaaaaaaaaataaaaaatggggattcattcttaaacttgctcttttcacccttttcttcgctctatttgtgtgtgaaacaagttgaatattttaaattacatcaaagggtctttttgttttacagttttgagaagtgggtgtgtgttatttttgtctgaagatgaaggttagtgttgtttctcgaagtggtagagatattatcaagggtggagttgagctcaatgataaggctactgtgagtgatctgcaagaggctattcatcgtcgaactaaaaaatattatccatctagacagcgcctcactcttccgctccaacctggttccaagggaaaagccgttgtccttgaccccaagaaaagtttacgagactattgtgatggaactagtgaaaacttgactgtggtgtttaaagatcttggtcctcaggtttcctacagcaccctttttttctttgaatacttgggtcctctgatcatttaccccatcttttactacctccctgtctatcggtaccttggatacaaagaggagcgcacaattcacccagtgcagacctacgccatgtattactggtgcttccactatttcaaacgtatcatggaaacctttttcgtccataggtttagccacgctacatcgcccatctctaatgtataccgtaattgtttttactattggagctttggcgcatatgttgcttattatgtcaaccacccattatttactcctgtgagtgaccttcaaatgaaaattggatttggtcttgggttgctctgtcaagtttcaaacttttactgtcaccttttgctgaggagccttcggagtccagacggtaaggggggataccaaatcccgcgtgggtttttgttcaacttcgtgacttgtgcgaattacaccacagagatctatcagtggctgggtttcaatattgcaacacagacagttgctggttatgtcttccttatagtggcggcttctattatgactaattgggcccttgggaaacacaggcgtttggtcaagttatttaacgggaaggacggcaagccaaaatatccatggagatgggccatactccccccatttatctaaaaagctacttgtcaacctgttgtttggtatctgctgcaaagttccagtttcttcgtttcatttcaagatccctagagcgatcctgttagattaaccagaaaagaggtgaatttagcttcagggttgttaattattctgtactaaaattaataagattctgaactaaagtaccactttcaattttagtgcttcttttcatgtagtcacctgtgcacgattgcacccttccagtttatagtaatcgtgtttttttttcttgttccgcacttgattgcaatttgcaatagattatagtaatcatgtttaatgcttgaaatgttagatatat

SEQ ID NO: 619 - DNA, 1489 bp, Aristolochia fimbriata
acagagtcaaaagtagcgagttgtatcgcaactcgggaaggcgatgaaaccaatagcggaaaagccaaagaactgctattattgtcgacccgtcgctgatggtagctctccaactccccaaccagaacccattactcctcccgctgcattcaacattcctactccttgacctgcccatcatcccattaacctcttctccattataagttttgtgaaccagaagaggttctccgggaaaagcaaggcttccgagttcgttttgtgttttttcccctgcttaagatcgttcttcgtcgggtgtcccaaatttttctgtttgtgagggtggtctttctcttaatcgaaaatgaaggtgaatctcgtttcgaggagcggcagagagatagtcaaaggtggaatagaaattaagagcgaggctacggtgagtgatctgcaagaggcaattcatcgtcgaaccaaaaagtactatccttctcgtcagcgccttactctccccttaaaacctgggacacaggggagacctgttgtaattagtccaaagaagagccttcaggattatgtagatggaaatgtggacaatttgacggtagtatttaaagatttgggcccccaagtttcttacagtacacttttcttttgggaatacctgggtcctttgaccatctatcccatcttttattactttcctgtctatcaatattttggctacaagggagagcgggtcatccatccggtccagacatatgccatgtattactggtgcttccattacttcaaaagaatcatggagacattcttcgttcacaggttcagccatgccacttcacctgtgtcgaacgtctttaggaactgtgcctactattggacctttggtgcttacattgcttatcatgttaaccaccctctttacactcctgttggcgatcttcaaatgaattttggttttgcttttggtttggtttgtcaaatttccaacttcttttgccacattctgttgcggaacttgaggagcactgatggaaatggagggtaccagattccacgtgggtttttgttcaacattgtgacttgtgcaaattacaccacagagatctatcagtggcttggattcaatattgcgacacagacagttgctggttatgttttcctagtggtggcaactgcaattatgagcaactgggctatggcaaagcatcgtcgtttgaagaagttatttgatggaaaagaaggaagacccaaatatccacgcagatgggtgatccttcctccgttcttctgagctgcgtaggcttctgaagatcaatctggggcgttatgaagatactgttgaagtcttagtcatttgcttatgtgatgcttaaatttgtagtgtttattctatcagaaagttaaattaaggacaagcttcagttgtatccgcggatattattcatttcttttagtcttaggctatttcattcctcaatactatttattcttcttcctctgg

SEQ ID NO: 620 - DNA, 1911 bp, Cedrus atlantica
gacaattaattcattgaggccaacgcccagcactatattttgtgcttcagcaaatctctgctggtcatactgataacagtggggattgtgaagatgaaggtctcggtggtatctcggagtggaagagaaatcatcaagggcggcatcgatctgagtgataacgccactgtggatgatctgaaagcctcgattcaacaaagagtcaggaaatattatcctgctcggcagcggcttactctgccgcaaactggaagagggaaaccagttgctctggaaaggggcaagaggctaaaagattattttgaaaaagatgagggaaatgtagtggtgttcaaggatttaggtccacaggtagcctacagtaccctctttttctgggaatatgtcggccctctgttcatttaccccatcttctattacttccctgtctacaagtattttggatatcctgcagaaagagttatacacccagttcagacatatgcaatgtactattggtgctttcactatgccaaacgcattttagagaccttttttgttcacaggttcagccatgcaacttcaccactttctaatgtttttagaaattgctgttactactggacctttggtgcaattatagcttattttgtcaatcatcccctctacactcctgtgagtgagaagcaaatgaagattgggtttgggctggggattatatgtcagttagcaaacttctactgccatattttgttgaggaatctcaggggcccgggcggtagcggaggatatcaaattccaagtggcttcctgtttaatatagttacatgtgctaactacaccactgagatctatcaatggttgggattcaatattgccacacagacagttgctggctacacctttctggctgtagcaacctttattatgactaattgggctcttgccaagcaccgccgtttgaagaagttgtttgatggcaaagatggcagacccaaatatccaaggcgatgggtgatattacctcctttcctatgaaaggggtgcttattaatgcacgggatacctttattcaaatctagattgatcttgacaaaaacttgggcctttttctggttcgacaatgtctaaaattgtcgcctttagtatgatctggtgttgtaactcactgtattgtggctgtaatttacttaattgtttgcttgcttatttaattatcgcctttagtatgatatgatgttgtaactcactgtttttgtgcctgtaattattatttgagactttctttctctcattcggtcaaggaagaggaggaagacgagcttgggattacggtctgcgaggcatggcgtacatcgagaatgggacagtgaaagcaaagcgttctatgtggaggttgagtttcattgttgatctcttttgggctgtattcactctcataacaaatttcattagaacaatgttctcgatggaggcaacggagtcatacaagaaaaagtctggatcacgtggtggtggctgggatagtggtcctggaggagggggaggttctggtgggggccccaatggaagtggtcctcgtcgaccacctcgtggcctggacaatgtccgagggatcgatcacaattctgctcctgcttgtggctcctgctgtggaggctaactctgtgtggtagttttggggttgagcatggaagtaacatcttttggggcatagtcaactgttttcacaataaaacaaatctgcttgtggagaatttggaacttttattcttcagtgtgcctgaaatatctataattgcagtgtcaagcactgctatctgattataaaatctattttctttggcactgctattatgcatgttcgttaccatactcgttattgataacataggatgtttcttagctgtaccttgtttttaattgatttag

SEQ ID NO: 621 - DNA, 1502 bp, Cirsium arvense
cacagaggagcgcagcagcatcagttgcttctgctcatctaccccaactacacgccttaaaattcatcaaattgctctagcaactttgcctcatccatcactgatacccacccgtgggccctcattagtttccttacccataaatctccccaaccatcaatcactcccagatctcacacttcccattgttttctccgctttctctcgatcgggcttcttaatcgccggaaacatgaaggtcaccgtaactactcggagcggtagagagttaatcaacggtggtcttgttcttgatagctctgctactgtggctgatttgcaggaagcaattcatcaacgaatcaagaagtactatccttccagacagcgcctgaccctccccctccaaccagggtcaaaggcgaagcctgttgttctccaatccaagaaaagtctcaaagagtatacgagcggaagttctgacaacattactgtagtgtttaaggatttgggtacacaagtttcgtatcgcacactcttctttttcgagtatttgggcccacttatcctctatcctgtcttctattacttcccagtgtaccagtattttggttacaaagatgaacgtgttatccgtccaattcagacatatgcaatgtactactggtgttttcactatttcaaacgtatcatggagaccttctttgtgcaccgattcagtcatgcaacctcacctctttcaaatgtctttcgaaactgtgcttattactggagttttggctgttatatagcttattacgttaatcaccctctttacacacccgtaagtgatctccaaataaagattggattaggatttgggttgatcatgcaactttcaaacttgtattgccacatcatactgagaaatcttcgcagccctagtgggaatggaggataccaaattccacaagggtttttgttcaatattgtgacttgtgcaaattacacaaccgagatttatcagtggctgggcttcaacatagcaacacagaccgttgctggttatatctttcttgtggttgctgctttcattatgactaattgggctctggctaagcattgtcgtctcaggaggctatttgatgggaaggaaggaagacccaagtatcctcgccgatgggtaatattgcccccatttctgtaagcagattacaaatatgggttgtgtcttatttatcttggttctggattatgagctaggtattgtgggcttattctagtcagatatgttcctaaaaaggatcagatattttaattgtttagaacattagtttcttgttgaggttgtgaatcatactgcttttatgattattttttctaggtctaagctgttttaccatgtgtacttgctacatctccacagatggcttttgaatttacttgatttgtgtcaaaaaagaaaaaagtaccgactgcgacttttccattgtagtagggtgcatagcgacgacagagttatcatcattgacggcttcgtcaac

SEQ ID NO: 622 - DNA, 1221 bp, Coffea canephora
cccgaaacccctgcgatcctcagatcttcgttccacctctcagaacttttgtaccctctctcgctgtgtctttcggaggcttactctttgaaggatgaaggtgacggttgttacacgtagcggcagagaactagtaaagggtggccttgacctcgatgattccgctactgttgctgatcttcaggaggcaatccataagcgaaccaagagatactatccttctcgacaaagactcaccctccctctcccacctggatccaaggagaagcctaccattcttcactacaagaagagtctcaaagagtacattggtgagagcacaaatgagttgactgtagcgttcaaggacctaggtccacaggttgcctacagcacacttttcttctgggaatacttggggcctcttattctttatcctcttttctacttcttcaatgtgtatcaatttttcggctataaaggcaagcgtgtcatccaccctgttcagacatatgcattatactactggtgtttccactacttcaagcgtatcatggaaacattcttcgtgcaccgtttcagccatgccacttccccactttcaaatgtcttccgtaattgtgcttattactggagctttggctcctatattgcttattatgtcaatcacccactttacacgcctgttaatgatctccaagtgaagattggctttggtatcgggttggcttgtcaattggcaaacttctattgccatattttgttgagaaagcttcgtcctgctgatggtagtggaggatatcaaatcccacgtggcttcctcttcaatatcgttacatgtgccaattacaccacagaaatttaccagtggctgggattcaacattgcaacgcaaaccgtagctggctatgttttcatggttgttgcagctgccattatgactaagtgggcacttgcaaagcacagacgattgaggaagctatttgatggaaaggacgggagacccaagtatcctcaaagatgggtgatattgcccccattcctgtaagtgattggcaggccagaagtgatgctcaagcaatgagattatgagtttggtcggatgtgctaatggttgtgcgcagtcagttcagattaaattgaaccaaaagatggatcatattttcacctttgctcatttttgtgtcaagcttcaattgacatgtggtactgttcctttcatttctttccttagaaccatca

SEQ ID NO: 623 - DNA, 1698 bp, Papaver somniferum
aactatataaattaaggttatttaaatgcagataactgaaatccgtaaactagaaacaagacaaaaaaaataacaggaataacattaaaaatcagacatgtagttagctctcctactcccaactacattccattaaaacaagagagaaactcaaacctaccaatttaatacccaattaagtttctcacttataacacaaaatgatacatctataaaaacgcgaaatgggttttctatgaactgattttactcctattctatatctctgatttgatccattatcattatctttgtgtgaggaagaatctgttagagagaaaaaaagggtttgtttttgtctcggtgatttaagaagtgggtttctcctgtctctcttagtagactttgagagatgaaggtgagtgttgtttcccgaagtggtagagaaattgtcaaaggtgggattgagctcaacgattcagctactgtgagtgacctccaagaggctattcatcgtcgaaccaaaaagtattacccttctcgtcagcgcctcactctcccactcgaacctggtgccaaggggaaacctattgtactagactataagaaaactatccaagattattgtgatggaaattcgaacagcataactgtggtgttcaaggatctcggcgcacaagtttattatagtacccttttcttctgggagtactttggccctctgatcatctatccaatcttttattactttgatctgtaccagtacttagggttcaaaggagaacgtgtaatccacccagtccaaacctatgccatgtactgctggtgctttcattacttcaagcgtataatggagacattttttgtccatagatttagccatgcaacttctccgctctccaacgtgttccgtaactgtgcttattactggtcattcggttcatacattgcttactatgtaaaccatccactttatactccagtgagtgatctgcaaatgaagattggatttgggtttgccttggtttgccagctttcaaacttctattgtcatattctgctgagaaaccttaggagtcctgacgggaagggagggtatcaaatcccatgtggatttttgttcaatctagttacatgtgcaaattacaccactgaaatataccagtggataggcttcaatatcgcaacacaaacagttgcaggttatgtttttgctgctgtagctgcttttatcatgactaattgggctcttgcaaagcaccggcgtctaaagaagctatttgatggaaaggaaggcagggctaagtacccccgcagatgggttatacttcctccattcatctaaagaagtctactataaatcacctgttgccgaaccctgctttttaatacattgattcgcagcagaggcgataacattaaattcttttattttcaggcacttcgaagcttcccttcatttttttatctgtgtttactagctgtattgacaatctgtgttgaatctatgctgtgctctctcttgattatcatcctctactgttgtttgtctcagtgaactagctattttctttgatttttgtcttaaaagattttatagaatgctttcccgtttattttgtcaaatattgtgaagaacattcttaccgagaactattctaatatcgtaacttttatgcaaatccagtaatggagttgtaactttggaaaaaaaaaaaa

SEQ ID NO: 624 - DNA, 1298 bp, Papaver somniferum
ctcacttataacacaaaatggatatatctataaaaacgcgaaatgggttttgtatgaactgattttactcctattctgtttctctgatttgtttctttgtgtgaggaagaatctgttagagagaaaaaaaagggttttttttggtcttagtgatttaagaagtgggtttctcctgtctctctttgtagactttgagagatgaaggtgagtgttgtttcccgaagtggtagagaaattatcaaacgtgggattgagctcaatgattcagctactgttagtgacctccaagaggctattcatcgtcgaaccaaaaagtattatccttctcgtcagcgccttacactcccactcgaacctggaacgaaggggaaacctatcgtactagactataagaaaactatccaagattattgtgatggaaattccaacagcataactgtggtgttcaaggatctcggtacacaagtttattatagtacccttttcttctgggagtactttggccctctgatcatctatccaatcttttattacttcgatctgtaccagtacttagggttcaaaggcgaacgcgtaatccacccagtccaaacctatgccatgtactgctggtgctttcattacttcaagcgtataatggagacattttttgtccatagatttagccatgcaacttctccgctctccaacgtgttccgcaattgtgcttattactggtcattcggttcatacattgcttactatgtaaaccatccactttatactccagtgagtgatctgcaaatgaagattggatttgggtttgccttggtttgccagctttcaaacttctattgtcatattctgctgagaaaccttaggagtccagacgggaagggagggtatcaaatcccacgtggatttttgttcaatctagttacatgtgcaaattacaccactgaaatataccagtggataggcttcaatatcgcaacacagacagttgcaggttatatctttgctgctgtagctgcttttatcatgactaactgggctcttgcaaagcaccggcgtctaaagaagctatttgatggaaaggaaggcagggctaagtacccccgaagatgggttatacttcctccattcatctaaagaagtctactatgaatcacctgttgctgaaccctgctttgattcacagcagaggcgataacattaaattcttaattttttatttttcatgaacttcgaagcttcccttcttttttttatctgtgtttactagctgtattgacaatctgtgttgaatctatgcgtgt

SEQ ID NO: 625 - DNA, 1323 bp, Pseudotsuga menziesii
gtcttcaatactcccacctagaagcaacaattcatttattggggtgaacgctcagctcaaagctatagcgcagtcttcagtcatcaatactcccacctataagtaccaatccattcatagaggacaacgccaacactatattgtgtgcttcaatcccttgcggtcatacggataccaggggattgcgaagatgaaggtctcggtggtatctcgaagtggtagagaaattatcaagggtggcatcgatctgaatgataatgcgaatgtggatgatctgaaagcctcgattcaacaaagagtcaagaaatattatccagctcggcagcggcttactctgccgcaatctgggaaagggaaaccagttgttctggaaaggggcaagaggcttaaagattattttgaaaaagatgaggggaagttagtggtggtgttcaaggatttaggtccacaggtagcctacagcactctttttttctgggaatatgtcggtcctctgttcatttatcccatcttctattacttccctgtctacaagtactttgggtatcctgcagaaagagttatacacccagttcagacatatgccatgtactattggtgctttcactatgccaaacgcattttagagaccttttttgttcacaggttcagccatgcaacttccccacttgctaatgtgtttagaaactgctgttactactggtccttcggtgcagtcatagcttattttgttaatcatcccctctacacccctgtgagtgagaagcaaatgaagattgggtttggtctggggattgtatgtcaggtagcaaacttttactgccatattttgttgaggaatctcaggatccctggaggtaaaggaggatatcaaattccaagtggattcctgtttaatatagtcacatgtgctaactacaccaccgagatctatcagtggttgggattcaatattgcaacacagacagttgctggctacacctttctggctgtagcaacctttattatgactaactgggctcttgccaagcatcgccgtttgaagaagttgtttgatggcaaagatggcagacccaaatatccaaggcgatgggtgatattacctcctttcctatgaaagggatgtgtattaatgcacgggacatttttgttgaattccatattgaattgttgacaataacttgggccttttctggttcgacaatgtctaaaatttgttgcctttgtaactcactgttttgtggctgtaatgtatttagttgtgctttcttaagaaaataggagtgaattcatctgtgtacgttctcggtattttaaatggag

SEQ ID NO: 626 - DNA, 1291 bp, Rosa hybrid cultivar
ctgattgctagctcaattttgtgaagtgggtctctgtctctctggctcgaggagatgaaggtcaccgtagttactaggagtggtagagagcttttcaagggtggcctcgagctcagtgactctgccactgttgctgatctgcaggaggagatccataagcgatccaaaaagttctatccttcaaggcagcggcttactcttcctgtcaaaccaggatcaaaagagaaggcagttgtcctcgcctccaagaagagtctcaaagattattacagtggaaactcagacaacttaactgtggtgtttaaggacttaggcccacaagttgaataccgaacgctcttcttctttgagtatattggtcctttgctcatttatcccatattttacttcttccctgtttaccagtacttgggcttcaaaggagaccgtgtcatccacccagtacagacatatgctctatattattattgcttccactactttaaacgtattatggaaacatttttcatacataggttcagccatgcaacctcacctctctcctatgtatctcggaattgtgcttattattggagctttgcagcacttatggcttactacgtgaatcacccactttacacccctgttagcgacctccaaatgaagattgggtttggttttgggataatatgtcaaatcgcaaacttatattgtcatattctattgaggaatctgagaagccctgatggaagtggaggctatcaaataccatgtggttttctattcaatatagtgacatgcgcaaattacacaactgagatttatcagtggttgggctttaatattgcaacgcagacggttgctggttatctttttgctgtagttgctgcttctatcatgaccaattgggcccttggaaagcaccgccgtttaaagaagctatttgatgggaaggacggaagacctaagtatccacgtcgatgggtgattctaccgccattcttgtagaagtgattggcgagcctaccttcattggtctcttggtatgaagtgttcaaattgcaccaatgggtgatcaacgtgaagaagttcaaatcgcataattatccaatttcaagattgatgttagtattctgcttagactctgtaataatttattaggaagacttggagatttgcttgtcgatctatacaagggtagtctatcttgttctagtcagtttgaactcttttgtcatttgcacttcctaactaatgtaatttttgaattgaaagcaataatatttgttatgctgtggctttagacactgac

SEQ ID NO: 627 - DNA, 1465 bp, Fragaria vesca
cccataattgtatatatccaataccgcccgaaccaactcctactactgtcctacacataactaattcccacatcgttattaaggagagagacagcccataaacccatttccggatctaacactcaatccttctctcattcctactctccaactttgctttgctccattttggcgaagtgggtctctttctctctggctcgagaagatgaaggtcaccgtagtcacaaggagtggcagagagcttttcaagggtggccttgagctcagtgactctgccacagttgctgatctgcaggaggagatccataagagatccaaaaagttctatccttcaaggcagcgacttactcttcccgtccaacctggatcaaaagagaaggcagttgtcctcacctccaagaagagtctcaaagattattacagtggaaactcagacaacttaaccgtggtgttcaaggacttgggcccacaagttgaatacagaacactcttcttctttgagtatattggtcctctgctcatttatcccatattttacttcttccctgtttaccagtacttgggcttcaaaggagaccgtgtcatccacccagtccagacatatgctctatattactattgcttccactactttaaacgtattatggaaacatttttcatacataggttcagtcatgcaacctcacctgtctcctatgtaacccggaactgtgcatattattggagctttgcagcactcatgtcttactatgtgaatcacccactttacacccctgtcagcgacctccaaatgaagattgggtttggttttgggataataaatcaaattgcgaacttctattgccatattctactgaggaatctgcgaagtcctgatggaagtggaggctatcaaataccacgtggttttctattcaatattgtgacatgtgcaaattacacgactgagatttatcagtggttgggttttaatattgcaacacagacggttgctggttatctttttgctgtagttgctgcttctatcatgaccaattgggccctaggaaaacaccgccgtttaaagaagctatttgatgggaaggacggaagacccaagtatccacgtcgatgggtgattctacccccattcttgtagaagtgattggcgaggctaccttcattgttctctttggtgtcaagtgttcaattccatttcctacgataggtcatcaacgtgaagaagttcagatcgcatatttatccaatttcaatattgatgttagtattctgcttagactttgtaataagaacttggagatttgcttgttgatctatacaagagtaatctatttatgcagtcaatttgaactgttttgtcatttgcacaaaacgaatgtaactttagaaattggaagcaattatatttagtcatgttgtggctttaaacacagatatccccttgagctttctgtcacagtacctt

SEQ ID NO: 628 - DNA, 1165 bp, Helianthus annuus
atctccaaccaatctcagatctccaccattgttttctccaccggaaagatgaaggtgaccgttactacgcggagtggcagagagttaatcaacggtgggcttgttcttgatagctctgctactgtggctgatttgcaggaagcaattcatcagaaaatcaagaagtatcatccttcgagacaacgtctaaccctgcctgtagaaccgggctcaaagaagaagcccaccgttctccaacacaagaaaagtctcaaagagtacacaaccgaaagctccgacaccattaccgtagtgtttaaagatttgggcccgcaagtctcataccgcacactcttctttttcgagtacttaggcccgttaatcctctatcccgtcttctactacttcccagtgtaccaatttttcgggtacaaagatgaacgggtcatccatccggttcaaacatacgcaatgtattactggtgtctacactatttcaaacgtatcatggagacctttttcgtgcaccggttcagtcacgcaacgtcgcctctttcaaacgtgtttcggaactgtgcttattactggactttcgggtgttacattgcgtattacgttaatcatcctctttacacgcctgtaagtgatctccagatgaagattggattcgggtttgggttggttatgcaagttgcaaacttgtattgccacgtcatactaagaaaccttaggagcccgagtgggaacggagggtaccaaattccgcaagggtttttgtttaatattgtgacgtgtgcgaattacacaaccgagatttatcaatggttgggatttaatattgcaacacaaactgttgcgggttatgtctttcttgtcgttgccgcttccatcatgactaattgggccctggctaaacatcggcgtctcaggaggctctttgatgggaaagaaggaagaccaaagtaccctcgccgatgggtgatactgcccccattcctgtaagcgactacaaacattggttgtgtatcgttattaatagcttgggtttatcagctagatttggcagtatcgtgaattgtttttagtcaacatatgttttttacttgtttagaacttttgtttcttttgtattgtgaatcataccatgtgtacttgctagttgctacattagacttttggatttagc

SEQ ID NO: 629 - DNA, 1237 bp, Valeriana officinalis
gataaaaccctcatctcttctctacgcacctcctatcttcaacactaacctctctcttttggatcttccccttctcactctctattcgttctgtgtttgctttcgtctcaaaagatgaaggtcactgtcacttctcgtggcggtaaagagttcatcaaaggcggtctcgatctcaatgattcggctacagttgctgatctgcaggaggcaatttataagcgaaccaagaaatactatccatctcggcaacgactaaccctaccactccaacccggttcaaaagacaaaccaactgttcttcaacagaagaaaaatctcaaagattatacagatggaaacacagacaccttaactgtaatattcaaagacctcggccctcaagtttcctaccgcacactcttcttcttcgaatacttgggcccactcataatctacccccttttctactacctacccctctacaaattcttcggctacaacgttgaccaagtcaaacgtcccgttcaaacctacgccatgtactactggtgctttcactacttcaagcgtataatggagacttttttcatccaccgtttcagccacgccacctcgccactctccaacgtcttccgaaactgcgcttactactggtctttcggtgcttacattgcttattatgtaaatcaccccttgtatacgcctgtatgtgatcttcaaatgaagattgggtttggttttggattggttaaccaaattgcgaatctttactgtcatatattattgaggaatcttcgtggtacggggaacggaggctaccaaatcccacgtggatttctgttcaatttcgtcacgtgtgcaaattacactacggagatttatcagtggttaggattcaatattgccacacagactgttgcaggttacgtctttcttgtggttgctgcatctattatgactaactgggctttagctaagcaccgccgattgaggaggctatttgatgggaaggaaggaagaccaaagtacccccgaagatgggtgatattacccccatttctgtagaagttgaaagaatttgcaggtgctgtctgtctttcacaatatatttatgtagtatttgttttggattaaaaatgtgatctgttgtggtagtttgtttgtttgttctttggtaaactgtttgggcactgccgatgatctcagaagtgaatcattaaatttgtgtttacccatactttaatttgatgatttctat

SEQ ID NO: 630 - DNA, 1260 bp, Vinca minor
aaggtgtctgtcgttactcgtagcggcagagaactcgtaaaggggggcattgacctcaatgattctgctactgtggctgatttgcaggaggcaattcataagagaaccaagaaattctatccttcaaggcagagacttactctccctctccaacctggatcaaaggagaagcctactgtacttcactataaaaagagtctcaaagagtacagcagtggaagcgatgattcattaactgtagttttcaaggacctaggtccacaggttaattacagcacgttgttcttctttgaatacttgggtcctctcgtcctgtatcctgttttctacttcttcaatgtctaccaatacctgggcttcaaaggggagcgaatcatccacccagttcagacatatgccttatactactggtgtttccactatttcaaacgtatcatggaaacattttttgtccaccgtttcagccatgccacttcaccaattgccaatgtttttcggaattgtgcttattactggagctttggctgtttgattgcatactatgttaatcacccactttacactccagtaagcgatctccaaatgaaaattggatttggacttgggttggtctgtcagatagcaaacttctattgccacatcttgttgagaagtcttcggggggctgatggcagtggagggtatcaaatcccccgtggcttcttgttcaacattgttacttgcgcaaattacacaacagagatctaccagtggctgggcttcaatattgcaacgcagactgcaactggctattttttcatggttgttgctgcttccataatgaccaactgggcccttgcaaagcaccggcgtttgagaaagatatttgatggaaaggatggaagacctaagtacccaagaagatgggtgatattgcccccattcctgtaggaagcaactggcagagcagccacgactccttcattgacaagatcacgaatttatccccttgtctcagaaggttgttatctttcattttggattaaattatttcaaacatagatcagatttattcatttcctctttcatatggaaatgcaatgtatctgagaccatatttatttcctttgctgcaagtgagctatttcttgctttctttttagatcatctttgacttgttacatttagattggctttaagatcatgttggacaatttatctacttgctggtttattttctgaagatatgatatattatctgcttgttagacttagaggagg

SEQ ID NO: 631 - DNA, 1507 bp, Chrysanthemum coronarium
agcaatagaatagaatagaaaagaagatcgttagcagttgggtcatctactcccaaccagacgccttaattaatatcaccccacacatcaatctcactcgcccataaaaccatacctacatttcatcaaactttcatagatctataactattttttataaatttttagcagttgggtcatctccgtttttcatttgttggaaagatgaaggtggttgttactactcgcagcggtagggagttaattaacggtggccttgaccttgatagctcctccgctactgtcgctgatttgcagaatgctattcatcagaaaaccaagaaatactatccttccagacagcgcctgaccctacccctccaagcagggtcaaaggataagcctgttgttcttcaaagcaagaaaagccttaaagaatatactagcggaagttctgacaccattaccgtagtttttaaggacttgggtccacaagtttcgtatcaaacactcttcttttttgagtatttgggtccactgatcctctatcctgtcttctattacttcccagtgtaccagttttttggatacaaaggtgaacgtgttatgcgtccagctcagacgtatgcattatactactggtgtttccactatttcaaacgtatcatggagaccttctttgtgcaccgtttcagtcatgcaacctcacctatttcaaatgtctttagaaactgtgcttattactggagttttggctgctatattgcttattatgttaatcaccctctatacacacccgtaagtgatctccagatgaagattggatttggatttggggcgatcatgcaagttgcaaacttgtattgccacatcatactgagaaatctccgcagccccagtggacctggaggataccaaatccctcgagggtttttgttcaatattgtgacttgtgcaaattacacaaccgagatttatcagtggttgggctttaatattgcgactcagactgttgccggttatgtctttctggtggttgctgcttccatcatgactaattgggcaatcgctaagcatactcgtctcaggaggctctttgatggtaaggaaggaagacccaagtatccccgtcgatgggttatattgcctccattcttttaagcgattacaaacatggatcgtgggttctggattatcagctatttggtctcgcaatgagttcattctagtcaacatccttaaaagaatcagatgtcttacattcttagaagtttattttctaattatcagcttctacggttaattttccttggtccaagttctttttaccatgtggacttgccacagatggcttttaaatttagctgatttgtatttgcgcctttgagtcttacttatatttaatatctggatcttttccaaatttgcagaatcttgaggtgtttcattcagtttaaattaggttttgtctctttcagaacaataaggatatgtttattgatacaataagattgcagatttattatca

SEQ ID NO: 632 - DNA, 1367 bp, Centaurea maculosa
cagcaagcagttcatctaccccaactacacgcctttaaaatccccatcaaattgcaaactttggctcatccccaccataactcataccgtgggccctcattactttatcttacccataaataaatctccccaaccatcgctacatttcattcattaatcccaacagatctcaatttctcacattgttttctccgcttgggtttctctcatcgccggaaacatgaaggtcaccgttactactcggagtggcagagagttaatcaacggcggtcttgttcttgattcctctgctactgtggctgatttgcaggaagatattcatcaacgaatcaagaagtactatccttccagacaacgcctgaccctccccgtccaaccagggtcaaaggtcaagccaattgtcctccaatccaagaaaagtctcaaagagtatactaccggaagttcagacaacattaccgtagtctttaaggacttgggcccacaagtttcgtaccgtacgctcttcttttttgagtatttgggcccactgatcctctatcccgtcttctattacttcccggtgtaccaattcttcggttacaaagttgaagaacgtgttatccgtccaattcagacgtacgcaatgtactactggtgtttccattatttcaaacgtatcatggagaccttctttgtgcaccgtttcagtcacgcaacctcccctctttcgaacgtctttcgaaactgtgcttattactggagcttcggctgttatatcgcttattatgttaaccaccctctttacacacctgtaagcgatctccagatgaagattgggttagggtttgggttgattatgcaactttcaaacttgtattgccacatcatactaagaaatcttcggagccccagtgggaacgggggataccaaattccacgtgggtttttgttcaacgtcgtgacttgtgcaaattacacaaccgagatttatcagtggctgggatttaacatagcaacacaggcggttgctggttatatctttctcgtggttgctgcttccatcatgactaattgggcactggctaagcatcgtcgtcttaggaggctatttgatggtaaggaaggaagacccaagtatcctcgccgatgggtgatattgcccccattcctgtaagcgattggttacaaatatgggtttggttctggattatatcagctagatttggttcgtttcttgagttcattctagttgacatgttcctaaaaaggatcaccagcagatgttttacttgtttagaacattagtttcttgtcgagttgtgaatcatactgcttaataggtctttcatcatgtgtacttgtcacagctccattagatggctttt

SEQ ID NO: 633 - DNA, 1326 bp, Centaurea maculosa
ggctcatccccaccataactcataccgtcggccctcattactttatcttacccataaataaatctccccaaccatcgcctacatttcattcattaatcccaacagatctcagtttctcacattgttttctccgcttgggtttctctgatcgccggaaacatgaaggtcaccgttactactcggagtggcagagagttaatcaacggcggccttgtccttgattcctctgctactgtggctgatttgcaggaagctattaatcaacgaatcaagaagtactatccatcccgacaacgcctgactctccctatccaaccagggtcaaaggtcaagccagttgtcctccaatccaagaaaagtctcaaagagtatactaccggaagttcagacaacattaccgtagtctttaaggacttgggcccacaagtttcgtatcgcacactcttctttttcgagtatttgggcccactgatcctctatcccgtcttctattacttcccagtgtaccaatttttcggttacaaagttgaagaacgtgttatccgtccaattcagacatatgcaatgtactactggtgtttccattatttcaagcgtatcatggagaccttctttgtgcaccgtttcagtcacgcaacttcgcctctttcgaacgtctttcgaaactgtgcttattactggagctttggctgttatatcgcttattacgttaaccaccctcattacacgcccgtaagcgatctccagatgaagattgggttaggatttgggttggttatgcaactttcaaacttgtattgccacatcatactgagaaatcttcggagccccagtgggaacggaggataccaaattccacaagggtttttgttcaatatcgtgacttgtgcaaattacacaaccgagatttatcagtggctgggatttaacatagcaacacagacagttgcgggttatatctttcttgtggttgctgcttccatcatgactaattgggcactggctaaacatcgtcgtctcaggaggctatttgatgggaaggaaggaagacccaagtatcctcgccgatgggtaatattgcccccattcctgtaagcgattgattacgaatatgggtttggttctggattatatcagctagatttggttcgtattgttgatttcattttagtcgacatgttgctaaaagggatcagcagatgttttacttgtttagaacattagtttcttgttgagttgtgaatcatactgcttaacaggtcttttatcatgtgtacttgccacagctccatcagatggcttttgaatttattggtacacaaatat

SEQ ID NO: 634 - DNA, 1499 bp, Tragopogon dubius
cgtgcgtggtccttcaatggcgatcagatgtaggtagatcgccctttcaacctcatttaggagaaccagcagcagctgccgctgctcatctaccccaactacacgcctttaaaatatatcaaatcacttgcaagccttagttcatctacgattcatagtgtgggacctgactcatttgttttcttacccataaatccatccaaccatccctacatttcgttaaacccatttccctagatctcagatatatatacctcgcattgttttcttcgttttccctcaattggttcactcccagtagcttgtagctcttgatctaatctccggcaagatgaaggttaccgttactactcggagcggtagagagttaattaacggtggcctcgtactcgatagctctgatactgtggctgatttgcaggaggcaattcatcggcgaatcaagaaatactacccttccagacaacgcctaaccctacccctccaaccggggtccaaggaaaagcccgtggttcttcaatacaaaaaaagtctgaaagaatacacaaccggaaactccgacacccttaccgtggtcttcaaagacttgggcccacaagtctcatatcgtacactcttcttcttcgagtatctgggcccactaatcctctacccagtcttctactacttcccagtctaccaattcttcggatacaataacaaacgtgtcatccaccccattcaaacaatcgcaatgtactactggtgtttccattacttcaaacgtatcatggagacttttttcgtgcatcggttcagtcacgccacgtcacctctttcaaacgtgtttagaaactgtgcttattactggtctttcgggtgttacattgcttattatgtgaatcatcctctttacacacccgtaagtaacgatctacaagtgaagattggggttggggtttgggttggttatgcaaatttcgaatttgtattgccatgtcatactgaggaatcttcgtgggcccggtgggagtggagggtatcagattccgcgagggtttttgtttaatattgtgacttgtgcgaattatacaaccgagatttatcagtggttagggtttaatattgctactcagacggttgcgggttatgtgtttcttgtggttgctgcttccattatgactaattgggccttggctaaacatcgtcgtctcagaaggctatttgatgggaaggaaggaagaccaaagtatccacgcagatgggtgatattgcctccattcttgtaagacataagacatgggttacggattatgtgctagatttggtgatatccttaaaagggttaaaatgttttacttgtttacaaccttagtttcttatttatttgtgaatcatatactgtttgtatgatttgtttttctaggccatgttcaacttatttgtattgctatctgagtctttctttgataaatccggaaccaaaagttcgaaatgttgaaaattgttgcaaataaaga

SEQ ID NO: 635 - DNA, 1497 bp, Thalictrum flavum
actctatttgtgtgtgaacaagttgaataccttgatttaatcgaaggtcgtttggtttacagttttgagaggtgggtttgtcttatttttatctaagatgaaggtcagtgttgtttctcgaagtggtagagatataattaaggtgtaattgagctgaatgataaggctactgtgagtgatctgcaagaggctattcatcgccgaacgaaaaatattatccatctagacagcgtcttactcttccactccagcctggttcgaagggaaagcagttgtccttgaccctaagaaaactttacgagactattgtgatggaattagtgacaacttgactgtggtgtttaaagaccttggtcctcaggtttcctacagcacccttttcttctttgaatacttgggtcctctggtcatttaccccatcttttactacttccctgtttatcggtaccttggatacaaagaggagcgcactattcacccagtgcagacctatgccatgtattactggtgcttccactatttcaaacgtatcatggaaacattttttgtccataggtttagccacgctacatcccccctctccaatgtattccgtaattgtttttactattggagttttggcgcatatgttgcttattatgcgaaccacccattatatactcctgtgagtgaccttcaaatgaaaattggatttggtcttggattgctctgtcaagtttcaaatttctactgccaccttttgctgaggagccttcggagtcctgacggtaagggaggataccaaatcccacgtgggtttttgttcaactttgtgacttgcgcaaattacaccacagagatctatcagtggctgggtttcaatattgcaacacagacagttgctggttatgtcttccttgtggtggcagcttctattatgactaattgggcccttgggaaacacaggcgtttagtcaagttatttaatgggaaggacggcaagccaaaatatccatggagatgggctatactccccccattcatctaaaatgctacttgtcaacctgctgtttggtatctgttacaatgtttccgcttcttcgtttcatttcgagattcacagagcaatcctgttagataagccataaaaaggtgaattcagcttcagtgttgttatttattatggtactaaatttaataagattctgaacttaagtacaactttcagttttagtgtttcctttgatgtagtcacttgtgcatgattgcacccttcaagtttaaagtaatcttgtttgatgcttgataatgttagatgtatttgcttgcaattggttgtcatcttgggtcttctttgggtgaccctaagtgggattgaacagatctgaaaaagttgtcaaaagctccatctgctggcccacctgagagtccgagatgaaagttgagctccttaacctgccaagcggaaagcttgcataatctcttagtggctgagataaagtattttagtccttaatt

SEQ ID NO: 636 - DNA, 1575 bp, Amaranthus tuberculatus
tgccccaataatagggtggttgatcagttttgggaggtagatatcaagatatcctactcccacccaactacatgcaattaatatgacatttaattaatttacaagactatttaccctcttaaatacttctatcaattgcaagaatatctctatatatcagctcattggctcgttatgctctagatttaagtccaccatttggatctccgccaaaatttcccagaaattttaaaagggtttgctacaaattcaatcttctgaattgggtttctttcattttcaccagaaatgaaggtttcggttgtaacacgaagtggaaaggaactcttgaaaggtggaattgagcttaatgattcggctacagttgctgatctacaggaggcaattcacaagaaaatcaagaaattctatccttccagacaacgactgactcttcctgtcgaaccgggatcaaagtcaagaccaactgttctaaacagcaaaaagagcctcaaagagtatgcagacggtaattccaacactctgactgtcgtgtttaaggacttaggaccacaagtttcctaccgtacactattcttttgggagtacctcggtcctttgatcatctatcccatattccattacttccctgtttaccaatacctcggctacaaagaggatcgtgtcatacaccccgttcagacatatgcttgttattactggtgtttacattatttcaaacgaatcatggaaacattttttgtgcatcgcttcagccatgcaacttctcccctgtctaatgtgttccgaaattgcttgtattactggagtttcggggctttcattgcttactatgtgaatcacccgctgtacacccccgttagtgaacttcaatggaaaatcggatttggattcgggttgctctgccaaatttcaaacttctactgtcatatattgctgaagaatctgcgaggcgctgacggaagtggagggtaccagatacctcgcgggtttttgttcaatattgtgacctgtgccaactacaccacagaaatatatcagtggattggtttcaacatcgcaacccaaactgtggcaggttatgtctttgttgtggttgctgccggaatcatgactaactgggcacttgcaaagcaccgacgtctcaagaagttattcgatgggaaagacggacgacccaagtacccacgccgatgggtgatcttgccaccattcctataaaacaatactgcaatacattgtgtggagtatggacagtgtctatatcattttatacactgtttcaaccagaccaataactaaaagttatctgttgttataagttatccaagtttctttattaagttgtcttgttaattatgttctctttactgtaaacttacttcagtctagtttttccattgaagcaaacttttatcatctttcctattgaaccaaaagtgctttgtagctcaatggatagagtatttgcatatagagcagaaggcttggggttcgaccctagggtgctgggaaagagtctttcttcttgggaaagttggaacgggctaaatgaagcttgtggtcaacatgata

SEQ ID NO: 637 - DNA, 1191 bp, Arnica chamissonis
ggtaaccgttatcacgcgtagcggtagagaactcatcaacggtggccttgttcttgacagctctgctactgtggctgatttgcaggaagcaattcatcaacgaatcaagaaatactatccttctcgacaacgtctgaccctgcccctagaaccgggctccaagaagaagcctgtcgttcttgaatacaataaaagtctcaaagagtacacaagtggaacctctgataccgttactgtagtttttaaggatttgggctcacaagtgtcataccgtacactcttcttttttgagtacttggggccgttaatcctctatcctgtcttctattacttcccggtgtaccaattttttggatacaaaggtgaacgggttatccatcctgttcaaacatatgcattatattactggtgtttacactacttcaaacgtatcatggagaccttttttgtgcaccgtttcagtcatgcaacttcacccgtttcaaatgttgttaggaactgtgcttattactggacttttgggtgttacattgcttattatgttaatcatcctctttacacacctgcaagtgatctccaggtgaagattggatttggctttgggttgattatgcaagttgcaaacttgtattgccacatcatactaagaaaccttaggagcccgagtgggaacggagggtaccaaattccacaagggtttttgtttaatattgtgacttgtgcaaactacacaaccgagatttatcagtggttgggatttaatattgcaacacagactgttgctggctatatctttcttgtggttgctgcttctatcatgactaactgggccctggctaaacatcggcgtctcaggaggctttttgatgggaaggaaggaagaccaaagtaccctcgccgatgggtaatattgcccccattcctgtaagcatgggttgtatttcattttcaacgattccggtttatcgtctagatttggttgtatcgtgagttatttttagtcaaatatgttttacttgtttagaacttgtgtttcttttgaattgtgaagcatgtcatgtgcacttgccacatacgactcttgaattgagctgaacttatttgttactcttgaattcagccgacttgtgtttgtaattcagtatttataaacaaactagtatttttgcccgcccgatatggcgtgcatct

SEQ ID NO: 638 - DNA, 982 bp, Arnica chamissonis
caattgttttctccgttttctctaaatcctgtctcttccggttccaatcgccggaaaagatgaaggtaaccgttattacgcggagcggtagagaactcatcaacggtggccttgttcttgacagctctgctactgtggctgatttgcaggaagcaatccatcaacgaatcaagaaatactatccttctcgacaacgtctgaccctgcccctagaaccgggctccaagaagaagcctgtcgttcttcaatacaagaaaagtctcaaagagtacacaagtggaacctctgacaccgttactgtagtttttaaggatttgggctcacaagtttcataccgtacactcttcttttttgagtacttgggcccgttaatcctctatcctgtcttctattacttcccggtgtaccaattttttgggtacaaaggtgaacgggttatccatccggttcaaacatatgcattatactactggtgtttacactacttcaaacgtatcatggagaccttttttgtgcaccgtttcagtcatgcaacttcacccgttgcaaatgtttttaggaactgtgcttattactggacttttgggtgttacattgcttattatgttaatcatcctctttacacacctgcgagtgatctccaggtgaagattggatttggctttgggttgattatgcaagttgcaaacttgtattgccacatcatactaagaaaccttaggagcccgagtgggaacggagggtaccaaattccacaagggtttttgtttaatattgtgacttgtgccaactacacaaccgagatttatcagtggttgggatttaatattgcaacacagactgttgcaggctatatctttcttgtggttgctgcttctatcatgactaactgggccctggctaaacatcggcgtctcaggaggctttttgatgggaaggaaggaagaccaaagtaccctcgccgatgggtaatattgccccc

SEQ ID NO: 639 - DNA, 1517 bp, Cicer arietinum
ccattaatgcatacatatgctttggcctcatctagtattactaaccacacctcacattattttatccttcccatcttaaatatttcatttttctctccaaattattaaacctccattttgtgaggaactatcaaaacacacactcttcctacaattcaggttctacttctattggattggatcttgaatataatcatttagtgatttgtaaagtgtgttgctgacactgtttggatttcaaagatgaagctcactttggtttctaggagtggaagagagattgttaaaggtggcattcagctcagtgattctgctactgtagcagatctgcaggaggcaatttacaagcgaatcaaaaagcatccatcaaggcagcgtttgacacttcctgtccaaccaggatcaaaggaaagacctgttgttcttaattacaaaaagagtctaaatgactacacgagtggaaattcagaaaccttaaccttagtattcaaggatttaggtccacaagtttcttaccgtacgcttttcttcttcgagtacttgggacctttgcttctctatccagtcttctattacttacctgtctaccagtattttggctacaaaggtgaacgtgtcatccaaccggtgcagacatatgccttgtactattggtgtttccattacgccaaacgaattctggaaacattttttgtgcatcgcttcagccatgcaacctcgcccctttccaacgtcttccgcaactgtgcttattactggtgctttggttcttatattgcttattatgtgaaccatccattatataccccagtaagtgaccttcaaatgaagatcgggttcgggtttgggatactttgtcaagtttcaaacttctattgccatattatactgaggaatcttcgcggaccagctggagaaggtgggtatcaaatcccacgtggctttctcttcaatatcgttacttgtgcaaattatacaacagaaatctaccagtggttgggcttcaacattgcaacgcaaaccattgccggttatttatttctcgcggttgctacttttatcatgaccaactgggctcttgcaaagcacaggcgcttgaagaagttatttgatggaaaggaagggagaccgaggtatccacgtcggtgggtgatattgcccccattcctgtagaaggctgtgctgctgatatgattaaggtcaccaaccactctgtgatcacaggcttctgagatttagaattgtagcataatgaatttttagttaattattattcgtattttataagatatgaatttaaatgtctttggatgtttttcctatgaagtttatttccatgttattgaagttgtttttattagatatttgtaatagtttctcaattatcataatgtggattattgtttcttatgaatcttcatcttgcattgattgtgtttgatgttattaaagttactcttgatactaaaggggtttttaaaaaaaaatgctgatttgagtttatcttgtgaaaaaaa

SEQ ID NO: 640 - DNA, 1416 bp, Panax ginseng
cttcttgtcttgtagaattagaagaactcctccacaaacaagatcaaaattcaaaagggtttgtcctttactccatttcaggaattgggtctctttcatctctacgggaagatgaaggtgactgtcactacccgtagtggtagagaattaataaagggcggcattgagctcaatgattcggctactgtggctgatctgcaggaggcaattcataagagaaccaagaaatactacccctctagacagcggctaaccctccccattcaacctgggtcaaaggagaaacctactgtccttcagtacaagaaaaatctgaaagagtatagtgatgaagcagacaaattaactgtgttgttcaaggacctgggtccacaagtttcctatcctatactattcttttgggaatacttgggtcctctgctcatctatccaatcttctattacttccctgtataccaataccttggcttcaaaggtgagcgtgtcattcaccctgttcagacttatgccttatactactggtgcttccactacttcaagcgtatcatggaaaccttttttgtccaccgtttcagtcgtgcaacctcaccactttctaatgtgtttcggaactgtgcttattactggtcatttggtgcctatattgcttactatgtgaatcacccactttatacacctgtaagtgacctccaaatgaagattggctttgggtttggtttactttgtcaaatttcaaacctctattgccatattatactgagaaatcttaggggtgatgggagtggagggtaccaaatcccatgtggatttttgttcaacattgtgacttccgcaaactacacaacagaaatttatcagtggctgggcttcaatattgcaacacagacagttgcaggttacgtctttttagttgttgctgcttccatcatgactaattgggctcttgcaaagcaccgtcgtctaaagaggctatttgatggaaaggagggtcgaccaaagtatcccagacgatgggtgattctacccccattcgtgtagaagctactgtcaaatgcctcctgagactcttctctttggttaggaagttcaaattttagagttgatgttttaaaggttcatacaaatcagcatgcaccaactatgaatccagatcttcattgttgcccattactgtcatagttttgcatttaaactgtaatagatttaagattgttagttcccctgttcttctacatgtcacagttcatcagatggcttctagaccatctttcgtgtatgttaattagttgtctcacttttccttaaatggtaatgctttggatcatggctattcttcaaaatactgctacagattttgaaatttccacaagatattgctgatgaatgaatattgtgccgtttggtactaatgtattg

SEQ ID NO: 641 - DNA, 1272 bp, Arachis hypogaea
ctctctctcttcccaaatccagtgtttattgaagtcggtttgtctcagtttcaaggatgaaggtcactttggtttctcggagcggaagagagattgtgaaaggtggcattgagctcaatgattctgctactgtagcagatcttcaacgtgaaattcacaaacgaactaagaagtatcctgaaaggcagcgcttgacacttccggtcccagcaggatcaagggaaaggcccattgtccttaattccaagaagaatctaaaagaatatactgatggaaattcaggagtcttaactgtagtattcaaggacttaggccctcaagtttcttaccgcacactctttttctttgagtacctgggacctttgcttctctatccagtcttctattatttccctgtctaccaatttttcgggtacaaaggtgaacgtgtcatccaccctgtgcagacatatgccttgtactattggtgtttccactatgccaaacgtatttttgagacatttttcgtccatcgcttcagccatgctacttctcctctttccaatgtgttccgcaactgcgcatattactggacatttgggtcttacattgcttactatgtgaaccatccaaattataccccagtaagcgacctccaaatgaagattgggtttgggtttggcatagtgatgcaaatttcaaatttctattgccacattatacttaggagtcttcgcaaacctgagggggacggtggataccaaatccctcgcggatttctcttcaatattgttacctgtgcaaattataccacagaaatctatcagtggttgggtttcaacattgcaacacaaactgttgcaggttatatttttcttcttgttgctactttgatcatgtccaactgggcttttgcaaagcacaggcgtttgaggaagttattcgatggaaaggaaggccgacccaagtatcctcgtcgatggataatattgccgccattcctgtagacaagttaccacttgctggtaggattcagagacttaaaattgtagtatgatgaagtttttagtgaatccttgagaaattgtctttcaattcttagaatgttttagactataaattttattcccaaaaaacattgatgttagtatgttgcagaaaaatctgcaatatcattttaagattatactactgggaataaccgttcctttagaatatgcatcttgtgttgatcaatttgatgtttgtgttttgttttggggcggtttgttacttttaatctttacttggtcc

SEQ ID NO: 642 - DNA, 1189 bp, Vinca minor
tgaaggtttctgtcgttactcgtagcggcagagaactcgtaaagggtggccttgagctcaatgattctgctactgtggctgatttgcaggaagcaattcataagcgaaccaagaaatactatccttcaagacagagacttactctccctattcaacctggatcaaaggagaagcctactgtacttcactctaaaaagagtatcaaagagtacagcagtggaagcgataattcgttaactgtagttttcaaggacctaggtccacaagttagttaccgcacattattcttctttgaatacttgggtcctcttgtcctgtatcctgttttctacttcttcaatgtgcatgaatgcttgggcaacaaaggggagcgcgtcatccacccagttcagacatatgccttatactactggtgtttccactacttcaaacgtattatggaaacattctttgtccaccgtttcagccatgccacttcaccactttccaatgttttccgaaattgtgcttattactggagctttggctgtcttatcgcatactatgtcaatcacccactttacactccagtaagcgatctccaaatgaaaattggatttgggtttgggttagtctgtcagatagcaaacttttattgccacatcttgttgagaaatcttcgcagcgctgatggcaacggagggtaccaaatcccccgtggcttcttgttcaacattgttacttgtgcaaattacaccacagagatctaccagtggctgggcttcaatattgcaacacagactacaattggctatttcttcatggttgttgctgctgccataatgaccaactgggcccttgcaaagcacaggcgtttgagaaagatatttgatggaaaagatggaagaccgaagtacccaagaagatgggtgatattgcccccattcctgtagatagcaactggcaaagcaggcacgaccccttcattgataagatcacgagtcagaaggttgttatctttcatttcggattaaatttatttcaaacatagatcagattttatttatttcctctttcatatggtagatctctatggaaatgcaatgtatctgagaccatatttatttgctttgatgcaagttagctctttcttgcttttcttttagatcatctttgacttgttacgtctggactggctttaagaacatgt

SEQ ID NO: 643 - DNA, 1223 bp, Centaurea maculosa
cctttaaaatccccatcaaattgcaaactttggctcatccccaccataactcataccgtggccctcattactttatcttacccataaataaatctccccaaccatcgcctacatttcattcattaatcccaacagatctcaatttctcacattgttttctccgcttgggtttctctcatcgccggaaacatgaaggtcaccgttactactcggagtggcagagagttaatcaacggcggtcttgttcttgattcctctgctactgtggctgatttgcaggaagatattcatcaacgaatcaagaagtactatccttccagacaacgcctgaccctccccgtccaaccagggtcaaaggtcaagccaattgtcctccaatccaagaaaagtctcaaagagtatactaccggaagttcagacaacattaccgtagtctttaaggacttgggcccacaagtttcgtaccgtacgctcttctttttcgagtatttgggcccactgatcctctatcccgtcttctattacttcccagtgtaccaatttttcggttacaaagttgaagaacgtgttatccgtccaattcagacgtatgcaatgtactactggtgtttccattatttcaaacgtatcatggagaccttctttgtgcaccgtttcagtcacgcaacctcacctctttcgaatgtctttcgaaactgtgcttattactggagcttcggctgttatatcgcttattacgttaaccaccctctttacacacccgtaagcgatctccagatgaagatcgggttgggatttgggttggtcatgcaactttcgaacttatattgccacatcatactgagaaatcttcggagccccagtgggaacggaggataccaaattccacaagggtttttgttcaatgttgtgacttgtgcaaattacacaaccgagatttatcagtggctgggctttaacatagcaacacagacagttgctggttatatctttctcgtggttgctgcttccatcatgactaattgggcactggctaagcatcgtcgtctcaggaggctatttgatgggaaggaaggaagacccaagtatcctcgccgatgggtgatattgcccccattcctgtaagcgattgattacgaatatgggtttggttctggattatcagctagatttgattcgtatcttgagttcattctactcgacatgttcctaaaaaggatcag

SEQ ID NO: 644 - DNA, 1342 bp, Lupinus angustifolius
gtcttagttctattcaaaatctgaaaccatttttacgttgatgtggttgtgttactaagaggactaccatagttcaggagaagtgagtttctctgggtttttgaggatgaaggtcactttggtttctaggagtggaagagaaatcgttaagggtggcattcagctcggtgattctgctatcgtagcagatctgcagaccgaaattcataggcgaactaagaagtatccctcgaggcagcgcttaacacttcctgttcaaccaggatcgaaagaaaggcctgtagtgcttaattacaacaagagtctgaaagaatatacagatggaaaatcagaaaccttaactgtagtattcaaggacttgggcccacaagtttcttatcgcacactctttttctgcgagtatttgggacctttgcttctctatccagtcttctattatttccctgtcatctacgagtatcttggctacaaaggtgaacgtgtcatccaccctgtgcagacatatgccatgtactattggtgtttccattatggcaaacgaatcctggaaacatttttcgtgcatcgcttcagccatgctacctcacccctttccaatgtgtttcgcaactgcgcttattactggacctttggttcatatattgcttactatgtgaaccacccattatatacccctgtaagcgacctccaagtgaagattggatttgggtttgggatactctgtcaagtttcgaatttctattgccatattatactgaggaatcttcgcaatcctgaggggagtggtggatatcaaatcccacgtggctttctcttcaatatcgtgacctgtgcaaattatacaacagagatctatcagtggttggggttcaacattgcaacacaaactgttgcaggttatgtttttctcgcggttgctacttttatcatgtccaattgggctattgcaaagcacaggcgcttgaagaagttatttgatggaaaggaaggtcgaccgaggtatccccgtcgatttataatattgcctccattcctgtagaagtcatagccactgatgaggtcaaccacttctagttcacaggattctgagatttagaaatgtagcttgatgttaaagtttagtgattatttcatatcagatatgaatgtctttcaatttatagatcaatatgggaatgattgtgtttatcatatttgatgttggtggggccagtatttcattaattatcaattcagattcagaaagtgaagtttaacttttatcgacttagctcacaataattttctctgtattaatgttgcagtaaagaacacatgttacccaatcatacagcattatatc

SEQ ID NO: 645 - DNA, 1491 bp, Chrysanthemum coronarium
ttagcagttgggtgatctacttccaaccaaacgccttaatatcaatcactcacccctacccattcatccatcaaaatcactttgcccataaaaccaagcatacccacattttcattaatctcatttatatagatctattattagcattgttttctccgttatcaaacaagataatgaaggtgcttgttactactcgcagtggtagggagttaattaacggtggccttaaccttgatgattccgcaactgttgctgatttgcagaatgccattcatcagaaaatcaagaaatactatccttccagacagcgcctgactctgcccatccaaccggggtcaaaggagaagcctgtagttcttcaaggcaagaaaagtctcaaggagtatactagcggaagttctgacaccgttagtgtagtttttaaggacttgggtccacaagtttcataccaaacactcttcttttttgagtatttgggcccactcgtcctctatcctgtcttctattacttccctgtgtaccggttttttggctacaaaggtgaacgtgttatgcatccagctcagacatatgcgctatactactggtgtttccactacttcaaacgtatcatggaaaccttctttgttcaccgtttcagtcacgcaacctcacctatttcaaatgtcttcagaaacgctgcttattactggagtttcggctgttatattgcttattatgttaatcaccccctttacacacccgtaagtgatctccagatgaagatcggatttggatttggggcaatcatgcaaatctctaacttgtattgccacatcatactgagaaatctccgcagccccaatggacctggaggataccaaatcccacgtgggtttttgttcaatattgtgacatgtgcaaattacacaaccgagatttatcagtggttgggctttaatattgcaactcagactgttgctggttatgtatttctggtggttgctgcttccatcatgactaattgggcattggctaagcatagtcgtctcaggaggctctttgacggtaaggaaggaagacccaagtatccccgccgatgggttatattgcctccattcttttaagcgattacaaacatggatcgtgggttattgattatcagctatttggtcgtgcaatgagttcattctagtcaacatcctcaaaagagtcagatttcttgcattcttagaagtttattttcgaattatcagtttctacgattaatttttctaggtccaagttcctttaccatgtggacttgccacggatggcttttatatttagctgatttgtatttgctcctttgagtctttacttatgtaatatctggatcatttccaaatttgcagaatcttgatgtgtttctttcggtttagaataggtctcgtctcttttagcaaaataaagatatgttcattgatacaataagatgcataagattctgtattgaaattgcacgagtagtgt

SEQ ID NO: 646 - DNA, 1296 bp, Bupleurum chinense
tgagccattgtttatctacaatttattgtatcaattcgatcgttgggttagatattgttcactgaatcttctacaaatacatcacaagggtctcttctttcctccaattcttgaactgggtcacgcttgtgttcggagaatatgaaggtcactgtcactactcgaagcggtagagaactcattaagggtcacattgatctcaatgattctgctactgtggctgatctgcaagaagctatacataagagaaccaagaaatattatccctctaggcagcggctaaccctccccgttaaacctggatcaaaggagaagcctactgtccttcagtataagaaaagtctcaaagagtttacagatggcaatggagaccaattaactgtagttttcaaggacttgggtccacaagtttcctatcctatattgttcttttgggaatacttgggtcctctactcatctatcctgtcttctacttcttccctgtgtaccaatacctgggtttcaaaggggagcgtgtcatccaccccgttcaaacttatgccttgtactactggtgctttcactacttcaaacgcatcatggagacattttttgtccatcgtttcagccatgcaacttcaccaatttcaaatgtgtttcgcaactgtacttattactggtcttttggtgctttgattgcttactatgtaaatcaccctctttatacaccagtaagtgaccttcaaatgaagattggatttggatttggtatactttgtcaagttgcaaacttttattgtcatataatactgaggaaccttcggggcgacggaagtggaggctatcaaatcccccgtggttttttgttcaacattgtaacctgtgcaaattacaccacagaaatatatcagtggctgggattcaatatcgcaacacagacagttgcaggctacgtctttttaattgttgctgctttcatcatgactaattgggctcttgcaaagcaccgtcgtttaaagaggctctttgatgggaaggaaggccgatctaagtatccaagaaggtgggtgatattgcccccatttctgtaagcgaatatcaagcttgagatttgtccatttggttccaagattgagatgcagcaccccttttaatatcaatgttcacagctacgggttccatagcagaacctatgctgcttgttgccattactttctgttgaaactttctgattgtttcaaggatgtgtccccttttcactgttctatcaaatgcttatatatgcctagacactgtagctgtggacaaaaaaattg

SEQ ID NO: 647 - DNA, 1394 bp, Gossypium hirsutum
aactcacaaacaccttctctactttctttttttctaacttataaacttcgagatctccgtgcacaaaaagcttccaagggtctgttcctttccccctaacaaattttgggtatcttttgttttgttctataggatgaaggtcactctagtttcacgcagtggaagagagttcatcaatggtggcctcgagcttcctgactcagctactgtggctgatctgcaggaggcaatttacaagagaactaaaaagttttatccttcaagacaaagactaacactcccagtacctccgggatcaaaggagagacctgtcgtccttaactacaagaagagcctcaaagattactctgatgaaaaacagaacaagttaactgtagtgttcaaggatctgggtccgcaagtatcgtatagtacacttttcttctttgaatacttgggtcctttgatcctctatcctatcttctactactttccagtgtacaagttctttggttatggagaggatcgtgtgatccacccagttcaaacatatgctgtatattactggtgtttccactacctcaaacgtattatggaaacattctttgtccaccgcttcagccatgcaacatctccactctcaaatgtcttccggaattgtgcttattattggctctttggttcttacatagcttactacgtaaaccacccactttacacacctgttggtgatcttcaaatgaagatagggtttggatttgggttggtttgtcaactgtcaaacttatattgtcatatcatactgaagaatctacgaaaccctgatgggagcggaggctatcaaattcctcatcgatttgtgttcaacattgtgacatgtgcaaactacactacagagatttaccaatggctcggtttcaatattgctacgcagactgttgcaggttatgtatttctcgtagttgctacttctatcatgaccaattgggccctcgcaaagcaccgccgtttgaagaagctatttgacggtaatgaaggaaggcctaagtacccgcgcagatgggtaattcttcccccattcctgtagaatgacgggtaaaacctcctactcattggacttttttcagtattaagttttcattccagaagcatggattcgagttcatgtcagatacgaacataagatgaccagggaattcatttttgttttcagtttagataatgtaatgtatctgatatgcattaggatgatccttctttttgtataaatattcaattgataaaggttgatgccattcaatcagcttgatactactggcatcaaagtttgagctaacttcaaaaaacccgtcctcggactgcaactcgcatacatgaagttggattcctactctcgaattttgtcaacacagtta

SEQ ID NO: 648 - DNA, 1249 bp, Distylium racemosum
attcactcggctcaccaacaaggcaatgttgttataatttctatactgaacatcacgctcataaatacagaggcctatcttcgaatgcaattcgaccttgttattgtttgagggattcattccagaggaggagtggggatttcgaagatgaagatctcagcggtctctcgcagcggtagagaaattgttaaggggggcattgaactcaatgacaatgctactgtggatgatctgaaatcttcaatctaccagcgaaccaagaagtattaccctgctaggcagcgtcttacacttccagtgcaacctggccaagggaaacctgttgttctccaatcaggaaagagactgaaagattattttgaaaacaatgaaggatatcaggtggtgttcaaagatttaggtccccaggtttcctacaggacactatttttctttgaatatctaggccctctattaatttatccaatcttctattacttcccggtgtacaagttctttggatatcctgccgagaaggttatacacccagttcagacatatgcattgtattattggtgctttcactacttcaaacggatattagagacttttttcgttcacagattcagtcatgcaacctctcctatttctaatgtatttagaaactgttgttactactggacgtttggtgctttcatagcctatttcgtcaatcatcctctctatacacctgttagtgagaagcaatggaagattggttttgggctggggcttttgtgtcaggcagcaaacttttactgtcatattctcctaaggaatctcagaagccctgatggtaagggaggatatcagattccaactgggttcctgtttaatattgtcacatgcgctaactacactactgagatatatcagtggttgggtttcaatattgcaacacagacagtggctggctattcgtttcttcttgtagcaaccctcatcatgacggattgggctttagggaagcaccgccgtcttaagaagttgtttgatggtaaagatggcagacccaaatatcccaggcgctgggtgatattaccaccttttctgtgaaatggatgcagtatttaatgcaacatatgtttgcaggagacacttggttgaagttgcatatggaatttttagttgatgggacaatttagttctgagctatttctaggcatgatcgatcatacatcgaacttgtcatctttattatttaagatagtgtttcagaaatgaacctgaa

SEQ ID NO: 649 - DNA, 852 bp, Echinochloa colona
accacacacaggcacaggggagctgtagagggcggagagcagaagccggcggagccatggcgacccctctctcgttatcttctcccctcttcctcgcagctccagccagagctagaaatgtgatctcgtacggagtggcttcagctactccatcagggagctctggaaatgcgctaggcaagggctacgtggatagggtgcatgactggcggcaacagcgacgacgaacagcaatagtatctgtgattggaagaaagtcaacggccagagaaacagtcgtccctgaccccgactacaggttaccaattgctatacttgggattgctggtgcttttgcatatgcagataatcttctagctgctgcgcctgtgggactgctcgggcttcttcttttgttccagactacaagagtgagattcgtttttgataatgaggccctggaagtgaaagttggagaacagctgcaggagtcaggtgaaaatgtattgtggtggcaagaaccgttggaagtactcaacattcataaattgggagctgtggtggccacaatttcctatcttagtttacttcaaggagacgcaaacgaaacccgagggacaaatccacttcttccctgtgatattcaatggccgacaactatatgatgtcatggtggagcgtgctggaccctccaagacaagtggccctaaatagtgtcgagcttccctcatgatgacgatgacctgagctctatggcttctcttgcatcagctgaatctccagggcttggacaatattcctgatgtatagcatatgcatcttcagtatactagaaaccgatgccattcaaccttttcttttgcaactatgata

SEQ ID NO: 650 - DNA, 890 bp, Saccharum officinarum
tggagagcagaagccggcggagccatggctaccaccactctttcgttatcctctcccttcctcctcggagctccggccagagctagagatgtgatttcgtatggagtggcttcggctagtatatcaccgagcactgtaaatgtgctaggcaagggctacatgagtagggttcatgatcgggagcaacagcgacgaacggcgatagtatctgtgcttggaaggaagaagtcaacggccaaagaaacagttgtcccggaccccgactataggttaccaattgctatacttgggattgctagtgcttttgcatatgcagacaatcttctagctgctgcacctgtaggactgctggggcttcttcttttgttccagactacaagagtgaggttcgtctttgataatgaggccctggaggtgaaagttggagaccagctgcaggagtcaggtgaaaatgtatttgtcggcggcaagaaccgatggaagtattcaacgtttgtaaattgggaactatggtggccacagtttcctatcttggtttacttcaaggagacccaaacaaagcccgaaggacaagtccacttcttccctgtgatattcaatggtcgacaattatacgatgtaatggtggagcgtgctggaccctcgaagacgagcggccctaaatagtgccactgagcttccctcgtgacaatgacacgagctccatgtcttctttggcggatcctgggacaacattgcttcctgatgctgatgtgtagcgtgcgcttctctcttgaaaaaaggcgtatatatgtagcacttacatggtatactagaaactgatgccatgcaactttttcttctgcaatgcaactatgataaagcaagcctgttgggcgatttttatattt

SEQ ID NO: 651 - DNA, 883 bp, Zea mays
gttggatgaggaaaggaagctctggatttaatgtgctcacatgtgcacaggagcttgacgcaaaggggagccgtagcctgtagagtgcggggagcaggagccggcggagccatggcgaccactctttcgttatcctctcccctcttcctcggagctccggccagagctagagatgtggttccgtacggagtgacttcggctagtgtatcactgatgactctaaatatgccaggcaagggttacacgagtagagttcgttgtcgggagcagcagcgacgaacgacaatagtatctatgcttggaaggaaatcaacggctagagcaactgttgtcccagaccccgactataggttaccaatcgctatacttgggattgctagtgcttttgcatatgccgacaatcttctcgctgctgcacctgtaggactgctggggcttcttcttttgttccagactacaagagtgaggttcgtctttgataacgaggccctggaggtgaaggttggagagcagctgcaggagtcaggtgaaaatgtattcgtcggcggcaagaaccgttggaagtactcaacgttcgtaaactgggagctgtggtggccacagtttcctgtcttggtttacttcaaggagacccaaacgaagcccgaaggacagatccacttcttccctgtgatattcgatggtcgacaattgtacgatgtgatggtggagcgtgctgggccctcgaagacgagtggccctaaatagttgcagctgatcttcctaccgtcgttttgctccctcgggctccctcacatttaaattgtaaaaatggtaaaattatatacaaacggggttcgattccaaccacggttcttagctttaaacccatcttcatacgtac

SEQ ID NO: 652 - DNA, 909 bp, Echinochloa colona
accacacacaggcacaggggagctgtagagggcggagagcagaagccggcggagccatggcgacccctctctcgttatcttctcccctcttcctcgcagctccagccagagctagagatgtgatctcgtacggagtggcttcagctactccatcagggagctctggaaatgcgctaggcaagggctacgtggatagggtgcatgactggcggcaacagcgacgacgaacagcaatagtatctgtgattggaagaagaaagtcaacggccagagaaacagtcgtccctgaccccgactacaggttaccaattgctatacttgggatttctggtgcttctgcatatgccgataatcttctagctgctgcgcctgtgggactgcttgggcttcttcttttgttccagactacaagagtgagattcgtttttgataatgaggccctggaagtgaaagttggagaacagctgcaggagtcaggtgaaaatgtatttgttggtggcaagaaccgttggaagtactcaacattcataaattgggagctgtggtggccacaatttcctatcttagtttacttcaaggagacgcaaacgaaacccgagggacaaatccacttcttccctgtgatattcaatggccgacaactatatgatgtcatggtggagcgtgctggaccctccaagacaagcggccctaaatagtgttgagcttccctcacgatgacgatgacttgagctccatggcttctttcagctgaatctccagggcttggacaatattcctgatgtatagcatatgcatcttcagtatactagaaaccgatgtcattcaaccttttcttttgcaactatgataatgaaaaatagaacttcaacgacatattgtttacctggatgtatatttggtgatttc

SEQ ID NO: 653 - DNA, 921 bp, Sorghum bicolor
agcctgtaccctgtagagagggtggagagcagaagccggcggagccatggcgaccactctttcgttatcctctcccctcttcctcggagctccggccagagctagagatgcaatttcgtatggagtggcttcggctagtatatcaccaaccactgtaaatgttctaggcaagggctacacgagcagggttcctgttcgggagcaacagcgacgaatggcgatagtatctgtgcttggaaggaagaagtcaacggccaaagaaacagttgtcccggaccctgactataggttaccaattgctatacttgggattgctagtgcttttgcatatgcagacaatcttctagctgctgcacctgtaggactgctggggcttcttcttttgttccagactacaagagtgaggttcgtctttgataatgaggccctggaggtgaaagttggagaccagctgcaggagtcaggtgaaaatgtgtttgtcggcggcaagaaccgttggaagtactcaacgtttgtaaattgggagctatggtggccacagtttcctatcttggtttacttcaaggagacccagacaaagcccgaaggacaaatccacttcttccctgtgatattcaatggtcgacaattatatgatgtaatggtggagcgtgctggaccctcgaagacgagtggccctaaatagtgccaccttgcttcttccctcgtggcaatgacatgactttccatgtcttctatggctcggatccttggacaaatattccgtcctgatgtgtagcttgcgcttcccttcaagtagaaggtcgtgtatatatatagcgtctatacttgttgtatcttcagtagggataatagaaactaatgtcatgcaactttttcttctggaactgcaactgtgatgaatcaaagcttgtgcgagga

SEQ ID NO: 654 - DNA, 1841 bp, Sorghum bicolor
aaaaaaattagccaactttttagacccgtgaacagagccgcgcctgttaattagtaaagaggtatatagcataggccaaccccaaaggtcactcataatgagctgagcctgctaccgtccatgccggcagaggacgagatggtcttattagcggcagatgaggcgtcatggcccatttcctcgccgccgccggcgtggttcgccgccctggtcgccatcggcctctacatcgtcgtgcggtccgccgccaccttcctcctctggctccaccgcgcgttcctgcggccgggcagggacctggcggggtggtacgggacgtgggcggtggtgaccggcgccacggacggcatcggccgcgcggtggcgctggagctggcgcgcgcggggctccacctcgtgctcgtggggcggagcccggacaagctggcgcgggtggcgaaggaggtcctggccgccgcgccgccgtcgtgcaaggtgcggaccgtggagttcgacctcgccgtgaccggggacgacgacgcgcggcgcggggtggcgcgggtggtggccgccgtggagggccgcgacgtgggcgtcctcgtcaacaacgccggcgccacgtacccgtgcgccgcctacttccacgaggtggagcgccccgtgtgggaggccgtcctgcgggtgaacgtcgaggccgcgacgcggatcacgcgcgccctgctgccgatgatggcggccaaggggaggggcgccgtcgtcaacgtgggctccggctccagcgtcgtcgtgccggcgttcccgctctacgccgtctacgcggcgagcaaagcgtacgttgatcaattttctcgaagcctgagtgtcgaatacaaacaatatggtgtagacgtgcaatgccagatccccctgtatgtggctaccaagatgtcgcctgtgaagggtgcttctccgttcataccatcgcctgaggagtacgccagagcagctcttggctgcatcggctacgaggcgaggtgcgtcccgtactggcgccactcggttcagtggttcttggcatccctaatgccagatgcggctctgaatcactggcgcctccaaactggcatccggaaacgaaacgagatgaaggctctgctcggagaaaaagcctgcggttaaaattgttgtgcagatcgagaggaaatggagtgatgtgcgtttaaaaactgtgctctgtttggaatcaatcctagctagtaaaaaaacccaataattagagtgtagtcttgcaaacagtacattcagtctagtggtctacgtagaaccatactactagtgtgtgatttgttgagtggaaactggaaacataccgtcttgaagtattcgttgtttatctgaaatgcaaatattgctacattgtcagcagtacgacacaagcagaacgtgagtcatcgggcgagggacaagatgcagcgactgaagaatcaagcgtgacgcgtccaagaaaaggggctcgagccaggcggccaaatgttctcgtcagtggacccgaatgggcttgagccagcgactaaacgcagctgcgcctgcgggctcaagtctggacgctgcccatgtataaaacggagtctgtgaaacccgaggggggcatcaaacaagaacaaaccaaaccagtattaagattcctattaccgttaccttatgtgttctgctttccttcctctctgtcctgctcctcttccccaactccgttactccctatcagagatgttaacatacatggatctattttagctaagcgcaccgtggagcttatcaggtcatgctcaaaaatacttgatgcagttaggattttgacgtcacaattgaaatgtgttcaacgg

SEQ ID NO: 655 - DNA, 1260 bp, Panicum virgatum
agcctcttctagcctgggctaaggtcataatgagccgcctactgctgtccgcgacgggagtgtccaagatggcatggttggctgcagatcgggcggcgccatggccgccggcgtcctcgtcctcgtcgccggcggccccggtgtggttcaccgtactggtggccgtcggcctcttcgtcgtggtccggtccgcggccaccttcctcgcgtggctgcgccgcgcgttcctccggccgggccgggacctggccgcgcggtacggcgcgtgggcggtggtgacgggcgccacggacggcatcggacgcgcggtggcgctggagctcgcgcgccggggcctccacctcgtcctcgtggggcggagccccggcaagctggcgcgcgtggggaaggaggtccgggccgccgcgccgtcgtgcgaggtgcgggccgtggcgttcgacctcgccgccacgggggccgacgcgcggcgcggcgtggcgagggtggcggccgccgtggagggccgggacgtgggcctcctcgtcaacaacgccggcgcgacgtacccgtgcgcggcctacttccacgaggtcgaggaggccgtgtgggaggccgtggtgcgagtcaatgtggaggccgcgacgcggatcacgcgcgccgtcctgccgctgatggcagcgaggggcaggggcgccgtcgtcaacgtgggctctggctcctccgtcgtcgtgccggcgttcccgctctacgccgtctacgcggcgagcaaagcgtacgttgataaattttctcgaagcttgagcgttgaatacaaacaatatggagtagacgtgcaatgccagatccctctgtatgtcgctaccaagatgtccccggtcaagggtgattctccattcataccatcgccagaggagtacgccaaggttgctcttggttgcattggctatgaggcaaggtgcctcccgtattggcgccactcagtccagtggttcttggcgtcgctagtgccggatgctgctctcaaccagtggcgcctccgaattggcatccggaaaagaaacgagatgaaggctactctggttgaagagaaagtcttcagttaagttgttataaatattgtattgtgatgatgggtttcaatatctgtgttctatttgcacttctaaaaaactttattgagtagtctagcaaccagcactttagtcaattggagaatgactggaaataatcggtcgtgtcttgggagtgactgcacaatactcgagtgattttgttttctat

SEQ ID NO: 656 - DNA, 5620 bp, Sorghum bicolor
agcagagcacagcggagcagaaggtggcgagtggaagcaaatggccaatgagtggcggtggtggtggtggtagcatactcctcgccttttctccccgcctcccgcgctctggttgttgcagcgagtgggagcgggaggactcgtgctgcctccgtcgcttctcgggcacgcctccctcgcccggatctgggccgcgcgcgcgagatcctgagctccgggctggagagctcccgtgctccgggtgggaatttcttcgtggcagctcaggtgacggcgatggagcccgcggtggctacagcgggtgaagggcagcggttcaagcggattccgcggcaggcgtggtcgggaaacctcgaactggatcctctgctcaatgaaagcttagatcagtggccacatctaaatgagctggtacagtgctacaaggctgattttgtgaaggatgactgcaaatatggacggtatgagagtgtcgcaccaccgtctttccaaaatcaaattttcgagggacctgatactgacatagaaacagaattgcagctttgcaacgcaaggcattccaaggctgaagatgctaccgaagatgatacgccaagcacctcagggaggcaaatatatgaaactgaatcagctgcttcatcttcaaaagtgcactgtagtctgtcaccactgccagcatatgaacctgcatttgattgggagaatgagaggtctttgatatttggccaaagggtgccagaaagtatacctgcaataagcaacagtggcttgaagataactgtcaaggtactgtctttgtcattccaagctggattagtcgaaccttttagtggaacaatttgcttgtataacagagatagaagagagaaactgtcagaagacttctattttcacatacttccaacagatatgcaggatgctcagggttccttggatcgtcgaggcgttttttcattggatgcaccttcaccatcggtctgccttttgattcaattggaaaaacctgctactgaagaagggggagtaacaccttctgtttattctcgaaaagagcctgtgcacttagctgagaaagagaagcaaaagctgcaagtatggtctcgaatcatgccttataaagagtcatttgcatgggccatgattcctctgtttgaaggtaaccatgcgggtggtcttagtgatgctgcttctcctagcagtcctttagcaccgagtttatcaggatcaagttcgcaagatagtattgtggaccctatttcaaagcttactttagatggaaaagtcaaccattactcaagtggaagctcagttattgtagagatatcaaacctaaacaaagtgaaggaaagctatatagaggactccctccaagatccaaaacggaaagtacataaaccagtgaaaggagtattgagattagaagtggaaaaacttcataatggccgcaatgatgtggataacgcttctgaaggcggaagcatggccaatgatttaaatgatgctggtgacatcaataatggcagaagcaacagaagtagctttgatgggattcgcagttctgtgaattctattgccattggccagaaagatgctcatcacaatggacacatttctaatgctgagaatggtgacagttttcaagcttttgactttcggatgctgacccgaagtgagccgttttcacaactttttcattgcctctatgtgtacccgttgactgttagcttgagccgcaaaagaaacctgtttgttagagtggaactgagaaaggacgattctgacatccgaaagcctccattagaggtgatcgttgggtattctgtacttccactgtcaacacatattcagttactttcagatgtgtccttgccaattttgagagagcttgttccacattacctgcaggaaagtggaaaggagagaatggactatctggaagatggaaaaactgttttcaggttgcgtttaaggctatgctcatcattgttcccagttaatgaaaggataagagacttttttgttgagtatgaccgccatactctacatacaagtcccccatggggttctgagcttcttgaggccataaatagtttgaaaaatgtcgaatctactgcattattacaatttctgcaaccaatacttaacatgctgcttcatcttattggcgacggcggtgagacccttcaggttgctgcatttcgagccatggttaacattttaacccgtgtgcagcaggagtcatcagatggggctgagagaaatagattccttattaactatgttgattttgcttttgatgacttcggtgatcggcaagcacctgtgtatcctggtctgtctactgtttggggaagtttggctcggagtaaggcaaaaggttatagagttggtcctgtgtatgatgatgtgttggcaatggcttggttttttctggagcttattgtaaaatcaatgggattggaacaaagccgtctcttctaccacaaccttccactaggtgaagatgtcccaccgctacaattgaaagaaggtgtcttcaggtgcatcatgcagctctttgattgccttctaactgaggttcatgagcgctgtaaaaagggtttaagcttggcaaaacgcttgaacagcacacttgctttcttttgctatgatcttttatcaattattgagcctcgccaagtttttgagctggtttcattgtacatggacaagtttgcaggagtttgtcaatcagtccttcatgactgcaaattgacattcctgcagataatatgcgaccatgatctattcgttgagatgcctgggcgggatccctctgatagaaactatctctcatcagttcttattcaagagatctttctgaccttagaccatgatgatctgtctcaacgagcgaaggctgctcggattttggttgtccttatatgcaagcatgaatttgatgcacgctatcaaaaaagcgaagacaagctgtacattgctcagctgtactttcctcttatagggcagatccttgatgagatgcccgttttctataatctgaatgccgttgaaaagcgtgaagtgctagttgtcattttgcaaattgtaaggaacttggatgatgcgactcttatcaaagcatggcaacaaagcattgctagaaccagattgttcttcaagcttcttgaagaatgtataacccattttgagcacaacaaaacaggagacagcatgctacttggtgctagttctcggagcccagatgtcgagcgtcctgcatccccaaagtactctgagcgattgtctccatcggtcaacgcatatttgtcggaggcttcaaggcatgaaataaggcctcagggaacaccagaaaatggatacatgtggaacagggttagccctcaattaagttcccctaatcaaccctattcattgagggaagcacttgctcaagcgcaatcttcaagaatcgggtcaaccgccagggcattgagagagtctctacatccagtactgagacaaaaattggaactttgggaagaaaatcttagtactgctgtgagcctcgaagtgttgggaataaccgagaagttttcagttgctgcaggcactcgaagcatcactactgattatgcgaagctagattgtgtaacatctatcttaatgggtcttttatctaggagccagcccttggctttttggaaggctttccttcctgtggtctacaatatatttaatcttcatggtgcaacactaatggcaagggagaatgaccgcttcttgaagcaaattgcttttcatcttctgcggcttgctgttttccgaaatgattcgattagaaaaagagctgttgttgggttgcagattcttgttaggaactcattcaactatttcaagaacactacaaggttgagggtcatgttgacaattactttgtcagagttgatgtccgatgtgcaagtaactcaaatgaaatccgatggttctcttgaagaaagcggtgaagctcgtcgccttaggaaatcactggaggaaatggctgatgtgagaagcaaggatctgttaaaagattgtggcctccctgttactgcattggaggcggtccctgaaggttcctctgatattaggtggtcttgggtagaggtgaaacatctgtctaaatgtctagtccaggcccttgatgctggtctggaacatgccctcttgggttctgcagtgactgtagacaggtatgcagctgccgagggtttctataaactagctatggcgtatgcgcctgttccagatcttcacattatgtggttgctgcatctgtgtgatgcacaccaggagatgcaatcatgggctgaagcagcacaatgtgcagttgctgtagctggtgtgatcatgcaggcacttgttggaaggaatgatgctgtgtggagcaaggagcatgttgcttcgctgtgcaagatttgccctatcgtcaacactgatgtgagtgcagaagcatccgcagctgaagttgagggatatggtgcatccaaactaacagtggactcggcggttaaatatcttcaactggccaataaactcttcacacaagctgaactctaccatttttgtgcaagcattcaggaactcataattcctgtgtataaaagcagaagggcttatggacagctggccaaatgccatacatcactcacaaacatctatgagtcaattcttgaacaggaggctagtcctataccattcattgatgccacatactaccgagttggtttctatggtgagcgttttggcaagctcaatagaaaggagtatgtatttagagaaccacgggatgtacgtcttggtgatattatggagaagcttagtcatatatatgaggctaaaatggatgggagtcacactttacacataatcccagactctagacaagtcaatgctgatgagttgcaacctggcgtctgctatttacagatcactgccgttgatcctgtgatggaggatgaggacttgggtagcaggagggaaaggatattttctttgtctactggtactgttcgtgcacgtgtttttgaccgttttctttttgatacaccattcacaaaaaatggaaaaacacaaggtggtctagaagaccagtggaagaggcgtacggtgctccagacagagggttcctttcccgcgttggtgaatcgcctgctagttaccaaatctgaatctctggagttctctcctgttgagaatgcgattggaatgattgaaacaagaacagctgcattaagaaatgaactagaagaaccacggagttctgaaggtgatcaactcccaaggcttcaaagcttgcaaaggatactccaaggaagtgtggctgtgcaggtcaacagtggggtattaagtgtgtgcactgcattcttatctggtgagccagcgacaaggctcagatcccaagaactgcagcaactcatcgctgcattgcttgaattcatggctgtctgcaagcgtgcaatccgtgtgcatttcagattgataggggaagaagaccaggaattccacacccaacttgtcaatgggttccagtcactcactgctgagctatctcactatatccctgctatactctccgagctatgatagagccagaaattag

SEQ ID NO: 657 - DNA, 5998 bp, Zea mays
cccggatctgcgccgctcgcgtgggatcctgagctccgggttggagagctctcgcgttccgggtgggaatttcgtcggtcaggtgacggtgatggagcccgcggtggctacggcgggtgaagggcagcggttcaagcggatttcgcggcaggcgtggtcggggaacctggaactggatcctttgcttaatgaaagcttagatcagtggccacatctaaatgatctggtacagtgctacaaggctgattttgtgaaggatgactgcaaatatggacgctatgagagtgttgcaccaccatctttccaaaatcaaattttcgagggacctgatacagacatagaaacagaattgcagctttgcaacgcaagacatttcaagcctgaagatcctaccgaagatgatatgccaagcacctcagggaggcaaatgtatgaaaccgaatcatctgcttcatcttcaaaagtgcactgtagtctgtcaccactgccagcatatgagcctgcatttgattgggagaatgagaggtctttgatatttggccaaagggtgccagaaagtataccagcaataagcaacagtggcttgaagataactgtcaaggtactatctttgtcattccaagctggattagttgaacctttcagtggaacgatttgcttgtataacagagatagaagagaaaaactgtcagaagacttctactttcacatacttccaacagatatgcaggatgctcagggttctttggatcgtcgaggcgttttttcattggacacaccttcaccatcagtctgccttttgattcaattggaaaaggctgctactgaagaagggggagtaacaccttctgtttattctcgtaaagagcctgtgcacttagctgagaaagagaagcaaaagctgcaagtatggtctcgaattatgccttgtaaagagtcatttgcatgggccatgattcctctgtttgaaggtaaccatgcgggtggtcttagtgatgctgcttctcctagcagtcctttagcaacaagtttaccaggatcaacttctcaagatagtattgtggaccctattttaaagcttactttagatggaaaagtaaaccattactcgagtggaagctcagttattgtagagatatcaaacctaaacaaagtgaaggaaagctatatagtggactccctccaagatccaaaacggaaagtacataaaccagtgaaaggtgtattgagattagaagtggaaaaacttcatggtggccacaatgatgtggataacacttctgaaggcggaagcatggccaatgatttgaatgatgctggtgacatcaataatggcagaagcaacagaagtagctttgatgggattcacagttttgtgaattctattgccattgcccagaaagatgctcatcacaatggaatcatttctaatgctgagaatggtgacaattttgaagcttttgactttcggatgctgacccgaagtgagccgttttcacaactttttcattgcctctatgtgtacccattgactgttagcttgagccgcaaaagaaacctgtttgttagagtggaactgagaaaggacgattctgacatccgaaagcctccattagaggctgttcatcctagggagcggaatatgatgctacagaagtggggccatacacagattgctgttggaacaagaatggcttcctaccatgatgaagttaaaatcagcctacctgctcttttgacaccccagcatcatcttgtgttcacatttttccatgtagatcttcaaatgaaacttgaagcaccaaaaccagtgatcgttgggcattctgtacttccactgtcgacacatattcagttactttcagatgtatccttgccaattttgagagagctcgttccacattacctgcagggaagtggaaaggagagaatggactatctggaagatggaaaaactgttttcaagttgcgtttaaggctctgttcttcattgttcccggttaatgaaaggataagagacttttttgttgaatatgaccgccatactctacatacaagtcccccatggggttctgagcttcttgaggccataaatagtttgaaaaacgttgaatctactgcattattacaatttctgcaaccaatacttaacatgctgcttcatcttattggcgatggcggtgagacccttcaggttgctgcgtttcgagccatggttaacattttaacccgtgtgcagcaggagtcatcagatggggctgagagaaatagattccttattaattatgttgattttgcttttgatgacttcggcggtcggcaagcacctgtgtatcctggtctgtctactgtttggggaagtcttgctaggagtaaggcgaaaggttatagagttggtcctgtgtatgatgatgtgttggcaatggcttggttttttctggagcttattgtaaaatcaatgggattggaacaaagtcgtctcttctaccacaaccttccattaggtgaagatgtcccaccgctacaattgaaagaaggtgtcttcaggtgcatcatgcagctctttgattgccttctaactgaggttcatgaacgctgtaaaaagggtttaagcttggcaaaacgcttgaacagcacgcttgctttcttttgctatgatcttttatcaataattgagcctcgccaagtttttgagctggtttcgttgtacatggacaagtttgcaggagtttgtcaagcagtccttcatgactgcaaattgacattcctgcagataatatgcgaccatgatctattcgttgagatgcctgggcgggatccctctgatagaaactatctctcgtcagttcttattcaagagatctttctgaccttagaccatgatgatttgtctcaacgagcgaaggctgctcggattctggttgtccttatatgcaaacatgaatttgatgcacgctatcaaaaaagtgaagacaagctgtacattgctcagctgtacttctctcttatagggcagatccttgatgagatgcctgttttctataatctgaatgccatcgaaaagcgtgaagtgctagttgtcattttgcaaattgtaaggaacttggatgatgcaactcttatcaaagcatggcaacaaagcattgctagaaccagattgttcttcaagcttcttgaagaatgtataacccattttgagcacaacaaaacaggaggcagcatgctacttggtgctagttctcggagcccagatgttgagcgccctgcacccccaaagtactctgagcgattatccccatcagtcaatgcatatttgtcggaggcttcaaggcatgaaataaggcctcagggaacaccagaaaatgggtacatgtggaacagggttagccctcaattaagttcccctaatcaaccctattcattgagggaagcacttgctcaagcacaatcttcaagaattgggtcaaccgccagggcattgagagagtctctgcatccagtactgagacaaaaattggaactttgggaagaaaatctcagtactgctgtgagcctcgaagtgttgagaataaccgagaagttttcagctgctgcaggcactagaagcatcactactgattatgcgaagctagattgtgtaacatctatcgtaatgggtcttttatctaggagccaacccttggcattttggaaggctttccttcctgtggtctacaacatatttaatcttcatggtgcaacactaatggcaagggagaatgaccgcttcttgaagcaaattgcttttcatcttttgcggcttgctgtttttcgaaatgattctattaggaaaagagctgttgttgggttgcagattctcgttaggaacgcattcaactatttcaagaacactacaaggttgagagtcatgttgacaattactttgtcagagttgttgtctgatgtgcaagtgactcaaatgaaatccgatggttctcttgaagaaagtggtgaagctcggcgccttagaaaatcactggaggaaatggctgatgtaagaagcaaggatctgttgaaagattgtggcctccctgttactgcattggaggcggcccctgatggttcctctgataatatgtggtcttgggcagaggtgaaacatctctctaaatgtctagtccaggcccttgatgctggtctggaacacgccctcttggattctgtagtgactgtagacaggtatgcagctgctgagggtttctataaactagctatggcctatgcgcccgttccagatcttcacattatgtggttgcagcatttgtgtgatgcacaccaggagatgcaatcatgggctgaagcagcacaatgtgcagttgctgcagctggcgtgatcatgcaggcacttgttggaaggaatgatgctgtgtggagcaaggagcatgttacttcgctacacaagatttgccctatcgtcaacactgatgtgagtgcagaagcatctgcagctgaagttgagggatatggtgcatccaaattaacagtggactcagcggttaaatatcttcaacttgccaataaactcttcacacaagctgaactttatcatttttgtgcaagcattcaggaactcataattcctgtgtataaaagcagaagggcttatggacagctggccaaatgtcatacatcactcacaaacatctatgagtcaattcttgaacaggaggcaagtcctataccattcattgatgccacatactaccgagttggtttctatggtgagcgtttcggcaagctcaataaaaaggagtatgtatttagagaaccacgagatgtacgtcttggtgatattatggagaagcttagtcatatatatgaggttaaaatggatgggagtcacactttacatataattccagattctagacaagtcaatgctgatgagttgcagcctggcgtctgctatttacagatcactgctgttgatcctgtaatggaggatgaggacttgggtagcaggagggaaaggattttttctttatctactggtactgtacgtgcacgtgtttttgaccgttttcttttcgatacaccattcacaaaaaatggaaaaacacaaggtggtctagaagaccagtggaagaggcgtactgtgctccagacagagggttcctttcctgctttggtgaaccgtctgccagtcaccaaatctgaatctctggagttctctcctgtcgagaatgcgattggaatgatcgaaacaagaacagctgcattgagaaatgaactagaagaaccacggagttctgaaggtgatcaactcccaaggcttcaaagcttgcaaaggatactccaaggaagtgtggctgtgcaggtcaacagtggggtattaagtgtgtgcactgcattcttatctggcgagccagcaactaggctcagatcccaagaactgcagcagctcatcgccgcattgcttgaattcatggctgtctgcaagcgtgcaatccgtgtgcatttcagattgataggggaagaagaccaggaattccacacccaacttgtcaatgggttccagtcactcaccgctgagctatctcattatatccctgctatactctccgagctatgatagaactgtaacaagccagaaattaggtagcatgtgaatgattcattctttcagttgcaggttcccaccaaatgtccatatttccattagttttggttgtatagttgcaccgattcctgattttggagtgtaaagtttgtataacctagtgttatctgttatgcaccagttatatgctgagtgccatgttttttgcggtttgctactgtatcacagcgagccgacattttacaacagttatatgtaatgttctgtagtgatacaatagtgcctattctgggtgatatgtatttttttccctgtaggaaatttgctgctgtcgagggcatcctcgcaatttgtttatgcacgatttgaagccttgtgttattgaagtcgttcccataa

SEQ ID NO: 658 - DNA, 6315 bp, Setaria italica
ttcgcttttcccccttcctttccactaaaaaaacactcgctcgcccaactccacctgcttccttcgcttccccttcatccccactccaccaaaccctcggcgtcgggggggagcagagcagagcacagcggagcaggaggtggcgagcggaagcaatggccaatgagtggcggtggtggtggtagcgccctcctcgccttttctccccgccctctcgccctctggttggtgcagcgggtgggagtggggggaacttgcgctgcccccgtcgcttcacgggcacgcctccctcgctcggatctgggccgcgcgcgcgagatcctgagcttcgggtgacggcgatggagcccgcggcggctgctgcgggagaagggcagcggttcaagcggattccgcggcaggcgtggtcggggaacctggagctggatccactgctcaatgaaaacttagatcagtggccacatctaaatgagctggtacagtgctacaaggctgattttgtgaaggatgatggcaaatatggacgatacgagagtgttgcaccaccttctttccagaatcaaattttcgagggacctgatactgacatagaaacagagttgcagctttgcaacgttaggcattccaagcctgaggatgctactgaagacgatacaccaagcacctcagggaggcaaatatatgaaaccgaaccatctgcttcatcttcaaaagtgcactgtagtctgtcaccgctgccagcatatgagcctgcgtatgattgggagaatgagaggtctttgatatttggccaaagggtgccagaaagtctccctgcaattaacaacagtggcttgaagataactgtcaaggtactatctttgtcattccaagctggattaattgagcctttcagtggaacgatttgcttgtacaatagagatagaagagaaaaactgtcggaagacttctactttcacatacttccaacagatatgcaggatgctcaaatttccttggatcgtcgaggcgttttctcattggatgccccttcaccatcagtctgcctcttgattcaattagaaaaagctgctactgaagaagggggagtaacaccttctgtttattctcgtaaagagcctgtgcacttaactgagaaagagaagcaaaaactgcaagtctggtctcgaatcatgtcttataaagagtcatttgcatgggctatgattcctctgtttgaaggcaaccatgctggtggtcttggtgatgctgcttctcctagcagtcctttagcaccgagtatatcaggatccagttctcaagatagtattgtggaccctatttcaaagcttactttagatggaaaactcaaccattactcaagtggaagctcagttattgtagagatatcaaacttaaacaaagtgaaggaaagctatatagaggactccctccaggatccaaaacgcaaagtacataaaccggtgaaaggtgtactgagattagaagtggaaaaacttcatgatggccaccatgatgcggataatgtttctgaaggtggaagcatggccaatgatttgaatgatgctggtgacctcagtaatggcagatgcaacaggagtagctttgatgggatccgcagttctgtgaattctagtggcgttgcccagaaagatgctcatcacaacggtaaaatttctagttgtgagaacagtgacagttttcaagcttttgacttccggatgatgacccgaagcgaaccattttcacaactttttcattgtctctatgtgtacccgttgactgttagcttgagccgcaaaagaaacctatttgtaagagtggaactgagaaaggatgattctgacatccgtaagcctccattggaggctgttcatcctagggagcggaacacaatgctacagaagtggggccatacgcagattgctgttggaacaagaatggctttgtaccatgatgaacttaaaatcagtctgcctgctcttttgacaccccaacatcatcttgtgttcacatttttccatgtagatctccaaatgaaacttgaagcaccgaaaccagtgattgttggatattctgtacttccactttcgacacatattcagttactttcggatgtatccttgccaattttgagagagcttgtcccacattacctgcaagaaagtggaaaggagagaatggactacctggaggacggaaaaactgttttcaggctgcgtttaaggctctgctcgtcactgtttccagttaatgaaaggataagggacttttttgtcgagtatgaccgccataccctacatacaagtcccccttggggttctgagcttcttgaggccataaatagtttgaagaacgtcgaatctactgcattgttacaatttctgcaaccgatactcaatatgctgctgcatcttattggtgatggcggtgagacccttcaggttgctgcatttcgagccatggttaacattttaacccgggtacagcaggagtcatcagatggggctgagagaaatagatttcttattaactatgttgattatgctttcgatgactttggtgatcggcaagcacctgtgtatcctggtctgtctactgtgtggggaagtcttgctcggagtaaggctaaaggttatagagttggtcctgtatatgatgatgtattggcaatggcttggttttttctggagcttattgtaaaatcaatgggattggaacaaagtcgtctcttctaccacaaccttccactaggtgaagatgtcccaccactacaattgaaagaaggtgtcttcaggtgcatcatgcaactctttgattgccttctaactgaggttcatgagcgctgtaaaaagggtttaagcttggcaaagcgcttgaacagcacgcttgctttcttttgctatgatcttttatcaattattgaacctcgccaagtttttgagctggtttcattgtatatggacaagtttgccggagtttgtcaatcagtcctccatgactgcaaattgacattcctgcagataatatgcgaccatgatctatttgttgagatgcctgggcgggatccctccgatagaaactatctctcgtcagttcttattcaagagatatttctcaccttggaccacgatgatttgtctcaacgagcgaaggctgctcgaattttagttgtccttatatgcaagcatgaatttgatgcacgttatcaaaaaagcgaagacaagctgtacattgctcagttgtattttcctcttatagggcagatccttgatgagatgcctgttttctataatctgaatgctgttgaaaagcgtgaggtgctagttgtcattttgcaaatcgtgaggaacttggatgatgcaactcttatcaaagcatggcaacaaagcattgctagaaccagattgttcttcaaacttcttgaagaatgtataacccattttgagcacaacaaaactggagacagcatgctacttggtgctagttctcggagccctgatgttgaacgtccagcatccccaaagtactcagaacgattatccccatcagttaatgcatatttgtcagaggcttcaaggcatgaaataaggcctcaaggaacaccagaaaacggatacatgtggaacagggttagccctcagctaagttcccctaatcaaccctattcattgagggaagcactcgctcaagcgcaatcttcaagaattgggtcaaccgccagggcattgagagagtctctacatccagtactaagacaaaaattggaactttgggaagaaaatctcagtactgctgtgagcctggaagtgttaggaataaccgagaagttttcagtcgctgcaggcactcgaagcattactactgattatgctaagttagattgtgtaacatcaatcttgatgggtcttttgtctaggagccagcccttggccttttggaaagctttccttcccgtggtttataatatatttaatctccatggcgcaacacttatggcaagggagaatgatcgcttcttgaagcaaattgcttttcatcttttgcggcttgctgttttccgaaatgattcgattagaaaaagggctgttgttgggttgcagattcttgttaggaactcgttcaactatttcaagaacactacgaggctgagggtcatgttgacgattactttgtcagaattgatgtccgatgtgcaagtgactcagatgaaatctgatggttctcttgaagaaagtggcgaagcacgtcgccttaggaaatctctggaggaaatggctgatgttagaagcaaggatctgttaaaagattgcggcctccctgttactgcattggaggctgctcctgaaggttccaatgataataggtggtcttgggtagaggtgaagcatctgtctaaatgtcttgtccaggcccttgatgctggtctggaacacgccctcttgggttctgtagtgaatgtggacaggtatgcggctgccgagggtttctataagctagctatggcttatgcgcctgttccagatcttcacattatgtggttgctacacctgtgtgatgcacaccaggagatgcagtcatgggctgaagcagcacaatgtgcagttgctgtagctggtgtgatcatgcaggcacttgttggaaggaatgatgctgtgtggagcaaggagcatgttgcttcactgcgtaagatttgccctatcgtgagcactgatgtgagcgcagaagtgtctgcagctgaagttgagggatatggtgcatccaaactaactgtggattcagctgtcaagtatcttcaacttgccaacaaactcttcgcacaagctgagctctaccatttttgtgcaagcatccaggaactcatcattcctgtgtataagagtagaaggtcttacggacagctagccaaatgccatacatcactcacaaacatctatgagtcaattcttgagcaggaggccagtcctataccatttattgatgccacgtactaccgagttggtttttacggtgagcgttttggtaagctcaataaaaaggagtatgtgtttagggagccacgggatgtacgtcttggtgacattatggagaaacttagtcatacatatgaggctaaaatggacggcaatcacaccttacacatcattccagactcaagacaagtcaatgctgatgagttgcaacctggtgtctgctatttacagatcactgctgttgatcctgtgatggaggatgaggacttgggtagcaggagggaaaggattttttctttatctactggtactgtacgtgcacgtgtgtttgaccgttttctttttgacacaccattcacaaagaatggaaaaacacaaggtggcttagaagaccagtggaagagacgcacagtgcttcagacagagggttcatttcctgctttagtgaaccgcctgctagttaccaaatctgaatctctggagttctcgccagttgagaatgcgattggaatgattgaaacaaggacagccgcattgagaaatgaactagaagaaccacggagctctgaaggtgatcaactaccaaggcttcaaagcttgcaaaggatactccaaggaagtgtggctgttcaggtcaacagtggagtattaagtgtgtgcacagcattcttatctggtgagcctgcgactaggctccgatcacaagaactgcagcagctcatcgctgcattgcttgaattcatggctgtctgcaagcgcgcaatccgtgtgcatttcagattgataggcgaagaagaccaggaattccacacccaactcgtcaatgggttccagtcactcaccgctgagctgtctcactatatccctgctatactctcggagctatgatagtactgtagcaagctggaagttaggtagcacgtgaatggttgttcattctttcagtcgtcggtccccaccaaatgtccatatttccgttagctttggttgtatagttaactagccttttgctctgcaccgttttgacgtacggagtcccgattttggagtgtaaagtatgtgtaatccttagtgttacgtgtatgtcaccgtggtgtttgttgcagtttgctcactgtactagcaacgaggacaattacgctagtcttctggagtgaaatatggtgcctggtgtttttttttatcttttgttttcttgtggaaattagcgtgcttcccaacaatttatctgtgcgcaatgtgttatttgagttgcctgtttgtataattgtattttgcatattgttcatttggaaacggattaattccctacaatcgaaacatgttaggaggtattgagggg

SEQ ID NO: 659 - DNA, 6214 bp, Setaria italica
aaaaaacactcgctcgcccaactccacctgcttccttcgcttccccttcatccccactccaccaaaccctcggcgtcgggggggagcagagcagagcacagcggagcaggaggtggcgagcggaagcaatggccaatgagtggcggtggtggtggtagcgccctcctcgccttttctccccgccctctcgccctctggttggtgcagcgggtgggagtggggggaacttgcgctgcccccgtcgcttcacgggcacgcctccctcgctcggatctgggccgcgcgcgcgagatcctgagcttcgggtgacggcgatggagcccgcggcggctgctgcgggagaagggcagcggttcaagcggattccgcggcaggcgtggtcggggaacctggagctggatccactgctcaatgaaaacttagatcagtggccacatctaaatgagctggtacagtgctacaaggctgattttgtgaaggatgatggcaaatatggacgatacgagagtgttgcaccaccttctttccagaatcaaattttcgagggacctgatactgacatagaaacagagttgcagctttgcaacgttaggcattccaagcctgaggatgctactgaagacgatacaccaagcacctcagggaggcaaatatatgaaaccgaaccatctgcttcatcttcaaaagtgcactgtagtctgtcaccgctgccagcatatgagcctgcgtatgattgggagaatgagaggtctttgatatttggccaaagggtgccagaaagtctccctgcaattaacaacagtggcttgaagataactgtcaaggtactatctttgtcattccaagctggattaattgagcctttcagtggaacgatttgcttgtacaatagagatagaagagaaaaactgtcggaagacttctactttcacatacttccaacagatatgcaggatgctcaaatttccttggatcgtcgaggcgttttctcattggatgccccttcaccatcagtctgcctcttgattcaattagaaaaagctgctactgaagaagggggagtaacaccttctgtttattctcgtaaagagcctgtgcacttaactgagaaagagaagcaaaaactgcaagtctggtctcgaatcatgtcttataaagagtcatttgcatgggctatgattcctctgtttgaaggcaaccatgctggtggtcttggtgatgctgcttctcctagcagtcctttagcaccgagtatatcaggatccagttctcaagatagtattgtggaccctatttcaaagcttactttagatggaaaactcaaccattactcaagtggaagctcagttattgtagagatatcaaacttaaacaaagtgaaggaaagctatatagaggactccctccaggatccaaaacgcaaagtacataaaccggtgaaaggtgtactgagattagaagtggaaaaacttcatgatggccaccatgatgcggataatgtttctgaaggtggaagcatggccaatgatttgaatgatgctggtgacctcagtaatggcagatgcaacaggagtagctttgatgggatccgcagttctgtgaattctagtggcgctgcccagaaagatgctcatcacaacggtaaaatttctagttgtgagaacagtgacagttttcaagcttttgacttccggatgatgacccgaagcgaaccattttcacaactttttcattgtctctatgtgtacccgttgactgttagcttgagccgcaaaagaaacctatttgtaagagtggaactgagaaaggatgattctgacatccgtaagcctccattggaggctgttcatcctagggagcggaacacaatgctacagaagtggggccatacgcagattgctgttggaacaagaatggcttcgtaccatgatgaacttaaaatcagtctgcctgctcttttgacaccccaacatcatcttgtgttcacatttttccatgtagatctccaaatgaaacttgaagcaccgaaaccagtgattgttggatattctgtacttccactttcgacacatattcagttactttcggatgtatccttgccaattttgagagagcttgtcccacattacctgcaagaaagtggaaaggagagaatggactacctggaggacggaaaaactgttttcaggctgcgtttaaggctctgctcgtcactgtttccagttaatgaaaggataagggacttttttgtcgagtatgaccgccataccctacatacaagtcccccttggggttctgagcttcttgaggccataaatagtttgaagaacgtcgaatctactgcattgttacaatttctgcaaccgatactcaatatgctgctgcatcttattggtgatggcggtgagacccttcaggttgctgcatttcgagccatggttaacattttaacccgggtacagcaggagtcatcagatggggctgagagaaatagatttcttattaactatgttgattatgctttcgatgactttggtgatcggcaagcacctgtgtatcctggtctgtctactgtgtggggaagtcttgctcggagtaaggctaaaggttatagagttggtcctgtatatgatgatgtattggcaatggcttggttttttctggagcttattgtaaaatcaatgggattggaacaaagtcgtctcttctaccacaaccttccactaggtgaagatgtcccaccactacaattgaaagaaggtgtcttcaggtgcatcatgcaactctttgattgccttctaactgaggttcatgagcgctgtaaaaagggtttaagcttggcaaagcgcttgaacagcacgcttgctttcttttgctatgatcttttatcaattattgaacctcgccaagtttttgagctggtttcattgtatatggacaagtttgccggagtttgtcaatcagttctccatgactgcaaattgacattcctgcagataatatgcgaccatgatctatttgttgagatgcctgggcgggatccctccgatagaaactatctctcgtcagttcttattcaagagatatttctcaccttggaccacgatgatttgtctcaacgagcgaaggctgctcgaattttagttgtccttatatgcaagcatgaatttgatgcacgttatcaaaaaagcgaagacaagctgtacattgctcagttgtattttcctcttatagggcagatccttgatgagatgcctgttttctataatctgaatgctgttgaaaagcgtgaggtgctagttgtcattttgcaaattgtgaggaacttggatgatgcaactcttatcaaagcatggcaacaaagcattgctagaaccagattgttcttcaaacttcttgaagaatgtataacccattttgagcacaacaaaactggagacagcatgctacttggtgctagttctcggagccctgatgttgaacgtccagcatccccaaagtactcagaacgattatccccatcagttaatgcatatttgtcagaggcttcaaggcatgaaataaggcctcaaggaacaccagaaaacggatacatgtggaacagggttagccctcagctaagttcccctaatcaaccctattcattgagggaagcactcgctcaagcgcaatcttcaagaattgggtcaaccgccagggcattgagagagtctctacatccagtactaagacaaaaattggaactttgggaagaaaatctcagtactgctgtgagcctggaagtgttaggaataaccgagaagttttcagtcgctgcaggcactcgaagcattactactgattatgctaagttagattgtgtaacatcaatcttgatgggtcttttgtctaggagccagcccttggccttttggaaagctttccttcctgtggtttataatatatttaatctccatggcgcaacacttatggcaagggagaatgatcgcttcttgaagcaaattgcttttcatcttttgcggcttgctgttttccgaaatgattcgattagaaaaagggctgttgttgggttgcagattcttgttaggaactcgttcaactatttcaagaacactacgaggctgagggtcatgttgacgattactttgtcagaattgatgtccgatgtgcaagtgactcagatgaaatctgatggttctcttgaagaaagtggcgaagcacgtcgccttaggaaatctctggaggaaatggctgatgttagaagcaaggatctattaaaagattgcggcctccctgttactgcattggaggctgctcctgaaggttccaatgataataggtggtcttgggtagaggtgaagcatctgtctaaatgtcttgtccaggcccttgatgctggtctggaacacgccctcttgggttctgtagtgaatgtggacaggtatgcggctgccgagggtttctataagctagctatggcttatgcgcctgttccagatcttcacattatgtggttgctacacctgtgtgatgcacaccaggagatgcaatcatgggctgaagcagcacaatgtgcagttgctgtagctggtgtgatcatgcaggcacttgttggaaggaatgatgctgtgtggagcaaggagcatgttgcttcactgcgtaagatttgccctatcgtgagcactgatgtgagcgcagaagtgtctgcagctgaagttgagggatatggtgcatccaaactaacagtggattcagctgtcaagtatcttcaacttgccaacaaactctttgcacaagctgagctctaccatttttgtgcaagcatccaggaactcatcattcctgtgtataagagtagaaggtcttacggacagctagccaaatgccatacatcactcacaaacatctatgagtcaattcttgagcaggaggccagtcctataccatttattgatgccacgtactaccgagttggtttttacggtgagcgttttggtaagctcaataaaaaggagtatgtgtttagggagccacgggatgtacgtcttggtgacattatggagaaacttagtcatacatatgaggctaaaatggacggcaatcacaccttacacatcattccagactcaagacaagtcaatgctgatgagttgcaacctggtgtctgctatttacagatcactgctgttgatcctgtgatggaggatgaggacttgggtagcaggagggaaaggattttttctttatctactggtactgtacgtgcacgtgtgtttgaccgttttctttttgacacaccattcacaaagaatggaaaaacacaaggtggcttagaagaccagtggaagagacgcacagtgcttcagacagagggttcatttcctgctttagtgaaccgcctgctagttaccaaatctgaatctctggagttctcgcctgttgagaatgcgattggaatgattgaaacaaggacagccgcattgagaaatgaactagaagaaccacggagctctgaaggtgatcaactaccaaggcttcaaagcttgcaaaggatactccaaggaagtgtggctgttcaggtcaacagtggagtattaagtgtgtgcacagcattcttatctggtgagcctgcgactaggctccgatcacaagaactgcagcagctcatcgctgcattgcttgaattcatggctgtctgcaagcgcgcaatccgtgtgcatttcagattgataggcgaagaagaccaggaattccacacccaactcgtcaatgggttccagtcactcaccgctgagctgtctcactatatccctgctatactctcggagctatgatagtactgtagcaagctggaagttaggtagcacgtgaatggttgttcattctttcagtcgtcggtccccaccaaatgtccatatttccgttagctttggttgtatagttaactagccttttgctctgcaccgttttgacgtacggagtcccgattttggagtgtaaagtatgtgtaatccttagtgttacgtgtatgtcaccgtggtgtttgttgcagtttgctcactgtactagcaacgaggacaattacgctagtcttctggagtgaaatatggtgcctggtgttttttttttatcttttgttttcttgtggaaattagcgtgcttcccaacaatttatctgtgcgcaatgtgttatttgagttgcctgtttgtataa

SEQ ID NO: 660 - DNA, 5971 bp, Triticum aestivum
ccgttctactagctgctgctcgtgctcgggttcggtggcagtggtggcgactggagggagtcatccttcgcgccgcgcctctcgtcggccgacgcctcccaccgcccggtacgtctgggccgcagcgccgagatcctgagctcagattcgtgagctccctccctctctccggtggcggccatggattccccggctgccggggaaggacagcggttcaagcggattccaaggcagccttgtggccggaacctggagctggatccactgcttaatgagaatttggaacagtggccacatctaagtgagctagtacagtgttataacgctgattttgtgaaagatgactgcaaatatggacgctatgagagtgtcgcgccaccgtcctttcagaatcaaatttttgagggacctgataccgacatagaaacagaattgcagctttgcaacgctaggcattccaagcctgaggaaactactgaggatgatatgccaagcacttcagggaggcaaatatatgaaactgaagcatctgcttcatcttcaaaaaaacattgtactctctcacctttaccggcatatgaacctgcatttgattgggacaatgagagatctttaatatttggccaacgcctgccagaaagtctccctgcaacacacagcagtggattgaagataacggtcaaggtattgtctttgtcattccaaactggattagtcgaaccttttagcggtacaatctgcttgtacaacagagataggagagaaaagctatcggaggacttctacttccacatacttccaacagaaatgcaagatgctcatatatctttggatcgtcggggtgttttctcattggacaccccttcaccatcaatctgccttctgatccagctagaaaaggctgctactgaagaagggggagtaactccttccatttattcccgtaaagaacctgtgcacttgactgagaaagagaagcagaagctgcaagtttggtctcgagtcatgccatacagagagccatttgcatgggcaatgattcctctgtttgaaaacaaccatgctggtggtgatgctgcctctcctagcagccctttagcaccaagtatgtcaggctcaagttctcaagatagcattgtggagcctatctccaaactcacttcagatggaaaactcaaccattattcaagtggaagttctgttattgttgagatatcaaacttaaacaaagtgaaggaaagctacatggaagactccctccaagatccaaaacgaaaagtacacaagccagtgaaaggtgtgctaaggctagaggtggaaaaacttcataatgaccgtaatgaggcggataccatttctgaaggtgggagcataaccaatgaattgcatgatgctggcgagctcaataatggcagacacagcaggaatagcattgatgggatccacagttctctgaattctagtgccattgtcaagaaagatacacaccagaatggtcaaagttccaatggagagaatggcaacaattttcaagcttttgactttcggatgatggcccggagtgaaccattttcacaacttttccattgcctctatgtgtacccattgactgttagcttgagccgcaaaagaaatctatttgtaagggtagaattgaggaaggatgattctgacatacgtaaacttccagtagaggctgtccatccaagggatcagaattcaacactacagaagtgtgcccatacccaaatttctgttggcacaagaatgtcttgctaccatgacgaagttaagatcagtctgcctgctctattgacgccccaacatcatcttctgttcacatttttccatgtagatctccaaatgaaacttgaagcccctaaaccagtgattgtgggatatgctgcacttccactgtcgacacacattcagttactttcggatgtgtctttgccaattttacgagagcttgttccgcattacctgcaggaaagtggaaaggaaaaaatggactacctggaggatggaaaaactgttttcaggctgcggttaagactttgctcttcgttgtttccagttaatgaaaggataagggactttttcgttgagtatgaccgtcacacactacatacaagtccaccttggggttctgagcttcttgaggcaataaatagtttaaagaatgttgaatctactgcattgttacaatttcttcaaccaatactcaatatgctgctacatcttattggcgatggtggtgaaacccttcaggttgctgcatttcgagccatggttaatattctaacccgggtgcaacaggaatcatctgatggagctgagagaaataagtttctcgttaattatgttgattttgcttttgacgacttcggtgatcggcagacacctgtataccctggtttgtctactgtttggggcagcctagctcgaagtaaggctaaaggttatagagttggacctgtctatgatgatgtgttggcaatggcttggttttttctggagcttattgtaaaatcaatgggattggaacaaagtcgtctcttctaccacaatcttccacttggtgaagatgtcccaccgctgcagttgaaagaaggagtcttcagatgcatcatgcagctatttgattgccttctaactgaggttcatgaacgctgtaaaaagggtttaaacttggcgaagcgcttgaacagcactcttgctttcttctgttacgatcttttatcaatcattgagccacgccaagtttttgagctggtttcactgtatatggacaagtttgcaggggtttgccagtcagtcctccatgattgcaaattgacattcctgcaaataatatgtgatcatgatctttttgttgagatgcctggtcgggatcccactgataggaattatctctcgtcggttcttattcaagagatctttctcacccttgaccatgatgatttgtcacagcgagcgaaagcggctcgtattttagttgttcttatatgcaagcatgaatttgacgcgcgatatcaaaaaagtgaagacaagctgtacattgctcagctgtattttcctcttataggacagattctggatgagatgcctgtgttctataacctaaatgccattgaaaaacgtgaagtgctagtggtcattttgcaaatcataaggaacttggacgacacaactcttataaaagcatggcaacagagcattgctagaaccagattgttcttcaagctacttgaagaatgtataacccattttgagcataacagaacaggagacagcttgctactaggttctagttctcggagccctgatgctgagcgccctgcgtcccccaagtattctgatcggttatccccatcagttaacgcatatttgtctgaggcttcgcgccatgaaataaggccccagggaacaccagaaaatgggtacatgtggaacaggattagtcctcagctaagttccccaaatcaaccctattcattgagggaagcacttgcgcaagcgcaatcttcaagaataggatcaacagccagggcattgagagagtccctacatccaatactgagacaaaagttggaactctgggaagaaaatcttagtactgctgtgagccttgaagtcttgggaataattgataagttttcagttgctgcagcttctcgaagcatctcgactgactatgctaagctagattgtgtaacatctatcttgatgggtcttttatctaggagccagcccttgactttttggaaagctttccttcctgtggtctataatatatttagtctccatggtgcaacactgatggcaagggagaatgaccgcttcttgaagcaaattgcttttcatcttttgcgacttgctgtattccgaaatgattctgttagaaaaagggccgttgttgggttgcagatccttgttaggaactcattcaactatttcaagagcaccacaaggctgagggtcatgttgactattactttgtcagaactgctatctgatgtgcaagtaactcagatgaaatccgatggatctcttgaagaaagtggtgaagctcggcgtcttaggaaatcactggaggaaatggctgatgtaaggagtaaggatcagttgaatgattgtggccttcctgttactgcactggaagtggctgctgaaggttccacagacaataggtggtcttgggtagaggttaagcatctatcaaagtgtctagtccaggcccttgatgctggccttgaacacgcccttttgggttctgtaatgagtgtggacaggtgtgcagctgctgagggtttctataagctagcattggcctatgcccctgttccggatcttcacattatgtggttactgcacctttgtgatgcacaccaggagatgcagtcatgggctgaggccgcgcagtgtgcagttgctgtagctggtgtgatcatgcaggcacttgttggaaggaacgatgctgtgtggagcaaggagcatgttgcctccctctgtaggatttgccctattgtgggcactgatataggtgcagaagtagctgcagcagaagttgaaggatatggtgcatccaagcttactgtggattcggccgtcaagtatcttcaacttgcgaacaaactcttcgcacaagctgaactttaccacttctctgccagtatccaggaacttatcattcctgtgtacaaaagcagaaggtcttatgggcagctggctaaatgtcacacgtcactcacaagcatatatgagtcaattcttgaacaggaggctagccctatcccgttcattgatgctacctactacagagttggattctatggggaacgatttggcaagctcaataaaagggagtatgtgtttagggagccgcgggatgttcgtctgggtgacattatggagaagcttagtcatacctatgaggctaagatggatgtgaatcacacgttacatatcattcctgactcgaggcaagtcaatgctgatgagctgcaacctggtgtatgctatctacaaataactgccgttgatcctgtaatggaggacgaggacttggagagcaggagggaaaggattttctctttatccactggttctgttcgtgcacgtgtgtttgaccgtttccttttcgacacaccattcacaaagaacggaaaaacgcaaggtggcctagaagatcaatggaagagacgcacagtgctccagacagagggttcctttcctgctctggtaaatcgtctggtggtgataaaatctgaatctctagagttttcacctgtggagaatgcgattggaatgattgaaacaaggacagctgcattgagaaatgaactagaagaaccacggagctctgaaggtgatcaactaccaagacttcaaagcctgcaaaggatactccaaggaagtgtggctgttcaggtcaacagtggtgtattaagtgtgtgcaccgctttcttatctggcgagcctgcaaccaggctccggtctcaagaactgcaacagctgatagctgcattgcttgaattcatggctgtctgcaagcgtgcaatccgtgtgcattttagattgataggggaagaagaccaggagttccacacgcaacttgtcaatgggtttcagtctcttactgctgagctttctcactatattcctgccatactttcggagctatgactgtagcaaggtggcaggcagttaggtagcatgtgaatggttggttgatttttcagttggggatctgctccaaatgttcatatttcgagtagctttggttgtatagtttgagaactaaccggggcctttgcatttctgctgtgtcacgattttggggtgtaaagtatatgcaacttcttagtgtgatgtacctggatcatcgtgtttgtttgtggtttgctggcagtgatagcaacttagctagtagctgttggagcggcattactattactattattatcat

SEQ ID NO: 661 - DNA, 6080 bp, Secale cereale
gactaaaccctcgggtgggggagagagaggagcagagcggagcaggagatggcgagcgcaagcaatgcgcaatgagtggcggcaccctcgccttcaccgcccctgcttttgccttctactagctgctgctcggtgcctcgggttggcgcagtgggtgggactgggaaggggattcattccttggcgccgcgcctctcgtcggcctcgtctccatcgcccggatctgggccgcagcgccgagatcctgagctcagattcgtgagctccctccctctctccggtgtcggccatggattccgcggcgcccggggaaggacagcggttcaagcggattccaaggcagccttgtggccggaacctggagctggatccactgcttaatgagaatttggaacagtggccacatctaaatgagctagtacagtgttataacgctgattttgtgaaagatgactgcaaatatggacgctatgagagtgtcgcgccaccgtcctttcagaatcaaatttttgagggacctgataccgacatagaaacagaattgcagctttgcaacgctaggcattccaagcctgaggaaactactgaggatgatatgccaagcacttcagggaggcaaatatatgaaactgaaccatctgcttcatcttcaaaaaaacattgtactctctcacctttaccggcatatgaacctgcatttgattgggacaatgagagatctttaatatttggccaacgcttgccagaaagtctccctgcaacacacagcagtggattgaagataactgtcaaggtattgtctttgtcattccaaactggattagtcgaaccttttagcggtacaatctgcttgtacaacagagataggagagaaaagctatcggaggacttctacttccacatacttccaacagaaatgcaagatgctcatatatctttggaccgtcggggtgttttctcattggacaccccttcaccatcaatctgccttctgatccagctagaaaaggctgctactgaagaagggggagtaactccttccatttattcccgtaaagaacctgtgcacttgactgagaaagagaagcagaagctacaagtttggtctcgagtcatgccatacagagagccatttgcatgggcaatgattcctctgtttgaaaacaaccatgctggtggtgatgctgcctctcctagcagccctttagcaccaagtatgtcaggctcaagttctcaagatagcattgtggagcctatttccaaactcacttcagatggaaaactcaaccattattcaagtggaagttccgttattgttgagatatcaaacttaaacaaagtgaaagaaagctacatggaagactccctccaagatccaaaacggaaagtacacaaaccagtgaaaggtgtgctaaggttagaggtggaaaaacttcataatgaccgtaatgaggcagataccatttctgaaggtgggagcataaccaatgaattgcatgatgctggcgagctcaataatggcagacacagcaggaatagcattgacgggatccacagttctctgaattctagttccattgtcaagaaagatacacaccagaatggtcaaaattccaatgcagagaatggcaacaattttcaagcttttgactttcggatgatggcccggagtgaaccattttcacaacttttccattgcctctatgtgtacccattgactgttagcttgagccgcaaaagaaatctgtttgtaagggtagaattgagaaaggatgattctgacatacgtaaacttccagtagaggctgtccatccaagggatcagaatgcaacactacagaagtgtgcccatacccaaatttctgttggcacaagaatgtcttgctaccatgatgaagttaagatcagtctgcctgctctattgacgccccaacatcatcttctgttcacatttttccatgtagatctccaaatgaaacttgaagcccctaaaccagtgattgtgggatatgctgctcttccactgtcgtcacacattcagttactttcggatgtatctttgccaattttacgagagcttgttccgcattacctgcaggaaagtggaaaggaaaaaatggactacctggaggatggaaaaactgttttcaggctgcggctaagactttgctcttcgttgtttccagttaatgaaaggataagggactttttcgttgagtatgaccgtcacacactacatacaagtccaccttggggttctgagcttcttgaggcaataaatagtttaaagaatgttgaatctactgcattgttacaatttcttcaaccaatactcaatatgctgctacatcttattggcgatggtggtgaaacccttcaggttgctgcatttcgagccatggttaatattttaacccgggtgcaacaggaatcatctgatggagctgagagaaataagtttctcgttaattatgttgattttgcttttgacgacttcggtgatcggcagacacctgtataccctggtttgtctactgtttggggcagcctagctcgaagtaaggctaaaggttatagagttggacctgtctatgatgatgtgttggcaatggcctggttttttctggagcttattgtaaaatcaatgggattggaacaaagtcgtctcttctaccacaatcttccacttggtgaagatgtcccacccctgcagttgaaagaaggagtcttcagatgcatcatgcagctatttgattgccttctaactgaggttcatgaacgctgtaaaaagggtttaaacttggcgaagcgcttgaacagcactcttgctttcttctgttacgatcttttatcaatcattgagccacgccaagtttttgagctggtttcactgtatatggacaagtttgcaggggtttgccagtcggtcctccatgattgcaaattgacattcctgcaaataatatgtgatcatgatctttttgttgagatgcctggtcgggatcccactgataggaattatctctcgtcggttcttattcaagagatctttctcacccttgaccatgatgatttgtcacagcgagcgaaggcggctcgtattttagttgttcttatatgcaagcatgaatttgacgcacgatatcaaaaaagtgaagacaaactgtacattgctcagctgtattttcctcttataggacagattctggatgagatgcctgtgttctataacctaaatgccattgaaaaacgtgaagtgctagtggtcattttgcaaatcataaggaacttggatgacacaactcttataaaagcatggcaacagagcattgctagaaccagattgttcttcaagctacttgaagaatgtataacccattttgagcataacagaacaggagacagcttgctactaggttctagttctcggagccctgatgctgagcgccctgcgtcccccaagtattctgatcggttatccccatcagttaatgcatatttgtctgaggcttcgcgacatgaaataaggccccagggaacaccagaaaatgggtacatgtggaacaggattagtcctcaactaagttccccaaatcaaccctattcattgagggaagcacttgcgcaagcgcaatcttcaagaataggatcaacagccagggcactgagagagtccctacatccaatattgagacaaaagttggaactctgggaagaaaatcttagtactgctgtgagccttgaagtcttgggaataattgagaagttttcagttgctgcagcttctcgaagcatctcaactgactatgctaagctcgattgtataacatctatcttgatgggtcttttatctaggagccagcccttgactttttggaaagctttccttcctgtggtctataatatatttagtctgcatggtgccacactgatggcaagggagaatgaccgcttcttaaagcaaattgcttttcatcttttgcgacttgctgtattccgaaatgattctgttagaaaaagggccgtagttgggttgcagatccttgttaggaactctttcaactatttcaagagcaccacaaggctgagggtcatgttgactattactttgtcagaactgctatctgatgtgcaagtaactcagatgaaatccgatggatctcttgaagaaagtggtgaagctcggcgtcttaggaaatcactggaggaaatggctgatgtaaggagtaaggatcagttgaatgattgtggccttcctgttacagcactggaagtgactgctgaaggttccacggacaataggtggtcttgggtagaggttaagcatctatcaaagtgtctagtccaggcccttgatgctggccttgaacacgcccttttgggttctgtaatgagtgtggataggtgtgcagctgctgagggcttctataagctagcattggcctatgcccctgttccggatcttcacattatgtggttactgcacctttgtgatgcgcaccaggagatgcagtcatgggctgaggccgcgcagtgtgcagttgctgtagctggtgtgatcatgcaggcacttgttggaaggaacgatgctgtgtggagcaaggagcatgttgcctccctctgtaggatttgccctattgtgggcactgatataggtgcagaagtagctgcagcagaagttgaaggatatggtgcatccaagcttactgtggattcggccgtcaagtatcttcaacttgcgaacaaactcttcgcacaagctgaactttaccacttctctgccagtatccaggaacttatcattcctgtgtacaaaagcagaaggtcttatgggcagctggctaagtgtcacacgtcactcacaaacatatatgagtcaattcttgaacaggaggctagccctatcccgttcattgatgctacctactacagagttggattctatggggaacgatttggcaagctcaataaaagggagtatgtgtttagggagccgcgggatgttcgtctgggtgacattatggagaagcttagtcatacctatgaggctaagatggatgtgaatcacacgttacatatcattcctgactcgaggcaagtcaatgctgatgagctgcaacctggtgtatgctatctacaaataactgccgttgatcctgtaatggaggacgaggacttggagagcaggagggaaaggatattctctttatccactggttctgttcgtgcgcgtgtgtttgaccgtttccttttcgacacaccattcacaaagaacggaaaaacgcaaggcggcctagaagatcaatggaagagacgcacagtgctgcagacagagggttcctttcctgctctggtaaatcgtctggtggtgataaaatctgaatctctagagttttcacctgttgagaatgcgattggaatgattgaaacaaggacagctgcattgagaaatgaactagaagaaccacggagctctgaaggtgatcaactaccaagacttcaaagcctgcaaaggatactccaaggaagtgtggctgttcaggtcaacagtggtgtattaagcgtgtgcactgctttcttatccggagagcctgcaaccaggctccggtctcaagaactgcaacagctgatagctgcattgcttgaattcatggctgtttgcaagcgtgcaatccgtgtgcattttagattgataggggaagaagaccaggagttccacacgcaacttgtcaatgggtttcagtctcttactgctgagctttctcactacattcctgccatactttcggagctatgactgtaacaaggtggcaggcagttaggtagcatgtgaatggttggttgatttttttcagttggggatctgctccaaatgttcatatttcgagtagcttttggttgtatagtttgagaactaaccggtcttcgcatttctgctgtgtcacgattttggggtgtaaagtatatatacttcttagtgtgatgtacctgtatcaccgtgttgcttgtggtttgctgacagtgatagcaacttagctagtaactgttggagcggcattattattaacattatcactatc

SEQ ID NO: 662 - DNA, 6302 bp, Brachypodium distachyon
actctctccctctccctttcttccgccattaatttcccctcgctctgtggatcttcttcctcctcgcgcgagcgccgccacctctctgcccatcccgctgccgagcgcccgagctcgccttcctcctcgcgcgagcgcctccacttcaggttgatctcccctttcgattctctcgctcccgaccgtttctcctcccatcaccccaccaacggattccgccctttagcttcccggtttcataatcttccccagttcgtaaccgaggcaaaaaaatcaaggtcctaccgggtcctccacccgtgggccgaggtccaatcaactgccgcggcagcatctggccggcttccactctagtgctttgcttggcacggtgcgggacatgagggaggaggccgaggcgaggccggttgggtgacattgctgtcggtcatcttcaccgccgcacaccctcactgcaagcatgtcggcagcggatctgctggtggcggacgcagcagcgagggaatggcagcggttcaagttgattccaagggtgtcgtgtgctgggaacctggacctggatccactgcttaatgaaaatttagagcaatggccacatctaaatgagttggtacagtgctataaggctgattttgttaaagatgactgcaaatacggtcgatatgagagtgtcgcaccaccgtcctttcgaagtcaaatttttgagggacctgatactgacatagaaacagaattgcagctttccaagcctgaggaaactactgaagatgatatgccaagcacctcagggaggcaaatatatgagactgaaccgtctgcttcatcttcaaacaaaccctgtagtctctcacctttaccggcatacgaacctgcatttgattggaacaacgagagatctttgatatttggccaacgggtgacagaaagtctccctgcaacacacatcagtggattgaagataactgtaaaggtgttatctttgtcattagaagctggattagtagaaccttttggcggtacaatttgcttgtacaacagagatagaagagaaaaactatctgaagacttctatttccgcatacttccaacagaaatgcaagatgctcatatttctttggaccgttggggtgttttttcgttggatgccccttcaccatcagtctgccttctgatccagcttgaaaaagctgctactgaagaagggggagtaactccttccgtttattcccgcaaagaacccgtgcacttgactgagaaagagaagcagaagctgcaaatttggtctcgaatcatgccatataaagagccatttgcatgggcaatgattcctttgtttgaaaacaaccatgctggtggtgtgggtgatgcagcctctcctagcagccctttagcacgaagtatttcaggctcaagttctcaagatagcatcatggagcctacttccaagctcgctttggacggaaaactcaaccattattcaagtggaagctcggttattgtagagatatcaaacttaaacaaagtgaaggaaagctacatagaggactccctccaagatccgaaacggaaagcacacaaaccagttaaaggtgtactgaggctagaggtggaaaaacttcataatgaccgtaatgatgcagataccatttctgaaggtgggagcatgaacaatgaattgcatggtgctgaactcaataatggcagacatcacaggaatagctttgatggggcccacagttatctgaattctagtgctgttgcccagaaaaatgcacaccagaatggtcaaaattccaatgcagagaatggtgacaattttcaagcttttgactttcggatgatgactcgaagcgaaccattttctcaacttttccattgcctgtatgtgtacccattgaccgtcagcttgagccgcaagagaaatctattcgtaagagtagaattgagaaaggatgatgctgacatccgtaaacttccactggaggctattcatccaacggattggagtacaacgctacagaagtttgtccatacccagatttctgttggcacgagaatgtcttgcttccatgatgaagtgaagatcagtctgcctgctctattgactccccaacatcatcttctgttcacattcttccatgtagatctccaaatgaaacttgaagcccctaaaccagtgattgtgggatatgctgcacttccactgtcgacgcacattcagttactttcagaggtatctttgccaattttacgagagcttgttccgcattacctgcaggaaagtggaaaggagagaatggaatacctggaggatggaaaagctgttttcaggctgcggttaagactttgctcttcgttgttgccagttaatgaaaggataagagacttttttgtcgagtatgaccgccacacactacatacaagtccaccttggggttctgagcttcttgaggccataaatagtttaaagaatgttgaatctactgcattgttacaatttcttcacccaatactcaacatgctgctgcgtcttattggtgatggtggtgaaacacttcaggttgctgcatttcgagccatggttaatattctaacccgggttcagcaggaatcatctgatggggctgagagaaataggtttcttgttaattatgttgattttgcttttgatgactttggtgatcggcagacacctgtataccctggtttatctactgtttggggtagcctagctcggagtaaggctaaaggttatagagttgggcctgtctatgatgatgtgttggcaatggcttggttttttctggagcttattgtaaaatcaatgggattggaacaaagtcgtctcttctaccacaatcttccactaggtgaagatgtcccgccgctacagttgaaagaaggtgtattcagatgtatcatgcagctgtttgattgccttttaactgaggttcatgaacgctgtaaaaagggtttaaatttggcaaagcgcttgaacagcactcttgctttcttttgttatgatcttttatcaatcatcgagccacgccaagtttttgagctggtttcgttgtatatggacaagtttgcaggggtttgtcaatcagttctccatgattgcaaattgacattcctgcagataatatgtgatcacgatctttttgttgagatgcctggccgagacccctctgataggaattatctctcgtctgttcttatccaggagatctttctcacccttgaccatgatgatttattacagcgagcaaaagcggctcgtattttggttgtcctgataagcaagcatgaatttgacgcacggtatcaaaaaagtgaagacaagctgtacattgctcagctgtatttccctcttataggacagattctagatgagatgcctgtgttctataatctaaatgctgttgaaaagcgtgaagttctagtggtcattttgcaaatcataaggaacttggatgacacaactcttataaaagcgtggcaacagagcattgctagaaccagactgttcttcaagctacttgaagaatgtataacccattttgagcacaatagaacaggagatagcttgctgctaggctctagttctcggagtcctgatgctgagcgccctgtgtcccccaagtattctgatcgattatccccatcagttaacgcatacttgtccgaggcttcacgccatgaaataaggcctcagggaacaccagaaaatggatacatgtggaacagggttagccctcaactaagttccccaaatcaaccctattcattgagggaagcacttgctcaagcacaatcttcaagaattggatcaacagccagggcattgagagagtctctacatccagtactgagacagaagttggaactctgggaagaaaatcttagtaccgctgtgagccttgaagtattgggaataattgagaagttttcggttgcggcagcttctcttagcatctctactgattacactaagctagattgtgtgacatctatcttaatgggtcttttgtctaggagccagcccttaactttttgggaagcttttcttcctgtggtctataatatattcagtcttcatggtgcaacactgatggcacgggagaatgaccgcttcttgaagcaaattgcttttcatcttttgcgacttgctgtattccgaaatgattctgttaggaaaagggccgttgttggattgcagatccttgttaggaactcattcaactatttcaagagcaccacaaggttgagggtcatgttgactattactttgtcagaattgctgtctgatgtgcaagtaactcaaatgaaatctgatggctctcttgaagaaagtggtgaagctcggcgtcttagaaaatcactagaggaaatggctgatgtcagaagtaaggatcagttgaacgactgtgggctccctgttaacgcactggaggtggctgctgaaggttccactgacaacaggtggtcttgggtagaagttaaacatctatcaaaatgtctagtccaggcccttgatgctggccttgaacatgcccttttgggttccgtaacaactctggacaggtgtgcagctgctgagggtttctataagctagcattggcctatgcacctgttcccgatcttcatattatgtggttactgcacctatgtgacgcccaccaggagatgcaatcatgggctgaagctgcacagtgtgcagttgctgtagctggtgtgatcatgcaggcacttgttggaaggaatgatgctgtgtggagcagggagcatgttgcttccctgtgtaggatctgtcctattgtcggcactgatgtgggtgcagaagtatctgcagcagaagttgagggatatggtgcatccaagcttactgtggattcagctgtgaagtatcttgaacttgccaacaagctcttcgcacaggctgaactataccatttttgtgctagcattcaggaactcattattcctgtgtacaagagcagaagggcttatgggcaactggctaagtgccatgcgtcactcacgaacatctatgagtcaattcttgaacaggaggctagccctattccattcattgatgccacatactacagagttggattttatggggatcgatttggcaagctcaataaaaaggagtatgtgtttagagagccacgggatgttcgtctgggtgacatcatggagaagcttagtcacacctatgaggctaagatggatggcaatcagaatttacacataattcctgactcgagacaagtcaatgccgatgagctgcaacctggtgtctgctatctgcagataactgctgttgatcctgtaatggaggacgaggacttggagagtaggagggaaaggattctctctttatctactggcactgtgcgtgcacgcgtgtttgaccgtttcctcttcgatacaccattcacaaagaatgggaaaacacaaggtggcctcgaatctcaatggaagagacgcacggtactccaaacagagggctcgtttcctgctttggtaaatcgcctgctagtgatcgaatctgaatctctagagttttcgcctgttgagaatgcaattgggatgattgaaacaaggacagctgcattgagaaatgaattagaagaaccacgtagttctgaaggtgatcaactaccaagacttcaaagcctgcaaaggatactccaaggaagtgtagctgttcaggtcaacagtggtgtattaagtgtttgcactgctttcttatctggagagcctgcaaccaggctccgatctcaagaactgcagcagctcatcgctgcattgcttgaattcatggcggtttgcaagcgcgctatccgtgtgcattttagattgataggggaagaagaccaggaattccacacgcaacttgtcaacgggtttcagtcccttactgctgagctttcccactatattcctgctatactttcggagctatgactgtagcaagctggcaattagataagcatgccaaaaattccattagctcgtgtatagtttgaaaactaaccgttctttgcaattgcgtcgtgttacaatgctgtgttcgattttggggtgtaaagtatgtgtaattcttggtgtgatgtatctgtagcagagtgttgtttgttgggagtgctagcaaattagcgattaaatctaagagcgggcgttcttattattagtagtagtatcaatattattattgctactgttatagtaatccttaatcctacgaggacctcaattggcgatggcggtcagtcaccttcaaaccattgag

SEQ ID NO: 663 - DNA, 6415 bp, Brachypodium distachyon
cgcatcgatagagaaagatatcgtctctttccctgaaagcatccccatctactctctccctctccctttcttccgccattaatttcccctcgctctgtggatcttcttcctcctcgcgcgagcgccgccacctctctgcccatcccgctgccgagcgcccgagctcgccttcctcctcgcgcgagcgcctccacttcaggttgatctcccctttcgattctctcgctcccgaccgtttctcctcccatcaccccaccaacggattccgccctttagcttcccggtttcataatcttccccagttcgtaaccgaggcaaaaaaatcaaggtcctaccgggtcctccacccgtgggccgaggtccaatcaactgccgcggcagcatctggccggcttccactctagtgctttgcttggcacggtgcgggacatgagggaggaggccgaggcgaggccggttgggtgacattgctgtcggtcatcttcaccgccgcacaccctcactgcaagcatgtcggcagcggatctgctggtggcggacgcagcagcgagggaatggcagcggttcaagttgattccaagggtgtcgtgtgctgggaacctggacctggatccactgcttaatgaaaatttagagcaatggccacatctaaatgagttggtacagtgctataaggctgattttgttaaagatgactgcaaatacggtcgatatgagagtgtcgcaccaccgtcctttcgaagtcaaatttttgagggacctgatactgacatagaaacagaattgcagctttccaagcctgaggaaactactgaagatgatatgccaagcacctcagggaggcaaatatatgagactgaaccgtctgcttcatcttcaaacaaaccctgtagtctctcacctttaccggcatacgaacctgcatttgattggaacaacgagagatctttgatatttggccaacgggtgacagaaagtctccctgcaacacacatcagtggattgaagataactgtaaaggtgttatctttgtcattagaagctggattagtagaaccttttggcggtacaatttgcttgtacaacagagatagaagagaaaaactatctgaagacttctatttccgcatacttccaacagaaatgcaagatgctcatatttctttggaccgttggggtgttttttcgttggatgccccttcaccatcagtctgccttctgatccagcttgaaaaagctgctactgaagaagggggagtaactccttccgtttattcccgcaaagaacccgtgcacttgactgagaaagagaagcagaagctgcaaatttggtctcgaatcatgccatataaagagccatttgcatgggcaatgattcctttgtttgaaaacaaccatgctggtggtgtgggtgatgcagcctctcctagcagccctttagcacgaagtatttcaggctcaagttctcaagatagcatcatggagcctacttccaagctcgctttggacggaaaactcaaccattattcaagtggaagctcggttattgtagagatatcaaacttaaacaaagtgaaggaaagctacatagaggactccctccaagatccgaaacggaaagcacacaaaccagttaaaggtgtactgaggctagaggtggaaaaacttcataatgaccgtaatgatgcagataccatttctgaaggtgggagcatgaacaatgaattgcatggtgctgaactcaataatggcagacatcacaggaatagctttgatggggcccacagttatctgaattctagtgctgttgcccagaaaaatgcacaccagaatggtcaaaattccaatgcagagaatggtgacaattttcaagcttttgactttcggatgatgactcgaagcgaaccattttctcaacttttccattgcctgtatgtgtacccattgaccgtcagcttgagccgcaagagaaatctattcgtaagagtagaattgagaaaggatgatgctgacatccgtaaacttccactggaggctattcatccaacggattggagtacaacgctacagaagtttgtccatacccagatttctgttggcacgagaatgtcttgcttccatgatgaagtgaagatcagtctgcctgctctattgactccccaacatcatcttctgttcacattcttccatgtagatctccaaatgaaacttgaagcccctaaaccagtgattgtgggatatgctgcacttccactgtcgacgcacattcagttactttcagaggtatctttgccaattttacgagagcttgttccgcattacctgcaggaaagtggaaaggagagaatggaatacctggaggatggaaaagctgttttcaggctgcggttaagactttgctcttcgttgttgccagttaatgaaaggataagagacttttttgtcgagtatgaccgccacacactacatacaagtccaccttggggttctgagcttcttgaggccataaatagtttaaagaatgttgaatctactgcattgttacaatttcttcacccaatactcaacatgctgctgcgtcttattggtgatggtggtgaaacacttcaggttgctgcatttcgagccatggttaatattctaacccgggttcagcaggaatcatctgatggggctgagagaaataggtttcttgttaattatgttgattttgcttttgatgactttggtgatcggcagacacctgtataccctggtttatctactgtttggggtagcctagctcggagtaaggctaaaggttatagagttgggcctgtctatgatgatgtgttggcaatggcttggttttttctggagcttattgtaaaatcaatgggattggaacaaagtcgtctcttctaccacaatcttccactaggtgaagatgtcccgccgctacagttgaaagaaggtgtattcagatgtatcatgcagctgtttgattgccttttaactgaggttcatgaacgctgtaaaaagggtttaaatttggcaaagcgcttgaacagcactcttgctttcttttgttatgatcttttatcaatcatcgagccacgccaagtttttgagctggtttcgttgtatatggacaagtttgcaggggtttgtcaatcagttctccatgattgcaaattgacattcctgcagataatatgtgatcacgatctttttgttgagatgcctggccgagacccctctgataggaattatctctcgtctgttcttatccaggagatctttctcacccttgaccatgatgatttattacagcgagcaaaagcggctcgtattttggttgtcctgataagcaagcatgaatttgacgcacggtatcaaaaaagtgaagacaagctgtacattgctcagctgtatttccctcttataggacagattctagatgagatgcctgtgttctataatctaaatgctgttgaaaagcgtgaagttctagtggtcattttgcaaatcataaggaacttggatgacacaactcttataaaagcgtggcaacagagcattgctagaaccagactgttcttcaagctacttgaagaatgtataacccattttgagcacaatagaacaggagatagcttgctgctaggctctagttctcggagtcctgatgctgagcgccctgtgtcccccaagtattctgatcgattatccccatcagttaacgcatacttgtccgaggcttcacgccatgaaataaggcctcagggaacaccagaaaatggatacatgtggaacagggttagccctcaactaagttccccaaatcaaccctattcattgagggaagcacttgctcaagcacaatcttcaagaattggatcaacagccagggcattgagagagtctctacatccagtactgagacagaagttggaactctgggaagaaaatcttagtaccgctgtgagccttgaagtattgggaataattgagaagttttcggttgcggcagcttctcttagcatctctactgattacactaagctagattgtgtgacatctatcttaatgggtcttttgtctaggagccagcccttaactttttgggaagcttttcttcctgtggtctataatatattcagtcttcatggtgcaacactgatggcacgggagaatgaccgcttcttgaagcaaattgcttttcatcttttgcgacttgctgtattccgaaatgattctgttaggaaaagggccgttgttggattgcagatccttgttaggaactcattcaactatttcaagagcaccacaaggttgagggtcatgttgactattactttgtcagaattgctgtctgatgtgcaagtaactcaaatgaaatctgatggctctcttgaagaaagtggtgaagctcggcgtcttagaaaatcactagaggaaatggctgatgtcagaagtaaggatcagttgaacgactgtgggctccctgttaacgcactggaggtggctgctgaaggttccactgacaacaggtggtcttgggtagaagttaaacatctatcaaaatgtctagtccaggcccttgatgctggccttgaacatgcccttttgggttccgtaacaactctggacaggtgtgcagctgctgagggtttctataagctagcattggcctatgcacctgttcccgatcttcatattatgtggttactgcacctatgtgacgcccaccaggagatgcaatcatgggctgaagctgcacagtgtgcagttgctgtagctggtgtgatcatgcaggcacttgttggaaggaatgatgctgtgtggagcagggagcatgttgcttccctgtgtaggatctgtcctattgtcggcactgatgtgggtgcagaagtatctgcagcagaagttgagggatatggtgcatccaagcttactgtggattcagctgtgaagtatcttgaacttgccaacaagctcttcgcacaggctgaactataccatttttgtgctagcattcaggaactcattattcctgtgtacaagagcagaagggcttatgggcaactggctaagtgccatgcgtcactcacgaacatctatgagtcaattcttgaacaggaggctagccctattccattcattgatgccacatactacagagttggattttatggggatcgatttggcaagctcaataaaaaggagtatgtgtttagagagccacgggatgttcgtctgggtgacatcatggagaagcttagtcacacctatgaggctaagatggatggcaatcagaatttacacataattcctgactcgagacaagtcaatgccgatgagctgcaacctggtgtctgctatctgcagataactgctgttgatcctgtaatggaggacgaggacttggagagtaggagggaaaggattctctctttatctactggcactgtgcgtgcacgcgtgtttgaccgtttcctcttcgatacaccattcacaaagaatgggaaaacacaaggtggcctcgaatctcaatggaagagacgcacggtactccaaacagagggctcgtttcctgctttggtaaatcgcctgctagtgatcgaatctgaatctctagagttttcgcctgttgagaatgcaattgggatgattgaaacaaggacagctgcattgagaaatgaattagaagaaccacgtagttctgaaggtgatcaactaccaagacttcaaagcctgcaaaggatactccaaggaagtgtagctgttcaggtcaacagtggtgtattaagtgtttgcactgctttcttatctggagagcctgcaaccaggctccgatctcaagaactgcagcagctcatcgctgcattgcttgaattcatggcggtttgcaagcgcgctatccgtgtgcattttagattgataggggaagaagaccaggaattccacacgcaacttgtcaacgggtttcagtcccttactgctgagctttcccactatattcctgctatactttcggagctatgactgtagcaagctggcaattagataagcatgccaaaaattccattagctcgtgtatagtttgaaaactaaccgttctttgcaattgcgtcgtgttacaatgctgtgttcgattttggggtgtaaagtatgtgtaattcttggtgtgatgtatctgtagcagagtgttgtttgttgggagtgctagcaaattagcgattaaatctaagagcgggcgttcttattattagtagtagtatcaatattattattgctactgttatagtaatccttaatcctacgaggacctcaattggcgatggcggtcagtcaccttcaaaccattgagattgcgataaatgacagtacaacattttctttaaatatgtattccttcggatcctaaattctt

SEQ ID NO: 664 - DNA, 6357 bp, Brachypodium distachyon
ggggacacagatcagcaaaacacgagcacaccgagcaaaaaatactgtcatcagagagagaaatcatcagtaaggcgccagagacagagaggcgcacgatggtttttgcggggtttcgaagggatcacggaatcagtgggtagggagggagagtggagtggagtgcagggcaggtgcagtggagtggagtggagcggcgctgggctgcgtagaaagacgacgacggcaagcgagctgttgctgctggggacaagctggctgccgccgattgctgccacgaaccacgagcaccagggcaactacccttggaatccctccctctgccccatctcgttgccgagcgaccctagccccctcgctccgagcgccgagccccctggctcgtcttcctcctcgcccgagcgcctccaccgcaggttgatctccccttcgattctctcgctcccgaccgtttctcctcccatcacagcacggtgcgggacaggagggaggaggccgaggcgaggccggtggggtgacattgctgtcggtcatctccaccgccgcacaccctcactgcaagcatgtcggcagcggatctggtggtggcggacgcaacagcgagggaatggcagcggttcaagttgattccaagggtgtcgtgtgctgggaacctggacctggatccactgcttaatgaaaatttagagcaatggccacatctaaatgagttggtacagtgctataaggctgattttgttaaagatgactgcaaatacggacgatatgatagtgtcgcaccaccgtcctttagaagtcaaatttttgagggacctgataccgacatagaaacagaattgcagctttgcaacgctaggcattccaagcccgaggaaactactgaagatgatatgccaagcacctcagggaggcaaatatatgagactgaaccgtgtgcttcatcttcaaacaaaccctgtagtctctcacctttaccggcatacgaacctgcatttgattggaacaacgagagatctttgatatttggccaacgggtgacagaaagtctccctgcaacacacatcagtggattgaagataactgtgaaggtgttatctttgtcattagaagctggattggtagaaccttttggcggtacaatctgcttgtacaacagagatagaagagaaaaactatctgaagacttctgtttccgcatacttccaacagaaatgcaagatgctcatatttctttggaccgttggagtgttttttcgttggatgccccttcaccatcagtctgccttctgatccagcttgaaaaagctgctactgaagaagggggagtaactccttccgtttattcccgcaaagaacccgtgcacttgactgagaaagagaagcagaagctgcaaatttggtctcgaatcattccatataaagagccatttgcatgggcaatgattcctctgtttgaaaacaaccatgctggtggtgtgggtgatgctgtgtctcctagcagccctttagcaccaagtatttcaggctcaagttctcaagatagcatcgtggagcctacttccaagctcgctttggagggaaaactcaaccattattcaagtggaagctcggttattgtagatatatcaaacttaaacaaagtgaaggaaagctacatagaggactccctccaggatccgaaacggaaagtacacaaaccagttaaaggtgtactgaggctagaggtggaaaaacttcataatgaccgtaatgatacagataccatttctgaaggcgggagcatgaacaatgagttgcatggtgctgaactcaacaatggcagacatcacaggaatagctttgatggggcccacagttatctgaattctagtgctgttgtccagaaaaatgcacgccagaatggtcaaaattccaatgcagagaatggtgacaattttcaagcttttgactttcggatgatgactcgaagcgaaccattttctcaacttttccattgcctctatgtgtacccattgaccgtcagcttgagccgcaagagaaatctattcgtaagagtagaattgagaaaggatgatgctgacatccgtaaacttccactggaggctattcatccaagggattggagtacaacgctacagaagtttgtccatacgcagatttctgttggcacgagaatgtcttgcttccatgatgaagtgaagatcagtctgcctgctctattgactccccaacatcatcttctgttcacattcttccatgtagatctccaaatgaaacttgaagcccctaaaccagtgattgtgggatatgccgcacttccactgtcgacacacattcagttactttcagatgtatctttgccaattttacgagagcttgttccgcattacctgcaggaaagtggaaaggagagaatggaatacctagaggatggaaaagctgttttcagactgcggttaagactttgctcttcgttgtttccagttaatgaaaggataagagacttttttgtcgagtatgaccgccacacactacatacaagtccaccttggggctctgagcttcttgaggccataaatagtttgaagaatgttgaatctactgcattgttacaatttcttcacccaatactcaacatgctgctgcgtcttattggtgatggtggtgaaacacttcaggttgctgcatttcgagccatggttaatattctaacccgggttcaacaggaatcatctgatggggctgagagaaataggtttcttgttaattatgttgattttgcttttgatgactttggtgatcggcaaacacctgtataccctggtttatctactgtttggggtagcctagctcggagtaaggctaaaggttatagagttgggcccgtctatgatgatgtgttggcaatggcttggttttttctggagcttattgtaaaatcaatgggattggagcaaagtcatctcttctaccacaatcttccacaaggtgaagatgtcccaccgctacagttgaaagaaggtgtattcagatgtatcatgcagctgtttgattgccttttaactgaggttcatgaacgctgtaaaaagggtttaaatttggcaaagcgcttgaacagcactcttgctttcttttgttatgatcttttatcaatcatcgagccacgccaagtttttgagctggtgtcgttgtatatggacaagtttgcaggggtttgtcaatcagttctccatgattgcaaattgacattcctgcagataatatgtgatcacgatctttttgttgagatgcctggccgggacccctctgataggaattatctctcgtctgtccttatccaggagatctttctcacccttgaccatgatgatttattacagcgagcaaaagcggctcgtattttggttgtcctgataagcaagcatgaatttgacacacggtatcaaaaaagtgaagacaggctgtacattgctcagctgtatttccctcttataggacagattctagatgagatgcctgtgttctataatctaaatgctgttgaaaagcgtgaagttctagtgctcattttgcaaatcataaggaacttggatgacacaactcttctaaaagcgtggcaacagagcattgctagaaccagactgttcttcaagctacttgaagaatgtataacccattttgagcacagtagagcaggagatagtttgctgctaggctctagttctcggagtcctgatgctgagcgccctgtgtcccccaagtattctgatcgattatccccatcggttaacgcatacttgtccgatgcttcacgccatgaaataaggcttcagggaacaccagaaaatggatacatgtggaacagggttattcctcaactaagttccccaaatcaaccctattcattgagggaagcacttgctcaagcacaatcttcaagaattggatcaacagccagggcattgagagagtctctacatccagtactgagacagaagttggaactctgggaagaaaatcttagtaccgctgtgagccttgaagtattgggaataattgagaagttttcggttgctgcagcttctcgtagcatctctactgattacactaagctagattgtgtgacatctatcttaatgggtcttttgtctaggagccagcccttaactttttgggaagcttttcttcctgtggtctataatatattcagtcttcatggtgcaacactgatggcacgggagaatgaccgcttcttgaagcaaattgcttttcatcttttacgacttgctgtattccgaaatgattctgttagaaaaagggccgttgttggattgcagatccttgttaggaactcattcaactatttcaagagcaccacaaggttgagggtcatgttgactattactttgtcagaattgctgtctgatgtgcaagtaactcagatgaaatctgatggttctcttgaagaaagtggtgaagctcggcgtcttagaaaatcactagaggaaatggctgatgtcagaagtaaggatcagttgaacgaatgtgggctccctgttaatgcactggaggtgtctgctgaaggttccacggacaacaggtggtcttgggtagaagttaaacatctatcaaaatgtctagtccaggcccttgatgctggccttgaacatgcccttttgggttctgtaacaactctggacaggtgtgcagctgctgagggtttctataagctagcattggcctatgcacctgttcccgatcttcatattatgtggttactgcacctatgtgacgcccaccaggagatgcaatcatgggctgaagctgcgcaatgtgcagttgctgtagctggtgtgatcatgcaggcacttgttggaaggaatgatgctgtgtggagcagggagcatgttgcttccctgtgtaggatctgtcctattgtcggcactgatgtgggtgcagaagtatctgcagcagaagtggagggatatggtgcatccaagcttactgtggattcagctgtgaagtatcttcaacttgccaacaagctcttcgcacaggctgaactataccatttttgtgctagcattcaggaactcataattcctgtgtacaagagcagaagggcttatgggcaactggctaagtgccataagtcgctcacgaacatctatgagtcaattcttgagcaggaggctagccctattccattcattgatgccacatactacagagttggattttatggggatcgatttggcaagctcaataaaaaggagtatgtgtttagagagccacgggatgttcgtctgggtgacatcatggagaagcttagtcacacctatgaggctaagatggatggcaatcagaatttacacataattcctgactcgagacaagtcaatgccgatgagctgcaacctggtgtctgctatctgcagataactgctgttgatcctgtaatggaggacgaggacttggagagtaggagggaaaggattttctctttatctactggcactgtgcgtgcacgcgtgtttgaccgtttccttttcgatacaccattcacaaagaatgggaaaacacaaggtggtctcgaatctcaatggaagagacgcacggtactccaaacagagggctcatttcctgctttggtaaatcgcctgctagtgatcaaatctgaatctctagaattttcgcctgttgagaatgcaattgggatgattgaaacaaggacagctgcattgagaaatgaactagaagaaccacgtagttctgaaggtgatcaactaccaagacttcaaagcctgcaaaggatactccaaggaagtgtagctgttcaggtcaacagtggtgtattaagtgtttgcactgctttcttatctggagagcctgcaaccaggctcagatctcaagaactacagcagctcatcgctgcactgcttgaattcatggctgtttgcaagcgcgcgatccgtgtgcattttagattgataggggaagaagaccaggaattccacacgcaacttgtcaacgggtttcagtcgcttactgctgagctttcccactatattcctgctatactttcggagctatgactgtagcaagctggcaattagatagcatgcgattggttggttgttgtttcagttttggctcgtgtatagtttgaaaactaaccgttctttgcaattgcgtcgttgcttacaataccgtattcgattttggggtgtaaagtatgtgtaattcttggtgttgtttgttgggagtgctagcaaattagcgattaaatctaagagcgggcgttcttattattagtactccctccgtctcatattaagtgactttctattgcatgta

SEQ ID NO: 665 - DNA, 6294 bp, Brachypodium distachyon
cgatggtttttgcggggtttcgaagggatcacggaatcagtgggtagggagggagagtggagtggagtgcagggcaggtgcagtggagtggagtggagcggcgctgggctgcgtagaaagacgacgacggcaagcgagctgttgctgctggggacaagctggctgccgccgattgctgccacgaaccacgagcaccagggcaactacccttggaatccctccctctgccccatctcgttgccgagcgaccctagccccctcgctccgagcgccgagccccctggctcgtcttcctcctcgcccgagcgcctccaccgcaggttgatctccccttcgattctctcgctcccgaccgtttctcctcccatcacagcacggtgcgggacaggagggaggaggccgaggcgaggccggtggggtgacattgctgtcggtcatctccaccgccgcacaccctcactgcaagcatgtcggcagcggatctggtggtggcggacgcaacagcgagggaatggcagcggttcaagttgattccaagggtgtcgtgtgctgggaacctggacctggatccactgcttaatgaaaatttagagcaatggccacatctaaatgagttggtacagtgctataaggctgattttgttaaagatgactgcaaatacggacgatatgatagtgtcgcaccaccgtcctttagaagtcaaatttttgagggacctgataccgacatagaaacagaattgcagctttgcaacgctaggcattccaagcccgaggaaactactgaagatgatatgccaagcacctcagggaggcaaatatatgagactgaaccgtgtgcttcatcttcaaacaaaccctgtagtctctcacctttaccggcatacgaacctgcatttgattggaacaacgagagatctttgatatttggccaacgggtgacagaaagtctccctgcaacacacatcagtggattgaagataactgtgaaggtgttatctttgtcattagaagctggattggtagaaccttttggcggtacaatctgcttgtacaacagagatagaagagaaaaactatctgaagacttctgtttccgcatacttccaacagaaatgcaagatgctcatatttctttggaccgttggagtgttttttcgttggatgccccttcaccatcagtctgccttctgatccagcttgaaaaagctgctactgaagaagggggagtaactccttccgtttattcccgcaaagaacccgtgcacttgactgagaaagagaagcagaagctgcaaatttggtctcgaatcattccatataaagagccatttgcatgggcaatgattcctctgtttgaaaacaaccatgctggtggtgtgggtgatgctgtgtctcctagcagccctttagcaccaagtatttcaggctcaagttctcaagatagcatcgtggagcctacttccaagctcgctttggagggaaaactcaaccattattcaagtggaagctcggttattgtagatatatcaaacttaaacaaagtgaaggaaagctacatagaggactccctccaggatccgaaacggaaagtacacaaaccagttaaaggtgtactgaggctagaggtggaaaaacttcataatgaccgtaatgatacagataccatttctgaaggcgggagcatgaacaatgagttgcatggtgctgaactcaacaatggcagacatcacaggaatagctttgatggggcccacagttatctgaattctagtgctgttgtccagaaaaatgcacgccagaatggtcaaaattccaatgcagagaatggtgacaattttcaagcttttgactttcggatgatgactcgaagcgaaccattttctcaacttttccattgcctctatgtgtacccattgaccgtcagcttgagccgcaagagaaatctattcgtaagagtagaattgagaaaggatgatgctgacatccgtaaacttccactggaggctattcatccaagggattggagtacaacgctacagaagtttgtccatacgcagatttctgttggcacgagaatgtcttgcttccatgatgaagtgaagatcagtctgcctgctctattgactccccaacatcatcttctgttcacattcttccatgtagatctccaaatgaaacttgaagcccctaaaccagtgattgtgggatatgccgcacttccactgtcgacacacattcagttactttcagatgtatctttgccaattttacgagagcttgttccgcattacctgcaggaaagtggaaaggagagaatggaatacctagaggatggaaaagctgttttcagactgcggttaagactttgctcttcgttgtttccagttaatgaaaggataagagacttttttgtcgagtatgaccgccacacactacatacaagtccaccttggggctctgagcttcttgaggccataaatagtttgaagaatgttgaatctactgcattgttacaatttcttcacccaatactcaacatgctgctgcgtcttattggtgatggtggtgaaacacttcaggttgctgcatttcgagccatggttaatattctaacccgggttcaacaggaatcatctgatggggctgagagaaataggtttcttgttaattatgttgattttgcttttgatgactttggtgatcggcaaacacctgtataccctggtttatctactgtttggggtagcctagctcggagtaaggctaaaggttatagagttgggcccgtctatgatgatgtgttggcaatggcttggttttttctggagcttattgtaaaatcaatgggattggagcaaagtcatctcttctaccacaatcttccacaaggtgaagatgtcccaccgctacagttgaaagaaggtgtattcagatgtatcatgcagctgtttgattgccttttaactgaggttcatgaacgctgtaaaaagggtttaaatttggcaaagcgcttgaacagcactcttgctttcttttgttatgatcttttatcaatcatcgagccacgccaagtttttgagctggtgtcgttgtatatggacaagtttgcaggggtttgtcaatcagttctccatgattgcaaattgacattcctgcagataatatgtgatcacgatctttttgttgagatgcctggccgggacccctctgataggaattatctctcgtctgtccttatccaggagatctttctcacccttgaccatgatgatttattacagcgagcaaaagcggctcgtattttggttgtcctgataagcaagcatgaatttgacacacggtatcaaaaaagtgaagacaggctgtacattgctcagctgtatttccctcttataggacagattctagatgagatgcctgtgttctataatctaaatgctgttgaaaagcgtgaagttctagtgctcattttgcaaatcataaggaacttggatgacacaactcttctaaaagcgtggcaacagagcattgctagaaccagactgttcttcaagctacttgaagaatgtataacccattttgagcacagtagagcaggagatagtttgctgctaggctctagttctcggagtcctgatgctgagcgccctgtgtcccccaagtattctgatcgattatccccatcggttaacgcatacttgtccgatgcttcacgccatgaaataaggcttcagggaacaccagaaaatggatacatgtggaacagggttattcctcaactaagttccccaaatcaaccctattcattgagggaagcacttgctcaagcacaatcttcaagaattggatcaacagccagggcattgagagagtctctacatccagtactgagacagaagttggaactctgggaagaaaatcttagtaccgctgtgagccttgaagtattgggaataattgagaagttttcggttgctgcagcttctcgtagcatctctactgattacactaagctagattgtgtgacatctatcttaatgggtcttttgtctaggagccagcccttaactttttgggaagcttttcttcctgtggtctataatatattcagtcttcatggtgcaacactgatggcacgggagaatgaccgcttcttgaagcaaattgcttttcatcttttacgacttgctgtattccgaaatgattctgttagaaaaagggccgttgttggattgcagatccttgttaggaactcattcaactatttcaagagcaccacaaggttgagggtcatgttgactattactttgtcagaattgctgtctgatgtgcaagtaactcagatgaaatctgatggttctcttgaagaaagtggtgaagctcggcgtcttagaaaatcactagaggaaatggctgatgtcagaagtaaggatcagttgaacgaatgtgggctccctgttaatgcactggaggtgtctgctgaaggttccacggacaacaggtggtcttgggtagaagttaaacatctatcaaaatgtctagtccaggcccttgatgctggccttgaacatgcccttttgggttctgtaacaactctggacaggtgtgcagctgctgagggtttctataagctagcattggcctatgcacctgttcccgatcttcatattatgtggttactgcacctatgtgacgcccaccaggagatgcaatcatgggctgaagctgcgcaatgtgcagttgctgtagctggtgtgatcatgcaggcacttgttggaaggaatgatgctgtgtggagcagggagcatgttgcttccctgtgtaggatctgtcctattgtcggcactgatgtgggtgcagaagtatctgcagcagaagtggagggatatggtgcatccaagcttactgtggattcagctgtgaagtatcttcaacttgccaacaagctcttcgcacaggctgaactataccatttttgtgctagcattcaggaactcataattcctgtgtacaagagcagaagggcttatgggcaactggctaagtgccataagtcgctcacgaacatctatgagtcaattcttgagcaggaggctagccctattccattcattgatgccacatactacagagttggattttatggggatcgatttggcaagctcaataaaaaggagtatgtgtttagagagccacgggatgttcgtctgggtgacatcatggagaagcttagtcacacctatgaggctaagatggatggcaatcagaatttacacataattcctgactcgagacaagtcaatgccgatgagctgcaacctggtgtctgctatctgcagataactgctgttgatcctgtaatggaggacgaggacttggagagtaggagggaaaggattttctctttatctactggcactgtgcgtgcacgcgtgtttgaccgtttccttttcgatacaccattcacaaagaatgggaaaacacaaggtggtctcgaatctcaatggaagagacgcacggtactccaaacagagggctcatttcctgctttggtaaatcgcctgctagtgatcaaatctgaatctctagaattttcgcctgttgagaatgcaattgggatgattgaaacaaggacagctgcattgagaaatgaactagaagaaccacgtagttctgaaggtgatcaactaccaagacttcaaagcctgcaaaggatactccaaggaagtgtagctgttcaggtcaacagtggtgtattaagtgtttgcactgctttcttatctggagagcctgcaaccaggctcagatctcaagaactacagcagctcatcgctgcactgcttgaattcatggctgtttgcaagcgcgcgatccgtgtgcattttagattgataggggaagaagaccaggaattccacacgcaacttgtcaacgggtttcagtcgcttactgctgagctttcccactatattcctgctatactttcggagctatgactgtagcaagctggcaattagatagcatgcgattggttggttgttgtttcagttttggctcgtgtatagtttgaaaactaaccgttctttgcaattgcgtcgttgcttacaataccgtattcgattttggggtgtaaagtatgtgtaattcttggtgttgtttgttgggagtgctagcaaattagcgattaaatctaagagcgggcgttcttattattagtactccctccgtctcatattaagtgactttctattgcatgtatttgacgctttttagccatagatacatccaaat

SEQ ID NO: 666 - DNA, 3838 bp, Sorghum bicolor
caaaaaacaaataggtatagcaaactcacgttctgcataggtcaacatcaaattgaatttttcataggaaaaaaaaaacaccttttccaaacatactcgaaggaaccggagtaccggaccgtctaaacatgggccaggccgaaacgtccggcaggggtggagctgggcttgtagcagacacgtggcagggctccaccagccaccgttccctcaatcgacggcggcggcgctggccgtcccgcgggaagccaaaatcacgaaacgaaaaattcttgaaaccgccggccgcgggaaacattttgcgcgccgcgccgcgcccccccttccccttcctcctcgcgcgcgcgcccacctccttttacaaatactcccttcccggttcggctcctactctcctccaaatctccagtcttctccagttcccaccccgcgccccaaatccagatccacccaccgcccaccaccccgccgccaacgcggacgccgcctcctccggctgcactcgtcgcgccatcctcaggtgcttggactccgcgaatctgtaggatcagtagagtagaccggtgtctgagcacggattggatagaggaatgcgctgtttgttcctagagtagcagctacaagatccgaaccctcccgtgatggaaagcggcgccatggttcccggcgttgctctccctgaagaggcccctgaccgcaacggcgccgggccacgggacgatttgggccaatcacagatgcaggtcgatggtcccgttgttctcaaccaatccgctgagctcgggtcgggtgattcgatggccgtcgatgacgccccggttcaagcacaatcaggccagccggtggcggcaacacagcagtctcctacgctggcggacaccattatggaggtgcagaagcagctgaagcggaagagggcttctaatagcccagtgattgcttccgcggataaggacgctctcgttgctagatgccggcaggagctcgagggcctcttccagttttacaaggaggtttgtgaccgcaagatgcagcttgacggcgggaacctgtccgtcaacgggatggttggctgcttgcttgaggagagcagtcttgggctgaccaagttggtggacgagatatatgaaaagttgaggggattggagggtgtctctgtggcttcagtccgtagctctgtgctgctcgctgggcagaggatgatgtacgggaaatcttcccctgacgctgatgtgttagaagatgaatcagagtcggctctttggtgctgggagataagagacctgagattgttgcctgtcaaagcacgcagcattctgagtacacggaggtctgtcagaaagaaaatccatgagagaatcactgctatctattcaactttgtcggttcttgaaaactcaggagcttacgtccaagtaaatgatctaaagaaagcatcattaaaattaaacaaatccctgaacctggaagggatcagatcaatggtggaaaaagtgacacaaaagaacactgaacggggtgtgaaagatgctggctcagctgttaaggaattgacgcaagaaccagagaaaaatgaccaaaatgttagaagacttgaggatactagtgtctctgaactgcaaaatggaaacttgcctgctaatgaaaaagagattcagaaagcacaaaaacaggtggagaaggaaataaagcgccaggagaaagaagaagctcagatgagaaaactgcaaaagaaacagcaagaagaggccctaagagaacagaagagacgtgaaaaggaggaggctgaagctaagaaacaacaaaagaagcaggaggaggaagcactgaaagaacagaagcgtcgtgaaaaggaagaagctgaaatgaagaaacaacagaaaaaacagcaagaggaagctgagaaagaacagaagcgccttgagaaggaagctgcacaactcaagaagcaactagccattcaaaagcaagcttctatgatggaacgttttttcaaaagtaagaaagacagtggaaaacttcaaaagcctggagagaataactcagctgatgatccatgcaatgagaacaaagagacagtaccagcaaccacatcaaaaattgattcttcattgtctcaacaagagagctgggttttagaggatcttcggaggttgcaggtcactggttggaagaagctatctagctacaataggtcctccagatggggtataagatgcaagcccaagatggaggcatttaaagagctgaagcttcagaaatcctcagatgatatggttgatgaaatactttccactccaaatgaagatggtggccacaattcagctcaggagaatgaacatgataagcttgaaagtgacattgacatgctacaggctagtgaggtgcaatgccatggcaccagtaaccctaaacctctgcaaactagattaattagaaagaagcttctgcaatttgacaaaagtaacaggccagcgtattatggatcctggaggaagaaaagtgctgttattggtccaaggtgtccacttaagatggatcctgatcttgactacgaggttgatagtgatgatgaatgggaagaggaggatcctggtgagagtctttctgactgtgagaaggataatgatgaagttatggaagaagattccaaaattacagatgaagaggatgaagatagctttgttgtgcctgatggctatctctcagacaatgagggtatacaaattgaaagcctattggatgataaagatgaggaagccactagtccaccaactggtcagtgtacagaagttgaagagttcaggtctctactgcgtcaacaaagagtcctgaacactttgactgagcaagctctcaggaagagccaacctcttattatatccaacctaaatcatgaaaaagctgaactactgactgctgaagacctcaagggaacagcaaagattgaacagctatgcttgcaagttctttcaatgcgcatctgcccaggaggtgcagttgttgatgtgcctctaactgacacctcatctgcaactgttgaggaaattaaccagcccaatgtgaagaatggctctcctggggctgcatctgctataccagaaacagacctgccagaaattgtccaggtgatacgatcatgtcgagatggaatccacaaggtggtggaattactgcagcacaagtttccaaatgttccaaagactcaactgaatcgtaaagtgagggagatatctgactttattgacaatcattggaaggtaaagaaagagattcttgacaagctaggattggattcgtcaccagtgaaatccaagaagaataaaagcatatccacgtacttctcgaagagatgtttacctccagaagaggctgtcaatgctctggctgcttctcctgagttgcggttgaaatctaaaaccaaaagtggcactgaagctcctcagatcaatctgttcccctcaaagcagtagaatttttaacccagatgagcagaaagctcagcggttcatgtacaaaggctatggaagtgcaactcagttttgcatcatcatcgatggaagatgaccttagtgcaactttggtttttgacaacatggagatctggattatgtttccagtgttggacatgttgtaactttagctcgaaagtaggtttattcatgaaggatattcagttcaattatttggccttgatgtgattaacatctgtcctattgttgacgcaaggcattgttctgaaattgcccatctgcaacctgtggtgtgttgtgaacattatgcctctggcaaataagcaatgagtcttgtgactgctcaattgaagtgcgactgcctg

SEQ ID NO: 667 - DNA, 3526 bp, Zea mays
caaatctccggtcgtctccagttcccacctcgcgccccaaatccgtatccaccgccaccgccaccgcccaccaccccgccgccaacgctgacgccgcctcctccggctgcacccgtcacgccaggtgcttggacttcgggaatctgcaggttcagtagagtagacaagtgtttgagcaaggactggatagaggaatgcgctgcttgttcctagagtagcacccgcaagatccaagtcttcccgcgatggaaagcggcgccatggtactcggtgttgttcgtcccgaggagtcccctgaccgcaacggcggtgggccacgggacgatttgggcccatcgcagatgcaggtcgatggtcccgttgttctcaaccaatccgctgagctcgtctcggatgattcgatggccgtcgatgacgtcccagttcaacaaccatcaggccagccggtggaggcaacacaacagtctcctgcgacgctgattgatactatcatggaggtgcagaagcagctgaagcggaagagggcttctaatagcccagtgattgatgccgccgataaggacgctcttgttgctgggtgccggcaggagctcgaggggctcttccagtattacaaggaggtttctgaccgcaagatgcagcttgacggcgggaacctgtccttcaacgggatggttggctgtttgcttgaggagagcagtctcgggctgactaggttggtggacgaaatatatcaacagctgaagggattggagggtgtgtctgtggcttcagtccgcagctctgtgctgctcgctggccagaggatgatgtacgggaattcttcactggacgctgatgtgttagaagatgaatcggagtcggctctttggtgctgggagataagagatctgcgattgttgcctgtgaaagtacgcagcattctgagtacacggagatctgtcagaaagaaaatccatgagagaatcactgccatatattcgactttgtcggttcttgaaaattcaggagcttacatccaagtaaatgatctaaaaaaagcatcattgaaattaaacaaatcactgaacctggaagggatcagatcaatggtggaaagagcgacacaaaagaacacagaacggggtgtgaaagatgctgtatcagcagttaaggaattgatgcaagagacagataaaaatgaccaaaatgttagaaggcttgaggatactagtgtctctgagccgcagaatgggaactcacttggtaatgagaaagagattcagaaagcacaaaaacaagtggagaaggaaataaagcgccaggagaaagaagaagctcagatgagaaaacttcaaaagaaacagcaagaagaggccctaagagaacagaagagacatgaaaaggaggaggctgaagccaagaagcaacaaaagaagcaggaagatgaagctctgaaagaacagaagagacgtgaaaaggaggaggctgaagctaagaaacaacaaaagaagcaggaagaggaagttctgaaagaacagaagcgtcgtgaaaaggaagaagctgaaatgaagaaacaacagaaaaaacagcaagatgaagctgagaaagaacagaagcgccttgagaaggaagctgcacaactcaagaagcaactggtcattcaaaaacaagcttctatgatggaacgctttttcaaaagtaagaaagacaatggaaaacatcaaaaacctggagagaacaactcagctgaagatccatgcaatgacaacaaagagacaataccagcaaccacatcaaaaattgattcttcattgtatcaacaagagggatgggttttagatgatcttcggaggttgcaggtcactggttggaagaagctatctagctacaataggtcctccagatggggtacaagatgcaagcccaagatggaggcatttaaagagctgaagcttcagaaatcctcagatgatatggttgatgaaatactttccactccaaatgaagatggtggccgcaatccaattcaggagaacgaacatgataagcttgaaagtgatattgacatgatacaggctagtgaaatgcaatgccatggtgctagtaaccctaaacctctgcaaacgagattaattagaatgaagcttctgcaatttgacaaaagtaacaggccagcatattatggatcctggaggaagaaaagtgctgctattagtccaaggtgtccatttaagatggatcctgatcttgactacgaggttgatagtgatgatgaatgggaagaggaggatcctggtgagagtctttctgactgtgagaaggataatgatgaatttatggaggaagattccaaaattacagatgaagaggatgaagatagctttgttgtgcctgatggctatctctcagacaacgaggggatacaaattgaaagcctattggacgataaagaagaggaggccaatagctccccaaatggtcagtgtacagaagttgaagagttcaggtctctgctccgccaacaaagagtcctgaacactttgactgagcaagctctccggaagagccaacctcttattatatgcaacctaaatcacgaaaaagctgaattactgactgctgaagacctcaagggaacggaaaagattgagcagctatgcttgcaagttctttcaatgcgcatctgtccaggaggtgcaattgttgatgtgcctctaactgacagctcatctgcaactgttgaggaaattaaccaacccaatgtgaagaatggctctcctgaggctgcatctgctataccagaaacagacctgccagaatttgtacaggtgataagatcatgtcgagatggtatccacaaggtggtggaattactgcagcacaagtttccaaatgttccaaagactcaactgaatcgtaaagtgagggagatatctgacttcattgacaatcattggaaggtaaagaaagagattcttgacaagctagggttggattcgtcaccagtgaaacccaagaagaataaaagcatagctatgtacttctcgaagagatgtttacctccggaagaggctgtcaatgctctggctgcttctcctgagttgcggttgaaatctagaaatggtggccgcgaagctccccagatcaatctgttcccctcagagcagtaaagtttctaataaaggtcccctgaaagttggattaggggtcaatgaagctacgaacccagatgagcagaaagctcagctatccatgtaaaggctaggaagtgcaactcggttttgcatcgtcaccaatggaagatggtcttagtgcaacatgggtttttgtcaacatctggattatgttttcagtgctggacatgtaattttagcctgaaagtaggtttttattcaattatttggccttgatgtgattaacatgtatgtgtcctgttgttagcgcaaggaattgctacaaagttggccatctgccgcttgtgtgttgttaacattattctgattctggcaaggcaaataagcaaacatgtcttgtgactgctcaa

SEQ ID NO: 668 - DNA, 3828 bp, Panicum virgatum
atagttgaaggaggtaaaacacattttttccaaaaacttgggcgtgtatgggctcattctaacggagcaaacaaacacgtggccccacgaatcgacggcggcggccgtcccgcgggaagccaaatcgacgaaacgaaattctcgaaaccgccggccgcgggaaacattttgcgcgcctcttctcccttccctcccacgcgcgcgcgcgcgcgcggcgcaactctctttacaaatactcttcccggttcggcgcccactcctctccaatcttctccgcttccctcctcgcgcccgttcacatccccaatctagatccactgcaggcgccgcccacctccccgagggaaacgccaaacgcggacgccgccgcccttctccggccgcacgcttcgctccctcctctggtgcttggactccggggatatgcaggtggagtagaccattgtttgaacaaagattggacataggaatgcgctgttagttcctggagtagaagctgcaagatccaaaccctcccgcgatggagagcagcggcatggttctcgatgttgttcgccccgaagaagcccccgacagcaacggcgcgggggcacacgacgatttggggcaatcgcagatgcaagtcgacggccccgttgttctcaaccgatcagccgagctcgagtcgtgtgactcgatggccaccgatgacgccccggcgcaagcaccatcaagccaaccggaggcggcgacgcagcagtctccttctacgctgacggacaccatcgtggaggtgcagaagcagctgaagcggaagagggcctccaacagcccggcgattgctgacgcggacagggatgcccttgtcgccggatgccggcaggagctcgagggcctcttccagtactacaaggaggtttctgaccgcaagatgcggtttgatgctgggaacctgtccggcaacgcgttggttggctgcttgcttgaggagagcagtcttgggctgaccaagttggtggacgagatatatgagaagatgaagggattgcagggtgtgtcgacggcttcggtccgtagctctgtcctgctcgttgggcagaggatgatgtacgggaaatcttccccggatgctgacgtgttggaagatgaatcagagtcagctctttggtgctgggagataagagatctgaagctgatgcctgtgaaagcacgcagcactctgagtacaaggagatctgtcagaaagaaaatccatgataggatcaatgccatctactcaactttgtcagttctggaaaaccgaggagttgaaacccaagtgaatgatctcaggaaaacatcattaaaattgaataaatcattgaatctggaagagatcagattaatggtggaacgagtgattcagaagaacacagaaagaggtgtgagagatgctgcgtcaacagctaaggaattgatgaaagaagcagagaaaaatgaccaaaatgttagcagacttgatgatgcgagtgtctctgaactgcagaatggaaacttgcctgctaatgaaaaggagattcagaaagtgcaaaaacaagctgagaaggaaataaagcgccaggagaaagaagaagctcagatgaggaaattgcaaaagaaacagcaagaagaggccctaagggagcagaagagacgtgaaaaggaagaagctgaagctaagaaacaacaaaaaaagcaagaagaggaagcattgaaagaacagaagcgtcgtgaaaaggaagaagctgaaatgaagaaacagcagaaaaaacagcaagaggaagctgagaaagaacagaaacgccgtgagaaggaagctgcacaactcaagaagcaactagccattcaaaagcaagcttctatgatggaacgctttttcaaaagtaagaaagacagtggaaaacttcaaaaatctggagataatgactcagctgatggtcccattgacaaaaaagaggcagtaccagcaaccacatcaaaaattgattcttccttgtctcaacaagagaactggattctaggggatcttcggaggttgcaggtcactggttggaagaagctatctagctacaataggtcgtccagatggggtatcaggcgcaaacccaaggtggaggcatttaaagagctcaagcttcaaaaatcttcagatgatatggttgatgaaatattttccactccgaatgaagatagctgccacaactcatgtcaggagaatgaacatgataagcttgaaagtgacattgacatgctaccaacaagtgaaacacaatgtcatggcaccagtaatgctaaacctctgcaaactagattgattaggagaaaacttctgcaatttgacaaaagtaacaggccagcgtattatgggacctggaggaagaaaagtgctgttgttggcccaagatgtccacttaagatggatcctgatcttgactacgaggttgatagtgatgatgaatgggaagaggaggatcctggtgagagtctttctgactgtgagaaggatggtgatgaagttatggaagaagattccaaaattacagatgaagaggatgaagatagctttgtcgtgcctgacggctatctctccgacaatgaggggatacagatagaaagtctattggatgataaggatgaggaagcctgtagctcaccaactgggcagtgcccagaagttgaagaattcaggtctctactccgccagcaaaaagtcctgaacactttgactgagcaggctcttcggaagagccaacctcttgttatatccaatttaaatcatgaaaaagctgaattactgactgctgaagacctcaagggaacaacaaaggttgaacaactatgtctgcaagttctttcaatgcgcatctgtccgggaggtgcggtggttgatgtgccttctattgacaactcatctgcaagtgctgaggaaattaaccagtccaatgtgaaaaatggttctcctgcttctgcatctgctataccagaaacagacctaccagaaattgttcaggtgattcgatcatgtcgagatggtatcaacaaggtggtcgaattactgcatcagaagtttccaaatgtttcaaagtatcaactaaaccgtagagtgagggagatatctgactttgttgataatcattggaaggtcaagaaagagattcttgacaagctaggcctggattcttcaccagtgaaatccaaaaagaccaaaggcatagccatgtacttcttgaagcggtgtttacctccagaagaggccatcagtgctctggtatcttcacctgagctgcgcttgaaatctaaaaccattcaaaatggcaacggtggcgctgaagctcctcagattaatctgttcccctcgccccagtagagttcctcgcaagatgatatcctaaagctttattcctcgggatcaggattcaatggagctgtgcacaaagatgagctctgagtaacagtggtgcgtgtacaaagacaatggaagcgcaacttgattttgcatcttcactgactgaagatgacccaacatggaggcctggataatgtttctgggtgctgacatgttgtagttttagccaaaaaataagttaatttatgaaggatactggttgatttatttggccatttgatgtgtccaacatgtatgtatcaattgttaacgcaggcggccggccattgttctgaaattgctcatcgcctgcaacttgttaacagtgtttattttagtgtgagctcattgagcctggaatttttttattctgggattctgacgaataagcaatctttacatgtgactgttcacttgacaatgactgcagaaatgggtttttgtaa

SEQ ID NO: 669 - DNA, 1861 bp, Setaria italica
tttccatcgccgccaccctctcctcctccctccccacctcgccgccaccaacaccgccgccgccatgcagagcctcctcctccccaccgccgcggcggccccggtggcggctccgcgcggccggcggcagccccccgggcgcgtctccgtacgcgcctccgcgacggcggcggcggcggccccgcggcgggagacggatcccaagaagcgggtggtgatcacggggatggggctggtctccgtgttcgggaacgacgtcgacgcctactacgaccgcctgctcgcaggggagagcggcatcggccccatcgatcgcttcgacgcctccaagttccccacccgcttcgccggccagatccgggggttctcctccgaggggtacatcgacggcaagaacgaccgccgcctcgacgactgcctccggtactgcatcgtcagcggcaagaaggcgctcgagtccgccgggatcgccctcggctccaagcccatggaaaagattgacaaggcccgggctggcgtgcttgtgggcactggtatgggtggcctcacagtgttttctgatggtgttcagaatcttattgagaagggatacagaaaaataactcctttcttcatcccgtatgctataacaaatatgggatccgccctgcttggaatggacattggcttcatgggtccaaactactccatctccactgcctgtgctacctcgaactactgtttctatgctgcagcaaaccatattcgcagaggcgaagctgatataatgattgctggtggcaccgaagctgcaattattccaattggtgttggtggctttgtggcatgtagagcactgtcacagaggaatgatgaccctaaaacagcatccaggccttgggacaaggaacgtgatggttttgtcatgggtgaaggagctggagtgctggtcatggagagcctagagcatgcaatgaaacgtgatgcaccgataattgcagagtatttaggaggtgctgtgaattgtgatgcttaccatatgactgacccaagatccgatggccttggtgtttcgtcatgcattaagcaaagtctcgaagatgctggtgtggcaccagaggaggtcaactatatcaatgctcatgccacatccacccttgctggtgatctggcggaggtgaatgccatcaagcaagtctttaaggacccatctgggatcaaaataaatgcaaccaagtccatgataggacactgccttggtgcagcaggtggtttggaagccattgctaccattaaagcgatgactactggatgggtgcatccaagcataaaccaattcaacccggaggaagtggttgaatttgatactgtacctaatgtaaaaaagcagcatgaagtgaacgttggtatttcaaattcctttggatttggaggtcacaattcagtggtagtatttgcaccatttaagccataaggtgttacttgcttcaccaatcttggtcagaacagtgaaggtcattctaggaatttccgcattaaattttcatgcgttttctttcgggggcagatttgttagccagcaacgttacaaatgaacagagtactgagatacattgcattttagacaactcgttgttcatttagattgagagcggctgtataacgttgtttgaatcatttgtaattggttgtactcttttttcatgtaatggtagaggtgtcctgtagaagctcatttggaccacctaattcaataccatacagatgtattggagggccagagttgtgtttgtactacaggatctgtactgcgttaccataatttgtcccaccaaatcagcatccaaaagctcttgatgcatgtgattcctgcatttttcaa

SEQ ID NO: 670 - DNA, 1806 bp, Setaria italica
cacctcgccgccaccaacaccgccgccgccatgcagagcctcctcctccccaccgccgcggcggccccggtggcggctccgcgcggccggcggcagccccccgggcgcgtctccgtacgcgcctccgcgacggcggcggcggcggccccgcggcgggagacggatcccaagaagcgggtggtgatcacggggatggggctggtctccgtgttcgggaacgacgtcgacgcctactacgaccgcctgctcgcaggggagagcggcatcggccccatcgatcgcttcgacgcctccaagttccccacccgcttcgccggccagatccgggggttctcctccgaggggtacatcgacggcaagaacgaccgccgcctcgacgactgcctccggtactgcatcgtcagcggcaagaaggcgctcgagtccgccgggatcgccctcggctccaagcccatggaaaagattgacaaggcccgggctggcgtgcttgtgggcactggtatgggtggcctcacagtgttttctgatggtgttcagaatcttattgagaagggatacagaaaaataactcctttcttcatcccgtatgctataacaaatatgggatccgccctgcttggaatggacattggcttcatgggtccaaactactccatctccactgcctgtgctacctcgaactactgtttctatgctgcagcaaaccatattcgcagaggcgaagctgatataatgattgctggtggcaccgaagctgcaattattccaattggtgttggtggctttgtggcatgtagagcactgtcacagaggaatgatgaccctaaaacagcatccaggccttgggacaaggaacgtgatggttttgtcatgggtgaaggagctggagtgctggtcatggagagcctagagcatgcaatgaaacgtgatgcaccgataattgcagagtatttaggaggtgctgtgaattgtgatgcttaccatatgactgacccaagatccgatggccttggtgtttcgtcatgcattaagcaaagtctcgaagatgctggtgtggcaccagaggaggtcaactatatcaatgctcatgccacatccacccttgctggtgatctggcggaggtgaatgccatcaagcaagtctttaaggacccatctgggatcaaaataaatgcaaccaagtccatgataggacactgccttggtgcagcaggtggtttggaagccattgctaccattaaagcgatgactactggatgggtgcatccaagcataaaccaattcaacccggaggaagtggttgaatttgatactgtacctaatgtaaaaaagcagcatgaagtgaacgttggtatttcaaattcctttggatttggaggtcacaattcagtggtagtatttgcaccatttaagccataaggtgttacttgcttcaccaatcttggtcagaacagtgaaggtcattctaggaatttccgcattaaattttcatgcgttttctttcgggggcagatttgttagccagcaacgttacaaatgaacagagtactgagatacattgcattttagacaactcgttgttcatttagattgagagcggctgtataacgttgtttgaatcatttgtaattggttgtactcttttttcatgtaatggtagaggtgtcctgtagaagctcatttggaccacctaattcaataccatacagatgtattggagggccagagttgtgtttgtactacaggatctgtactgcgttaccataatttgtcccaccaaatcagcatccaaaagctcttgatgca

SEQ ID NO: 671 - DNA, 2015 bp, Sorghum bicolor
aaaccaaccacataaactttgcaatgcaacacgcatcacaagggtaaacaagaagtttccgttgcaaagcccgccccgttccgttgagaacgaggtccgtctccggcgcctccaaagaccaaagtcccacagcgccaaagcccaaaccccctgtgggcccacgaccccatcctccatatacacacgggcaacgcttccggctcgcagccagcaggacaccactcatcttcttcccccccccgcctcgtttccatcgccgccaccctctcctcctcctcccccgtcccaccccctcgccgccgccgccaccgccgtcgccatgcagagcctcctcctgcccaccgctgccgcggccccggtggcggctccgcggggccggcggagtctcccggggcgcctctccgtgcgcgcctccgcgacggcggcagcggcgccgcggcgggagacggatcccaagaagcgggtggtgatcacggggatggggctggtctccgtgttcgggaacgacgtagacgcttactacgaccgcctgctggccggggagagcggcatcgggcccatcgaccgcttcgacgcctccaagttccccacccgcttcgccggccagatccggggcttctcctccgagggctacatcgacggaaagaacgaccgccgcctcgacgactgcctccggtactgcatcgtcagtggcaagaaggctctcgaggccgccgggattggcctcggctccaagcccatggaaaagattgacaagacccgggctggtgtgcttgtgggcactggtatgggtggcctcacggtgtttcaagatggtgttcagaatctcattgagaagggatacagaaaaataactcctttcttcatcccatatgctataacaaacatgggttctgccctgcttggaatggacattggtttcatgggtccaaactactccatctcaactgcctgtgctacctcgaattactgtttctatgctgcagcaaaccatatccgtagaggagaagctgatataatgatagctggtggcactgaagctgcaattattccaattggtgttggtggctttgttgcctgtagagcactgtcacagaggaatgatgacccgaaaacagcatccaggccttgggacaaggatcgtgatggttttgtcatgggtgaaggagccggagtcctggtcatggagagcctagatcacgcaatgaaacgtgatgcaccaataattgcggagtatttaggaggtgctgtgaactgtgatgcttaccatatgactgacccgagagctgatggtcttggtgtttcatcttgcatcaagcaaagtctcgaagatgctggtgtggcacctgaggaggtcaactatattaatgctcatgcaacatcaacccttgctggtgatctggcagaggtgaatgccatcaagcaagtcttcaaggacccatctgggatcaaaataaatgcaaccaagtccatgataggacattgccttggtgcagcaggcggtttggaagccattgctactattaaagcgataactactggatgggtgcatccaagcataaaccaatttaaccccgaggaagctgttgaatttgacactgtacctaatgtaaaaaagcagcatgaagtgaacgttggtatctcaaattcctttggatttggaggtcacaattctgttgtagtatttgcgccatttaagccataaggtgttccttgcctcacagatcttggtcagaacagtggagatcttttctagggatttctgcgttcagttttcacgtgttctctttgggggaagtaatgtcagatttgagccagcaacgttacaaatgaactaaagctgagatacattgcattttagataactccatgttcacttagattgagcgcggttgtacaacgttgctttgaatcatttgtaattgattgtactgtttttcatgtaatggaagagggtcctgtagaagcacatctggaccttctagttcaataccatacaaatgaattttcagggc

SEQ ID NO: 672 - DNA, 1774 bp, Zea mays
caggacaccactcatcttccttcccccccgcctcgtttccatcgccgccactctcttgctcccccgtaccatccctcgccaccgccaccgccgtcgctatgcagagcctcctcgtgcccactgctgcatcggccccggtggcggctccgcgggctcggcggaatctccctatgcgcctctccgtccgcgcctccgcgacggcggcagcggcaccgcggcgggagacggatcccaagaagcgggtggtgatcacggggatggggttggtctccgtgttcgggaacgacgtagacgcttactacgaccgcctgctagccggggagagcggcatcgggcccatcgaccgcttcgacgcctctaagttccccacccgcttcgccggccagatccggggcttctcgtccgagggctacatcgacggaaagaacgaccgccgcctcgacgactgcctccgatactgcatcgtcagtggcaagaaggctctcgaggctgccggtattgcccacggctccaagcccatggaaaagattgacaaaacccgggctggtgtgcttgtgggcactggtatgggtggcctcacggtgttttctgatggtgttcagaatctcattgagaagggctacagaaaaataactcctttcttcatcccatatgctataacaaacatgggttctgccctgcttggaatggatattggtttcatgggtccaaactactccatctcaactgcctgtgctacctcgaactactgtttctatgctgcagcaaaccatatccgtagaggcgaagcggatataatgatagctggaggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtcatggagagcctagagcatgcaattaaacgtgatgcaccaataattgcggagtatttaggaggtgctgtgaactgtgatgcttaccatatgactgacccgagatctgatggtcttggtgtttcatcttgcatcaagcaaagtctcgaagatgctggtgtggctcctgaggaggtcaactatattaatgctcatgcaacatcaacccttgctggtgatctggcagaggtgaatgccatcaagcaagtcttcaaggacccatctgggatcaaaataaatgcaaccaagtccatgataggacattgccttggtgcagcaggtggtttggaagccattgctactgtcaaagcgataactactggatgggtgcatccaagcataaaccaatttaacccagaggaagcggttgaattcgacacagtacctaatgtaaaaaagcagcatgaagtgaacgttggcatctcaaattcttttggatttggaggtcacaattctgtcgtagtatttgcgccatttaagccataaggtgttcctggcctcacaaaccttggtcagaacaacgaggatctttaggagtttctgcgttcaattttcatgtgttctctttaggggaagttatgtcagatctgagccggcaacgttacaaatgaactaaagctgagatacattgctttttagataactccaggttcacttaggttgtgcgcggctgtacaacgttgctttgaatcatttgtaattgattgtactgttttttcatgtaatggaagaggggttctgtagaagaagcacatttggaccttctagagttctag

SEQ ID NO: 673 - DNA, 1822 bp, Zea mays
tcgcagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttgccggtcagatccggggcttctcctccgagggatacatcgacggaaagaacgaccgccgccttgatgattgcctccgatactgcatcgtcagtggcaagaaggctctcgaggcctccggtatcgcccacggctccaagcccatggaaaagattgacaagacccgggccggtgtgcttgtgggcactggtatgggtggcctcacggtgttttcggatggtgtccagaatctcattgagaagggatacagaaagataactcctttcttcatcccatatgctatcacaaacatgggttctgccctgcttggaatggacattggtttcatgggtccaaattactccatctcaactgcctgtgctacctcgaactactgtttctatgctgcagcaaaccatatccgtagaggcgaagctgatataatgatagctggtggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtcatggagagcctagagcatgcaatgaaacgtgatgcaccaataattgcggagtatttaggaggtgctgtgaactgtgatgcttaccatatgactgatccgagatctgatggtcttggtgtttcatcttgcatcaagcaaagccttaaagatgctggtgtggcgcctgaggaggtcaactatattaatgctcatgcaacatcaacccttgctggtgatctggcagaggtgaatgccatcaagcaagtcttcaaggacccatctgggattaaaataaatgcaaccaagtccatgataggacattgccttggcgcagcaggcggtttggaagccattgctactattaaagcgataactactggatgggtgcatccaagcataaaccaatttaacccagaggaagcagttgaatttgacactgtacctaatgtaaaaaagcagcatgaagtgaatgttggtatctcaaattcctttggatttggaggtcacaattctgtcgtagtatttgcaccatttaagccataaggtgttccttgcctcacaaatcttggtcagaacagtgagatctgatttctgcgttcaattttcatgtgttctcttcgggggggaagtaatgtcagatttgaaccagcaacgttaaaaatgaactaaagatgagatacattgcgttttagatgactccatgttcacttagattgagcgcggctgtacaacattcctttgaaccatttgtaattgattgtactgtttttcatgtaatggaagaggagtcttgtagatgcacatctggaccttctagttaaatagcatacaaatgaatttggaaggca

SEQ ID NO: 674 - DNA, 1711 bp, Panicum virgatum
ggccccggcggcggctccgcggggccggcggcagccgccccggcgcgtctccgtccgcgcctccgcggcggcggcggcggcggccccgcggcgggagacggatcccaggaagcgggtagtgatcacggggatggggctggtctccgtgttcgggaacgacgtcgacgcctactacgaccgcctgctcgccggggagagcggcatcggccccatcgaccgcttcgacgcctccaagttccccacccgcttcgccggccagatccgggggttctcctccgaggggtacatcgacggcaagaacgaccgccgcctcgacgactgcctccgctactgcatcgtcagcggcaagaaggcgctcgaggccgccgggatcgcccacggctccaagcccatggaaaagattgacaaggcccgggctggcgtgcttgtgggcactggtatgggtggcctcacggtgttttctgatggtgttcagaatcttattgagaagggatacagaaaaataactcctttcttcatcccatatgctataacaaacatgggatccgccttgcttggaatggacattggcttcatgggtccaaactactccatctccactgcctgtgctacctcgaactactgcttctatgctgcagcaaaccatattcgcaggggcgaagctgatataatgattgctggtggcactgaagctgcaattattcctatcggtgttggtggctttgttgcatgtagagcactgtcacagaggaatgatgaccctaaaacagcatccaggccttgggacaaggaccgtgatggttttgtcatgggtgaaggagctggagtgctggtcatggagagcctagagcatgcaatgaaacgtgatgcaccgataattgcagagtatttaggaggtgctgtgaattgtgatgcttaccatatgactgacccaagatccgatggccttggtgtttcatcatgcattaagcaaagtctcgaagatgctggtgtggcgccagaggaggtcaactatatcaattgtcatgccacatccacccttgctggtgatctggcagaggtgaatgccatcaaaaaagtctttaaggacccatctgggatcaaaataaatgcaaccaagtccatgataggacactgccttggtgcagcaggtggtttggaagccattgctaccgttaaagccataactactggatgggtgcatccaagcataaaccaatttaacccagaggaagcagttgaatttgatactgtacctaatgtaaaaaagcagcatgaagtgaatgttggtatctcaaattcctttggattcggaggtcacaattcggtggttgtatttgcgccatttaagccataaggtgttacttgcttcacaaatcttggtcagaacaacgaaggtcgttctaggaatttcgggattaaattaccatgcgttttctttgggggcagatttgttatccggcaatgttacaaatgaactgagtaatgaggtacattacattttagataactccatgttcatttagattgagagcggctgtataacgttgtttgaatcattttgtaattggttgtactctttttcccatgtaatggaaggtgtcctgtagaagcacattggaccacctttgttcaatacccatacaatacaaatgtattcgagccagtggcgaagccagcccgagaattcacctagggcggactcatactc

SEQ ID NO: 675 - DNA, 1981 bp, Brachypodium distachyon
ccaaccccgcagccagcgcaccccggacgcctcgtttccatcgccacgcccctcctcccgccgccgtctcagccatgcagagcctcctcctccccaccgccgcggcctccgtggcgccggcggcccctcgcgggcggcggccgggccgcatctccgtgcgcgcttccgccaccgcggcggcggcggcggctgcgccacggcgggagacggatccgaagaagcgggtggtgatcacggggatggggctggtctccgtcttcgggaacgacgtcgacgcctactacgaccggctgctcgccggagagagcggcgtgggccccatcgaccgcttcgacgcctccaagttccccacgcgcttcgccggccagatccgcggcttctcctccgaggggtacatagacggcaagaacgaccgccgcctcgacgactgcctccgctactgcatcgtcagcggcaagaaggcgctcgaggccgctggcctcccgctcggctccgaggccatgggcaagattgacaaggcccgggctggtgtacttgtgggcactggtatgggcggcctccaagtgttttctgatggtgtccagaatcttatcgagaagggctacagaaagataactcctttcttcatcccgtatgcaataacaaacatggggtctgccctgcttggcatggatattggtttcatgggtccaaactactctatttcgactgcctgtgctacttcgaactactgtttctacgctgcagcaaaccatattcgcagaggcgaagccgatattatggttgctggtggcactgaagctgcaattattccaattggtgttggtgggtttgttgcatgtagagcactctcacagaggaatgatgaccctcaaactgcatctaggccttgggacaaggagcgtgatggttttgtcatgggtgaaggagctggagtactggtcatggagagcctagaacatgctatgaaacgtggggctccaatagttgcggagtatttaggaggtgctgtgaactgtgatgcttaccatatgactgacccaagagccgatggtcttggtgtttcatcatgcattagacaaagtcttgaagatgctggtgtggccccagaggaggtgaattacataaatgctcatgcaacatccactcttgctggtgatttggcagagatgaatgccatcaagcaagtgtttaaggacccatccgggataaaagtaaacgcaaccaagtccatgatagggcattgccttggcgccgcaggtggattggaagcaattgctactatcaaagcgataaacactggattggtgcatccaagcataaaccagtttaaccgggagccagcggttgaatttgatacggtacctaatgtaaaggcggaacacgaagtgaatgtcggtatctcgaattcgtttgggttcggaggacacaattcggtggtagtatttgccccattcaagccttgatgcgctactttgctccacaaatctttggccagaacagtgatggttttggggggaagctcggtgttattttgatggaagcaattactgatcggataatagccattgccacttcactatgaacagaggatctgagatccattgcatttttagatacatccatcttcgttttagattgagagctctctgtataacgtcttgctgccatctccagccggttctacttgttttcatgtaatgcaaaagggagggaatttctagaaattgtcgtcatgtagaggcaactactgggatattctattgttctgttccacagagaatgcattggggcctagccaaggagtcgtctgtctgtctgtctgtactacttgatctggtggaaatctataccgtgtcgtattttttttgttctatatccaggttccagtatgctgttgcctggaaccaaataaaaactgtatttttaggagatggcaatacatcttgaaccaacattatgtatccgtccattctaatta

SEQ ID NO: 676 - DNA, 2004 bp, Brachypodium distachyon
ccccgactccaaccccgcagccagcgcaccccggacgcctcgtttccatcgccacgcccctcctcccgccgccgtctcagccatgcagagcctcctcctccccaccgccgcggcctccgtggcgccggcggcccctcgcgggcggcggccgggccgcatctccgtgcgcgcttccgccaccgcggcggcggcggcggctgcgccacggcgggagacggatccgaagaagcgggtggtgatcacggggatggggctggtctccgtcttcgggaacgacgtcgacgcctactacgaccggctgctcgccggagagagcggcgtgggccccatcgaccgcttcgacgcctccaagttccccacgcgcttcgccggccagatccgcggcttctcctccgaggggtacatagacggcaagaacgaccgccgcctcgacgactgcctccgctactgcatcgtcagcggcaagaaggcgctcgaggccgctggcctcccgctcggctccgaggccatgggcaagattgacaaggcccgggctggtgtacttgtgggcactggtatgggcggcctccaagtgttttctgatggtgtccagaatcttatcgagaagggctacagaaagataactcctttcttcatcccgtatgcaataacaaacatggggtctgccctgcttggcatggatattggtttcatgggtccaaactactctatttcgactgcctgtgctacttcgaactactgtttctacgctgcagcaaaccatattcgcagaggcgaagccgatattatggttgctggtggcactgaagctgcaattattccaattggtgttggtgggtttgttgcatgtagagcactctcacagaggaatgatgaccctcaaactgcatctaggccttgggacaaggagcgtgatggttttgtcatgggtgaaggagctggagtactggtcatggagagcctagaacatgctatgaaacgtggggctccaatagttgcggagtatttaggaggtgctgtgaactgtgatgcttaccatatgactgacccaagagccgatggtcttggtgtttcatcatgcattagacaaagtcttgaagatgctggtgtggccccagaggaggtgaattacataaatgctcatgcaacatccactcttgctggtgatttggcagagatgaatgccatcaagcaagtgtttaaggacccatccgggataaaagtaaacgcaaccaagtccatgatagggcattgccttggcgccgcaggtggattggaagcaattgctactatcaaagcgataaacactggattggtgcatccaagcataaaccagtttaaccgggagccagcggttgaatttgatacggtacctaatgtaaaggcggaacacgaagtgaatgtcggtatctcgaattcgtttgggttcggaggacacaattcggtggtagtatttgccccattcaagccttgatgcgctactttgctccacaaatctttggccagaacagtgatggttttggggggaagctcggtgttattttgatggaagcaattactgatcggataatagccattgccacttcactatgaacagaggatctgagatccattgcatttttagatacatccatcttcgttttagattgagagctctctgtataacgtcttgctgccatctccagccggttctacttgttttcatgtaatgcaaaagggagggaatttctagaaattgtcgtcatgtagaggcaactactgggatattctattgttctgttccacagagaatgcattggggcctagccaaggagtcgtctgtctgtctgtctgtactacttgatctggtggaaatctataccgtgtcgtattttttttgttctatatccaggttccagtatgctgttgcctggaaccaaataaaaactgtatttttaggagatggcaatacatcttgaaccaacattatgtatccgtccattctaattatttttggatctgctg

SEQ ID NO: 677 - DNA, 1923 bp, Secale cereale
gactgccagcacaccagaccagaccccgcctcgtttccatcgccaccccgcccgcccgcccaccgccgccccccagccatgcagagcctcctcgtccccaccgccgcggcctgcgcggcgccgtcggcgtcgcgcccccggcctgcccgcgtctccgtccgcgcctctgctgcggccgcggcggccccgccccggcgggagacggatccgaagaagcgggtggtgatcacggggatggggctggtctccgtcttcggcaacgacgtcgacgcctactacgaccgcctgctcgccggggagagcggcgtgggccccatcgaccgcttcgacgcctccaagttccccacgcgcttcgccggccagatccggggcttctcctccgagggctacatcgacggcaagaacgaccgccgcctcgacgactgcctccgctactgcatcgtcagcggcaagaaggcgctcgagtccgcggggctcgcgctcggctccgacgccatggggaagattgacaaggcccgggctggtgtacttgtggggactggtatgggtggcctccaagtgttctccgatggtgttcagaatcttctcgagaaggggtacagaaagataactcctttcttcatcccatatgccataacaaacatgggatctgccctgcttggcatggacattggcttcatgggtccaaactactctatttcaacggcatgtgctacctcgaactactgtttctacgccgcagcaaaccatattcgcaaaggcgaagccgatgtgatgattgctggtggcactgaagccgccatcattccgattggtgttggtgggtttgttgcatgtagagcactatcacaaaggaatgatgaccctaaaacagcatccaggccttgggacaaggagcgtgatggtttcgtaatgggcgaaggagctggagtactggtcatggagagcttggaacatgcaatgaaacgtggtgctccaatagttgcggagtatctagggggtgctgtgaactgtgatgcttaccatatgactgatccgagagccgatggtctcggtgtttcatcttgcatcagacaaagtcttcaagatgctggtgtggcaccagaggaggttaactacatcaatgctcatgcaacatccacccttgctggtgatttggcagagatgaatgccatcaagcaagtctttaaggacccatctgggataaaagtaaacgcaaccaagtccatgatagggcattgcctaggtgcagcaggtggtttggaagccattgctactattaaagcgataaacactggattggtgcatccgagcataaaccagtttgaccgggagcctgcggttgaatttgacacggtacccaacgtaaaggccgaacacgaaatcaatgttggtatctcgaattcctttggatttggaggacacaactcagtggtcgtattcgccccattcaagccttaatgcggtacatgctcgacaaatcttggccagaacagtgaaggtttttttcaggaagctcttgagttatttcgatgtgttctcttccgggaagcaactgtcgatctgacagccagcaacattacagtgaacagaggatccaagatccattgcattttagatacacccatctccgattagatttgagaacgccgtgtaaccttctgcatcgcttgcagtcgattctacttgttttcgtgtaatttgtcatgtagaaacaaacactagttcttctgttccgtagagagagtgcattggagggcaaggagttgtttgtctgtactacctgatctggggggaaatctatattatcacaattttttgctgtttccagtccctttgtagtctaataaaaactgtaatgtttcagtcttacgggtggcgctcggtctaagatggtaatgcatactgaatgaaaattgtgat

SEQ ID NO: 678 - DNA, 2027 bp, Avena sativa
gcccctgtccgtcgcctccaaagctccccaaatccaaacccctctgtgggccccgcctaaccccaccctccatacatacgcacgctcaccaccaccccctgcctgcattccacctcgcagccagcacagcacgccccagagcgagcaggcagcctcgtttccatcgccaccccgccgccgccccccgcctccagccatgcagagcctcctcgtccccaccgccgccgcctccgtggcgccggcgaccccgcggaggcggcccgggcgcatctccgtccgcgcctcggcaacggcggcggctgcgcccccacggcgcgagacggatccgaagaagcgggtggtgatcacggggatggggctggtctccgtcttcgggaacgacgtcgacacctactacgaccggctgctcgcgggggagagcggcatcggcctcatcgaccgattcgacgcctccaaattccccacgcgattcgccggccagatccacggcttctcctccgagggatacatcgacggaaagaacgaccggcgcctcgacgactgcctacgctactgcatcgtcagcggcaagaaggcgctcgaatccgccggcctcgccctcggctccgactccatggagaagattgacaagtctcgggctggtgtacttgtgggcactggtatgggtggcctccaagtgttttctgatggtgttcagaatcttatcgagaagggccacaggaagataactcctttcttcatcccatatgccataacgaacatgggatctgcacttcttggcatggacattggtttcatgggtccaaactactctatttcaactgcgtgtgctacctcgaactactgtttctatgccgcagcaaaccatattcgtagaggcgaagcggatattatggttgctggtggcactgaagccgccattattccgattggtgttggtgggtttgttgcatgcagagcactatcacagaggaatgatgaccctaaaacagcatctaggccttgggacaaggaacgtgatggtttcgtcatgggtgaaggagctggaatactggtcatggagagcttagaacatgccatgaaacgtggtgctccaatagttgcggagtatttgggaggtgctgtgaactgtgatgcttaccatatgactgatccaagagccgatggtcttggtgtttcatcatgcattagacaaagtcttcaagattctggtgtggcaccagaggaggtcaactacatcaatgctcatgcaacttccactcttgctggtgatttggcagagatgaatgccatcaagcaagtctttaaggacccaactgggattaaagtaaacgcaaccaagtccatgatagggcattgcctcggtgcagcaggtggtttggaagccattgccgttattaaagcgataaacacaggattggtacatccgagcataaaccagtttaaccgggaggaggcggttgaattcgacacagtacctaacgtgaaagccgaacatgaagtgaatgttggtatctcaaattcttttggatttggaggacacaactcagtggtagtatttgctccattcaagccttaatgtggcggcacttgctccacaagtcttggtcgaaacagtgagggttttttccggaagctccccgttatttcaatgtgttttctttggtgaagcaactgccccacctgacatccatcagcgttacaatgaacagaggacatgagatccattgcgtttttagatacatctatcttggattagatcgagagcacaccgtgtgacgtttttccatcatttgcagtccgagtctacctatttcccgtgagacaaaagtcagggaatttctagaagtgtcatgtagaagcaacaattagatcttctgctttatagagagtgcattgaacgccaaagagtctgtgtgtgtactagtacatgatccggggaaaatctatatattatcgcaattttttgttgtatccagtatgctagtgccctgccaggcaaataaaaattgtatggctttcagttc

SEQ ID NO: 679 - DNA, 1796 bp, Avena sativa
gcctgcattccacctcgcagccagcacagcacgccccagagcgagcaggcagcctcgtttccatcgccaccccgccgccgccccccgcctccagccatgcagagcctcctcgtccccaccgccgccgcctccgtggcgccggcgaccccgcggaggcggcccgggcgcatctccgtccgcgcctcggcaacggcggcggccgcgccccccaggcgcgagacggatccgaagaagcgggtggtgatcacggggatggggctggtctccgtcttcgggaacgacgtagacacctactacgacaggctgctcgcgggggagagcggcatcggcctcatcgaccgattcgacgcctccaaattccccacgcgattcgccggccagatccacggcttctcctccgagggctacatcgacggcaagaacgaccggcgcctcgacgactgcctacgctactgcatcgtcagcggcaagaaggcgctcgaatccgccggcctcgccctcggctccgactccatggagaagattgacaagtctcgggctggtgtacttgtgggcactggtatgggtggcctccaagtgttttctgatggtgttcagaatcttatcgagaagggccacaggaagataactcctttcttcatcccatatgccataacgaacatgggatctgcacttcttggcatggacattggtttcatgggtccaaactactctatttcaactgcgtgtgctacctcgaactactgtttctatgccgcagcaaaccatattcgtagaggcgaagcggatattatggttgctggtggcactgaagccgccattattccgattggtgttggtgggtttgttgcatgcagagcactatcacagaggaatgatgaccctaaaacagcatctaggccttgggacaaggaacgtgatggtttcgtcatgggtgaaggagctggaatactggtcatggagagcttagaacatgctatgaaacgtggtgctccaatagttgcggagtatttaggaggtgctgtgaactgtgatgcttaccatatgactgatccaagagccgatggtcttggtgtttcatcttgcattagacaaagtcttcaagattctggtgtggcaccagaggaggtcaactacatcaatgctcatgcaacttccactcttgctggtgatttggcagagatgaatgccatcaagcaagtctttaaggacccaactgggattaaagtaaacgcaaccaagtccatgataggacattgcctcggtgcagcaggtggtttggaagccattgccgttattaaagcgataaacactggattggtgcatccgagcataaaccagtttaaccgggaggaggcggttgaatttgacaccgtacctaacgtgaaagccgaacatgaagtgaatgttggtatctcaaattcttttggatttggaggacacaactcagtggtagtatttgctccattcaagccttaatgtggtggcacttgctccacaagtcttggtcgaaacagtgagggttttttccggaagctccccgttatttcaatgtgttttctttggtgaagcaactgccccacctgacatccatcagcgttacaatgaacagaggacatgagatccattgcgtttttagatacatctatcttggattagatcgagagcacaccgtgtgacgtttttccatcatttgcagtccgagtctacctatttcccgtgagacaaaagtcagggaatttctagaagtgtcatgtagaagcaacaattagatcttctgctttatagagagtgca

SEQ ID NO: 680 - DNA, 1672 bp, Pennisetum glaucum
cccccgggcgcgtctccgtacgcgcctccgcgacggcggcggcggcggcggccccgcggcgggagacggatcccaagaagcgggtggtgatcacggggatggggctggtctcagtgttcgggaacgacgtcgacgcctactacgaccgcctgctcgccggggagagcggcatcggccccatcgatcgcttcgacgcctccaagttccccacccgcttcgccggccagatccgggggttctcatccgagggatacatcgacggcaagaacgaccgccgcctcgacgactgcctccggtattgcatcgtcagcggcaagaaggcgctcgagtctgccgggatcgcccacggctccaagcccatggaaaagattgacaaagcccgggctggtgtgcttgtgggcactggtatgggtggcctcacggtattttctgatggtgttcagaatcttattgagaagggatacagaaaaataactcctttctttatcccgtatgctataacaaacatgggatccgccctgcttggaatggacattggcttcatgggtccaaactactccatttccactgcctgtgctacctcgaactactgtttctatgctgcagcaaaccatattcgcagaggcgaggctgatataatgcttgctggtggcaccgaagctgcaattattccaattggtgttggtggctttgttgcatgtagagcactgtcacagaggaatgatgaccctaaaacagcatccaggccttgggacaaggaacgtgatggttttgtcatgggtgaaggagctggagtgctggtcatggagagcctagagcatgcaatgaaacgtgatgcaccgataattgcagagtatttaggaggtgctgtgaattgtgatgcttaccatatgactgacccaagatctgatggccttggtgtttcgtcatgcattaagcaaagtcttgaagatgctggtgtggcgccagaggaggtcaactatatcaattgtcatgccacatccactcttgctggtgatctggcggaggtgaatgcgatcaagcaagtttttaaggacccatctgggatcaaaataaatgcaaccaagtccatgataggacactgccttggtgcagcaggtggtttggaagccattgctaccattaaagcgataaatactggatgggtgcatccaagcataaaccaatttaacccggaggaagtggttgaatttgatactgtacctaatgtaaaaaagcagcatgaagtgaacgttggtatttcaaattcctttggatttggaggtcacaattcagtggtagtatttgcaccatttaagccatgaggtgttacttgcttcaccaatcttggtcagaacagcgaaggtcgttctaggaatttccatgttaaatttccatgtgttttctttgggggcggatttcttagccagcaacgttacaaaagaacagagtactgagatacatcgcattttagacaacccatgttcatttagattgagagcggctgcgtaacgttgtttgaatcatctgtaattggtttgtactcttttttcatgtaatggtagaggtgtcctgtaaaagctcatttggaccacctagttcaataccacaaagatgtattgaagggccggaattgtgtttgtactacgggatctgtactgcgtcaacataa

SEQ ID NO: 681 - DNA, 1834 bp, Musa acuminata
tctccctcgacgtctccgcctcccctattctccctccctctgcttcgagctcccatttctattcgcgtttcgccctcttccctcctcccagaattctagggttctacccagcaccgggatgcagaccctccgcgtccctacgatggacggcctccgcctctcccccgctacgccgtccgccaccccccgacgtccctccctccgccggcccgccggcgccagctccatccgcgcctccgtcgtcgcggcggcgccacgccgcgagacggatcccaagaagcgggtggtcatcaccgggatggggcttgtctcggtgttcgggaatgacgtagatgcgtactacgagaagcttctggagggggagagcgggatcgggcccatcgaccggttcgacgcctccaaattacccacgaggttcgccgggcagatcagggggttctcgtcggaggggtacattgacgggaagaacgaccggcggctcgatgactgtctgaggtattgccttgtcagcggcaagaaggctctcgagagcgctggcctcggtgtcggcagccaagcaatcagcaagattgacaaggttcgagcaggtgtgcttgttggcacaggcatgggtggtcttacagtgttttccgatggtgttcaggctcttatagagaaaggccataggaaaataactccatttttcattccttatgctataacaaacatgggttctgccttacttgctatggatattggatttatgggcgcaaattactccatttcaactgcctgtgcaacctccaactattgcttttatgctgctgctaaccatattcgtcgaggtgaggctgatataatgattgctgggggtactgaagctgctattattcctattggtgttggtgggtttgtcgcctgtagagcactgtcccagagaaatgatgatccaaaaactgcatcaaggccatgggacacaggtcgagatggttttgttatgggtgaaggtgctggtgtgttggtcatggagagccttgaacatgcaatgaagcgtgatgcaccaattatagctgagtatctgggaggtgctgtgaactgtgatgcctatcatatgacagatcctagagctgatggtcttggagtttcatcttgtatcaggaaaagtcttgaagatgctggagtagcaccagaagaggttagttacattaatgctcatgcaacttccactcttgcgggtgacttggcggaggtaaatgctattaatcaagtcttcaagaacccatctgggattaagatgaatgcaaccaagtctatgatagggcactgccttggagcagcaggaggtttagaggccatcgcaacagtgaaagccatcactactggatggctgcatcctagtataaatcaatttaatcccgagccagcagttgagtttgatacagttgctaacaaaaagcagcagcatgaagttaatattgctatctcaaattcattcggatttggagggcacaactctgtggtggtatttgcacctttcaagccatgattctggtacactttttctgccctgggccaactggttctcgtcgaggagaaatttcagcaaattgtttgtagcctttttaggtgacagaaatatttgtgcggaagtagctccaaggaaagcttatgtttaaactcgagaaccaccactggagaggtttgttggacattttacttcaaaggacttttcatctcgtgtggcactctttatgttcccaagtacgttattgtcattcttcttcaaccacagtactcctgattgctgttttagttcacgaagattgcatattctgataatatatgagatgtctgc

SEQ ID NO: 682 - DNA, 1897 bp, Musa acuminata
tgataatacatcaaatcttctccctcgacgtctccgcctcccctattctccctccctctgcttcgagctcccatttctattcgcgtttcgccctcttccctcctcccagaattctagggttctacccagcaccgggatgcagaccctccgcgtccctacgatggacggcctccgcctctcccccgctacgccgtccgccaccccacgacgtccctccctccgccggcccgccggcgccagctccatccgcgcctccgtcgtcgcggcggcgccacgccgcgagacggatcccaagaagcgggtggtcatcaccgggatggggcttgtctcggtgttcgggaatgacgtagatgcgtactacgagaagcttctggagggggagagcgggatcgggcccatcgaccggttcgacgcctccaaattacccacgaggttcgccgggcagatcagggggttctcgtcggaggggtacattgacgggaagaacgaccggcggctcgatgactgtctgaggtattgccttgtcagcggcaagaaggctctcgagagcgctggcctcggtgtcggcagccaagcaatcagcaagattgacaaggttcgagcaggtgtgcttgttggcacaggcatgggtggtcttacagtgttttccgatggtgttcaggctcttatagagaaaggccataggaaaataactccatttttcattccttatgctataacaaacatgggttctgccttacttgctatggatattggatttatgggcgcaaattactccatttcaactgcctgtgcaacctccaactattgcttttatgctgctgctaaccatatacgtcgaggtgaggctgatataatgattgctgggggtactgaagctgccattattcctattggtgttggtgggtttgtcgcctgtagagcactgtcccagagaaatgatgatccaaaaactgcatcaaggccatgggacacaggtcgagatggttttgttatgggtgaaggtgctggtgtgttggtcatggagagccttgaacatgcaatgaagcgtgatgcaccaattatagctgagtatctgggaggtgctgtgaactgtgatgcctatcatatgacagatcctagagctgatggtcttggagtttcatcttgtatcaggaaaagtcttgaagatgctggagtagcaccagaagaggttagttacattaatgctcatgcaacttccactcttgcgggtgacttggccgaggtaaatgctattaatcaagtcttcaagaacccatctgggattaagatgaatgcaaccaagtctatgatagggcactgccttggagcagcaggaggtttagaggccatcgcaacagtgaaagccatcactactggatggctgcatcctagtataaatcaatttaatcccgagccagcagttgagtttgatacagttgctaacaaaaagcagcagcatgaagttaatattgctatctcaaattcattcggatttggagggcacaactctgtggtggtatttgcacctttcaagccatgatcctggtacactttttctgccctgggccaactggttctcgtcgaggagaaatttcagcaaattgtttgtagcctttttaggtgacagaaatatttgtgcggaagtagctccaaggaaagcttatgtttaaactcgagaaccaccactggagaggtttgttggacattttacttcaaaggacttttcatctcgtgtggcactctttatgttcccaagtacgttattgtcattcttcttcaaccacagtactcctgattgctgttttagttcacgaagattgcatattttgataatatatgagatgtctgcattttgcttgtgatgtaatgaaataacaaagcaattttcatttga

SEQ ID NO: 683 - DNA, 1650 bp, Musa acuminata
ctaaaaaggacaattcgcacacgcttcctctgatctctcgagaactccgaggctccgccgcccgccaccatgcagaccctcctcctccccgccgtggacggtctccgcctctcctcccccgaacctccccccacgctccgtcgacgctccccccgcccgctcaccgccgtccgcgcctctgccgcgccgccccgcagggagacggatccgaagaagcgggtcgtgatcaccggcatggggctggtctccgtgttcggaaacgacgtcgatgcgtactacgacaagctcctccaaggggagagcgggatcgggctgattgaccggttcgacgcgtccaagttccccacaaggttcgccggccagatcagggggttttcgtcggaggggtacattgatgggaagaacgaccggcggctcgacggctgtttgaggtattgcctggttagtggcaagaaggccctcgagagcgccggccttggtgttgggagccaaacccttaacaagattgacaaggttcgagctggtgttcttgttggtacaggcatgggtggtctttcaatcttttctgatggggttcaggctttaatagagaaaggccacaggaaaataactccatttttcattccttatgccataacaaacatgggttctgcgctacttgcaatggatattggtttcatgggtcctaactattcaatttctactgcatgtgcaacgtcaaactattgtttttatgctgctgctaatcatattcgtcgtggtgaggctgatataatgattgctggtggtactgaagctgccatcattccaattggtgttgggggttttgttgcatgtagagcattatctcaaagaaatgatgatcctaaaactgcatcaagaccatgggacaaggatcgagatggctttgtcatgggggaaggtgctggagtactggtcatggagagccttgaacatgcaatgaaacgtgatgcaccaataattgctgagtaccttggaggtgctgtcaactgtgatgcctatcatatgacagatcctagagctgatggacttggggtttcatcttgtgtccagaaaagtcttgaagatgctggagtggcaccagaagaggtcaattacataaatgctcatgcaacttccacacttgcgggggatctggcagaggtgaacgccattaaacaggttttcaaggatccatctgcggttaagatgaatgcaacaaagtctatgatagggcactgccttggtgcagcaggcggtttagaggctattgcaactgtgaaagccataactacaggatggctgcatccaactataaaccaattcaatttagagccagcagttgagtttgataccgtggcaaacgaaaagcagcagcatgaagttaatgttgctatttcaaactcatttggttttggaggacacaactcggttgtggtgtttgcacctttcaagccatgatcagttcaaacataatttttggggtatctgatggttacctttctctagtgaggccaggaaaagtagagttgtttcaagctgccaaattttctgctaaaggaggcaaattttgctatgagaacagtctttcttcatatgagaaaaacatttctattctttcaataaagcctttgcacctattttttttcc

SEQ ID NO: 684 - DNA, 1804 bp, Amorphophallus konjac
cgagggacctcctcggcttctccgcagcaatgcaggcctcttcctctctccacatccccaagatggagggtctccgcctgcaccgccccgcggccccgccgctgccgtcagccggggcgcggtgccgccgccggattggaccggggccccgcccctcggtccgggcctccgctggggtggcggcggcgccgccgaggagggagacggatccgaagaagagggtggtgatcaccggtatggggctggtctccgtcttcggcaacgacgtggatgcttactacgagcggctgctggagggggagagcgggatcggccccatcaacaggtttgatgcctccaagttccccaccaggttcgccggccagatccgggggttcacttccgagggctacatcgacggcaagaacgaccgccggctcgacgactgcctccgctactgccttgtcagcggtaagaaggcgctcgagagcgccgggctccctgtcggcagcgccgccttggagaagatcgacaaggtgcgagctggtgtgcttgtgggaactggcatgggtgggctcactgtgttctctgatggtgtccaggctcttattgaaaaaggttacagaaagataaccccattttttattccttatgcaatcacaaacatgggatctgcattgcttgcaatggatgttgggttcatgggtgcaaattattcaatatcaactgcttgtgccacatcaaactattgtttttatgctgctgcaaaccatatacgacggggagaagccgatataatgcttgctggtggaactgaagctgcaattattcccattgggttggggggttttgtagcatgtagagctttatcgcagagaaatgatgatccaaaaactgcatcaaggccgtgggacaaggaccgggatggctttgtaatgggggaaggtgctggagttctggttttggagagcttggagcatgcaatgaaacgtgatgcaccaattattgctgaatacttgggtggggctgtaaattgtgatgcataccatatgactgatcctagagctgatggacttggggtttcgacctgtatccagagaagtcttgaggatgctggtgtagcaccagaggaggttaactacataaatgctcatgccacttctacactcgctggggacctggctgagatcaatgccattaaaaaagtcttcaagaatacatcagaaatcaaaatcaatgccaccaagtctatgatagggcattgtctcggtgcagcaggtggattagaggccattgctactgtgaaagccataactactgggtggcttcatccaagcattaaccaatttaatcctgagccagcagttgaatttgatactgtggcgaatgagaaacagcagcatgaagtgaatgttgcgatttctaattctttcggttttggaggacacaactccgttgttgtttttgcgcctttcaagccttgagagcatttcctgatgttgttcttgcctgtgagactgacttcgggcatgtcttttatccaatacttggctgatattgatcatgcagtaagaaccggaggcgaacatcacgggagacttgttaaacataaaaataagttatttgttatcttcatttttcaatatttaatttgttggttgtgtagaagttaattgggatgtgagaaattctttagcgccaccgcaattttcataatgcaatttgccacatgcattaggagatgcttgattggttacgaggatggctcctctaagatttttgtgatttgtcagaaaaaacgtgtccaatgtgtgttgaaaggtgc

SEQ ID NO: 685 - DNA, 1958 bp, Cocos nucifera
aaagaccgcaatttgcttttattctgtttccgaggtaaacatgggatccgtccctttatgcgcccgttagacgagtctcaaagtctggtgatctcccttctcggtcgtatcgccgctccgaaccctgcatccattttttggcgcaaaacacctcctccctcccctatttactttccccgtccctgctccgctctctttcgccttcccctcgccctctcgatggccatgcagaccattcgcgtcccctccatggacggcctccactgctccccctcgtttccggcccctgccgctgccgccgctccctgccggcgcggcctcctcctccgccgatccgtccggcggcccgccgtccgtgcctccgtcgcggcggcgccagtggcgcctcggagagagacggatccgaggaagcgggtggtgataacggggatggggttggtgtcggtgttcgggaacgacgtcgatgtctactacgagaagctgctggaaggggagagtgggatcgggccgatcgaccggttcgacgcctctaagttcccgacgaggttcgccggccagatcagggggttctcgtcggaggggtacatcgacgggaagaacgaccgcaggctcgatgactgccttcggtactgcctcgtcagtggcaagaaggcgctcgagagcgccgggcttgcggttgggagcaaggccctcagcaagattgagaaggtacgagctggtgtacttgtggggacgggcatgggtggcctttcggtgttttctgatggtgtccaggctctcatagagaaaggctacaggaaaataactccattttttattccttatgccataacaaacatgggctcggccctgctggcaatggatattggcttcatgggtgcaaactattcaatttcaactgcctgtgctacttcaaattattgtttctatgctgctgccaaccatatccgtcgtggtgaggctgatgtaatgattgctggtggtacagaagctgcagttattcctatcggtattggaggctttgtggcatgtagagcattgtcacagagaaatgatgagcccaaaactgcatcgaggccgtgggacaaaggtagagatggatttgttatgggagaaggtgctggagtgttggttatggagagtctggaacatgcaatgaaacgtggtgcatcgattattgctgagtacctgggaggtgctgttaactgtgatgcttatcatatgacggatcctagagctgatgggcttggcgtttcatcttgtatccaaagaagtcttgaagatgccggtgttgcaccagaggaggttaactatataaatgcccatgcaacttccacacttgctggtgacctagctgaggtgaatgctattaaacaggtgttcaagaacccatcagacatcaagatcaatgcaaccaagtctatgatagggcactgccttggtgcagccgggggtttagaagcgattgcaacagtgaaagccataactactgggtggctgcatccaacgatcaaccaatttaatccggagcctgcggttgaatttgatacggtggcaaataaaaagcagcaacatgaagtgaatgttgcgatttctaattcatttggattcggaggacacaactcggtggtggtgtttgcgccttttaagccatgatccatcatagtttgctctttgcattctgtttcaactggagaatcctcggcattgagggggaaaagaatttagttgtatcaaataggcattttccattttaccgaagcaagttttgacaacaaaagcttttatttatgtgggagtggtagtgttaggtggtttaattcggcggcttcggtcattttaagttgaggaagaggagcactcaatactgtgggccccctgtgattgaactctgagagatgttgtctttaacgttgcatgcgttattggttaaacattgattagtttttccacaaaaa

SEQ ID NO: 686 - DNA, 2130 bp, Cocos nucifera
cttcagtctgatactcgtcgcagcaatgatcaaaacgtgcccttgtatcatgctttcatgcggaacatcggatccgccccatcctggattcattgaacgggcctctaaatctggtgacctccatcctcgttcgtatcgcctcgttcgtatcgccccgccgctctccgaactcagctctctattttttaatttcttttcacaaacatccctccccccgccgcttgttattttccggacagtcgtcccccttctcgccttacccccgccccctcgacggccatggacggcctccgccttccctccatggacggcctccgcctctccccctccccaccgccggccgccgccccctcccggcgctgccttcttctccgtcgatccgtccggcggcccgccgtccgcgcctccgtcgcggtggcgccccggagggagacggatccgaagaagcgggttgtgataacggggatggggctggtgtcggtgttcgggaacgacgtggatgtttattacaagaagctgcttgaaggggagagcgggatcgggccgatcgaccggtttgacgcctctaagttcccgacgaagttcgctggccagatcaggggtttctcgtcggagggatacatcgacgggaagaacgaccggcggcttgacgactgcctcaggtactgcctcgtcagtggcaagaaggcactggagagcgccggacttggcgttgggagcaaggatctcagcaagattgacaaggtgcgagctggtgtacttgtggggacaggcatgggtggcctcacggtgttttctgatggtgtccaggctctcatagagaaaggccacaggaaaataactccattttttattccttatgccataacaaacatgggctccgccttgctggcaatggatattggcttcatgggtgcaaattattcaatttcaactgcctgtgctacttcaaattattgtttctatgctgctgccaaccatattcgtcgtggtgaggctgatgtaatgattgctggtggtaccgaagctgcaattattccaattggggttggggggtttgtggcctgtagggcattgtcgcagagaaatgatgatcccaaaactgcatcaaggccatgggacaaaggtcgggatggctttgttatgggagaaggtgctggagtgttggtcatggagagtctggaacatgcaatgaaacgtgatgcacctattattgctgaatacttgggaggtgctgtcaactgcgatgcttatcatatgacagatcctagagctgacgggcttggcgtttcatcttgtatcgaaaaaagccttgaagatgccggagttgcaccagaagaggttaactatataaatgcccatgcgacttccacacttgctggtgacctagctgaggtgaatgctgttaaacaggtcttcaagaacccatcagaaatcaagatgaatgcaaccaagtctatgatagggcactgccttggtgcagctggaggtttagaagccattgcaacagtgaaagccataactactgggtggctgcatccaaccataaaccaatttaatccagagcctgcagttgaattcgatacagtggcaaataaaaagcagcaacatgaagtgaatgttgccatttctaattcatttggatttggaggacacaactctgtggtggtatttgcaccttctaagccatgatccatcatagtttgctttttccatttgatggtgttgtttgctttttccatcatagccagagaaatctttcacatttaaggggggaagaagttagttgtggcagcaggaattattctttctagtgaagcaagttttgacaacagtggcatttaccattgtgggagggagtaccactaggtggcttaactcaggcgctttggtcactctaggaagaagagcagtcatccttgcgggccccctgctattgcgttgtgataatattgtatgtttaacatttcatgcattatcggttaaacattgctagattttcccaaccccttgttttgttcacaaacttccaatgattgattacatatactttcccatttgtattcctggatttgcctattcatatgatttgcctaataagttttaattgttggagttattctttaaaaa

SEQ ID NO: 687 - DNA, 1834 bp, Elaeis guineensis
cctgcatccattttttggcacaaaagcgctcctccctccccaatttacttaacctcgtccctgctccgcccgctctctccttctcctcgccctctcgacggccatgcagaccattcgcgtcccctccatggaaggcctccgattctccccctcgtttccgccccccgccgctccctcccggcgcggcctcgtccgccgatccatccggcggccggccgtccgcgcctccgtcgcggcggcgcctcggagggagacggatccgaggaagcgggtggtgataacggggatggggctggtgtcggtgttcgggaacgacgtcgatgtctactacgagaagctgctggaaggggagagtgggatcgggccgatcgaccggttcgacgcctctaagttcccaacaaggttcgccggccagattagggggttctcgtcggagggatacatcgacggcaagaacgaccgcaggctcgatgactgcctccggtactgcctcgtcagtggcaagaaggcgctcgagagcaccgggcttgaggttgggagcaaggccctcagcaagattgacaaggtacgagctggtgtacttgtggggacgggcatgggtggccttacagtgttttctgatggtgtccaggctctcatagagaaaggctacaggaaaataactccattttttattccttatgccataacaaacatgggctcagccctgctggcaatggatattggcttcatgggtgcaaactattcaatttcaactgcctgtgctacttcgaattattgtttctatgctgctgccaaccatattcgtcgtggtgaggccgatgtaatgattgctggtggtacagaagctgcaattattcctattggtattggaggttttgtagcatgtagagcattgtcacagagaaatgacgagcccaaaactgcatcaaggccatgggacaaaggtagagatggctttgttatgggagaaggtgctggagtgttggttttggagagtctggaacacgcaatgaaacgtggtgcacctattattgctgagtacctgggaggtgctgttaactgtgacgcttatcatatgacggatcctagagctgatgggcttggcgtttcatcttgtatccaaaaaagtcttgaagatgctggtgttgcaccagaggaggttaactatatcaatgcccatgcaacttccacacttgctggtgacctagctgaggtaaatgccattaaacaggtgttcaagaacccatcacacatcaagatcaatgcaaccaagtctatgatagggcactgccttggtgcagctgggggtttagaagcgattgcaacagtgaaagccataactactgggtggctgcatccaacaatcaaccaatttaatccggagcctgcagttgaatttgatacagtggcaaataaaaagcagcaacatgaggtgaatgttgccatttctaattcatttggatttggaggacacaactcggtggtggtgtttgcgccttttaagccatgatccatcatagtttgcctttggcattctgtttcaactacagaattttccacattgagggggaaaagaatttagttgtttcaagtaggcattttccattttactgaagcaagttttgacaacaaaagcttttaattatgtgggagtagtagcgttaggtggtttaatgcggcggcttcggtcattttaagtttaggaagagcattcatactgcgggccccctgtgattgaactctgagagatgttgtgtctttaacattgattagtttttccacaaaaagaagtgcttagttttattaattaatttctttgaagtagaattat

SEQ ID NO: 688 - DNA, 1931 bp, Elaeis guineensis
tttgcacaaacatccctccccgctccaattattattttcccgaccctcgccccccttctcgccttctccccgccccctcgacgaccatgcagaccctccgcctcccctccatggacggcctccacctctccccctcgccaccgccggccgccgccccctcccggcgcggcctccttctccgtcgatccgactggcggcccgccgtccgcgcctccgtcgcggtggcgccccggagggagacggatccgaagaagcgggttgtgataacggggatggggctggtgtcggtgtttgggaacgacgtggatgtttattacgagaagctgcttgaaggggagagcgggatcgggctgatcgaccggttcgatgcctccaagttcccgacgaagttcgctggccagatcaggggtttttcgtcggagggatacatcgacgggaagaacgaccggcggctcgacgactgcctcaggtactgccttgtcagcggcaagaaggcactggagagcgccggacttggcgttgggagcaaggatctcagcaagattgacaaggtgcgagctggtgtacttgtggggacgggcatgggtggcctcacagtgttttctgatggtgtccaggctcttatagagaaaggctacaggaaaataactccattttttattccttatgccataacaaacacgggctctgccttgctggcaatggatattggcttcatgggtgcaaattattcaatttcaactgcctgtgctacttcgaattattgtttctatgctgctgccaaccatattcgtcgcggtgaagctgatgtaatgattgctggtggtactgaagctgcaattattccaatcggggttgggggttttgtggcctgtagggctttgtcacagagaaatgatgatcccaaaactgcatctaggccatgggacagagagcgggatggctttgttatgggagaaggtgctggagtgttggtcatggagagtctggaacatgcaatgaaacgtgatgcacctattattgctgagtatttgggaggtgctgttaactgcgatgcttatcatatgacggatcctagagctgatgggcttggcgtttcatcttgtattgaaaagagccttgaagatgctggagttgcaccagaagaggttaactatataaatgcccatgcaacttccacacttgctggtgacctagcagaggtgaatgctgttaaacaggttttcaagaacccgtcagaaatcaagatgaatgcaaccaagtctatgatagggcactgccttggtgcagctgggggtttagaagccattgcaacggtgaaagccatgactactgggtggctgcatccaaccataaaccaatttaatccagagcctgcagttgaattcgatacagtggcaaataaaaagcagcaacatgaagtgaatgttgccatttctaattcatttggatttggaggacacaactcggtggtggtgtttgcaccttttaagccatgatccatcatagtttgccttttccatttggtgacgttgtttgctttttccatcatagctagagaaatctttcacatttatggggggaaagaagttagttgtggcaacaggaattattctttctagtgaagcaagttcgacaacaatagcttttactattgagggaaggagtaccactaggtggcttaactcaaggcgctttggtcacttcaggaagaggagcagtcgtccttgcggcccccctgcgattgcgttctgatagtattgtatgtttagcatttcatgcattatcggttaaacgttgctaggttttcccaaccccttgttttattcacaaactttccatgatcgattacatatactttcccatttgtattcctggatttgcgtcataagttttaattgttggagttattctttaaaaaaaaaaaaaaa

SEQ ID NO: 689 - DNA, 2004 bp, Panicum virgatum
gtactagcctgtttccaagccagaaagggatagtagctgcctacctggctagtggctaccccaatccaatccacaagtcttgtctccctccaaaacccacacatcctgtgccaccctcgccgcgcggcgcctcacctccgcctccgtccgccgcggcgtctatttaaccgccgcaccccgcctcactccccattcgccggccgcagctccctctccgccatgcaagcgcccgcgcacaccctcgggctccgcctgccccctccctcctccgctcgcccgcgcccgggccggcgcccggccgtccgcgcggcggcggccgccactcaggcggcgccgcggcgggagacggacccgaggaaacgggtggtgatcacggggatggggtctggtgtccgtgttcgggaccgacgttggcgccttctacgaccggctcctgcagggcgagagcggggtcggccccatcgaccgcttcgacgccggcagcttccccacccggttcgcggcccagatcaggggattctcgtcggagggatacatcgacggcaaaaacgaccgcaggctcgacgactgcctccgatactgcatcgtcagcggcaagaaggcgctcgagaacgccggtctcgccaagggctccgacgcgcacgccaagcttgacaaagtgcgtgctggagttctcgtggggactggcatgggtggccttacagtgttttctgatggcgttcagaatctcatcgagaagggatatagaaagatttcacccttcttcattccatatgctataacaaacatgggctccgcgttacttgcaatggatgttggttttatgggtcctaactactcaatttcaactgcatgtgctacctccaactattgcttttatgctgctgcaaaccacatacgacgtggtgaggctgatataatcatagctggtggtactgaagctgcaattattcccattggccttggaggttttgtggcctgtagggcgctatcacagaggaatgatgacccgacaactgcatctaggccatgggacaaggagagggatggttttgttatgggtgaaggtgctggtgtactggttatggagagcctggagcatgcaatgaagcgtgatgcaccaataattgcagaatacttgggaggggcagtgaactgtgacgcttaccatatgactgatcctagatcagatggactgggtgtatcttcctgtatcaaaaagagccttgaagatgcaggtgttgcacctgaggaggtgaactacattaatgcgcatgcaacttcaacacttgctggtgacttggctgaagtaagagccattaagcaagtcttcaacaatacatccgagataaaaattaattcaacgaagtcaatgataggccattgcctaggtgcagctggtggattagaagctatagccacggtagaagctataactactggattggtgcatccgacaattaatcaatttaacccagagcctgaagttgagttcgatacagtagccaatgaaaagaagcagcatgaagtgaatgttgccatctcaaattcctttggattcggaggacacaactcggtggtagtatttgctccattcaagccgtgatccatccttgctacaaatgtatacagcctgcagcaccgtctcaccattggtaatttagagaggaatttgttagatgtagcatatgatttttcctcttctttttcaccggcttcaaaggaacaagttttgattcatcgagtgatgctgtcataattggacacagctgtttagatgccaattcttttgggcgctcctgatgtatgtcctatactatacggaaaatatgaatgtaaatcaaacagtaatccatttaatatttattgttcctttgctcccaggggtggagccagggcccgtgctgcagcatgggcctagcccagattgtccattgtaaatctgtagtatatttaatagacttagaaacagtagcattcaagactatttttggttagagcagc

SEQ ID NO: 690 - DNA, 1712 bp, Musa acuminata
ccgccttcttccggcccaagaacgagccatcaactaaaaaggacaattcgcacacgcttcctctgatctctcgagaactccgaggctccgccgcccgccaccatgcagaccctcctcctccccgccgtggacggtctccgcctctcctcccccgaacctccccccacgctccgtcgacgctccccccgcccgctcaccgccgtccgcgcctctgccgcgccgccccgcagggagacggatccgaagaagcgggtcgtgatcaccggcatggggctggtctccgtgttcggaaacgacgtcgatgcgtactacgacaagctcctccaaggggagtgcgggatcgggctgattgaccggttcgacgcgtccaagttccccacaaggttcgccggccagatcagggggttttcgtcggaggggtacattgatgggaagaacgaccggcggctcgacggctgtttgaggtattgcctggttagtggcaagaaggccctcgagagcgccggccttggtgttgggagccaaacccttaacaagattgacaaggttcgagctggtgttcttgttggtacaggcatgggtggtctttcaatcttttctgatggggttcaggctttaatagagaaaggccacaggaaaataactccatttttcattccttatgccataacaaacatgggttctgcgctacttgcaatggatattggtttcatgggtcctaactattcaatttctactgcatgtgcaacgtcaaactattgtttttatgctgctgctaatcatattcgtcgtggtgaggctgatataatgattgctggtggtactgaagctgccatcattccaattggtgttgggggttttgttgcatgtagagcattatctcaaagaaatgatgatcctaaaactgcatcaagaccatgggacaaggatcgagatggctttgtcatgggggaaggtgctggagtactggtcatggagagccttgaacatgcaatgaaacgtgatgcaccaataattgctgagtaccttggaggtgctgtcaactgtgatgcctatcatatgacagatcctagagctgatggacttggggtttcatcttgtgtccagaaaagtcttgaagatgctggagtggcaccagaagaggtcaattacataaatgctcatgcaacttccacacttgcgggggatctggcagaggtgaacgccattaaacaggttttcaaggatccatctgcgtctatgatagggcactgccttggtgcagcaggcggtttagaggctattgcaactgtgaaagccataactacaggatggctgcatccaactataaaccaattcaatttagagccagcagttgagtttgataccgtggcaaacgaaaagcagcagcatgaagttaatgttgctatttcaaactcatttggttttggaggacacaactcggttgtggtgtttgcacctttcaagccatgatcagttcaaacataatttttggggtatctgatggttacctttctctagtgaggccaggaaaagtagagttgtttcaagctgccaaattttctgccaaaggaggcaaattttgctatgagaacagtctttcttaatatgagaaaaacatttctattctttcaataaagcctttgcacctattttttttcctaattaagtcattttattgacacttttggatggcactgtattgtgatatt

SEQ ID NO: 691 - DNA, 1869 bp, Oryza sativa
gtacacacccacgaaggtgaggggccccatccaatccacacgaaatccatccccccgccgcgcgcgccaccgccaccgccaccgccaccctcgccgcggcgccgcctccactccactccaccgccgccgcctatataacccacctccacctcgcttccccggcctcgactccactgctccaccaccatgcaggcgcacgcccacacgctcgggctccgcatctccccgccgccgcctgcgccgccgcggcgccgcgctcgcccgcgccggcgcgcagtccgtgtcgccgcggcggcgtcggcgccgcggcgggagacggacccgaggaagcgggtggtgatcacggggatggggctggtgtccgtgttcgggaacgaggtggacgccttctacgagcggctgctcgccggggagagcggggtcggcgccatcgaccgcttcgacgccggcggcttccccacgaggttcgccggccagatacgcgggttctcctcggaggggtacatcgacggcaagaacgaccggaggctcgacgactgcctccgctactgcatcgtcagcggcaagaaggcgctcgagaacgccggcctcggcaagggctccgatggccacaccaagcttgacaaagtccgggctggtgttcttgtgggaactggcatgggtggcctcactgtgttttccgatggtgttcaaaaccttattgagaagggatacaagaaaatttcgcctttctttatcccatacgctataactaacatgggctcggcattgctagcaatggatgctggttttatgggtccaaactactcaatttcaacagcttgtgcgacctccaactactgcttctatgctgctgccaaccatatacgtcggggtgaggctgatgttatcgttgctggtggtactgaagctgcaattattccaattggccttggaggttttgtggcctgtagagcactatcgcagaggaacgatgacccagaaactgcatctaggccatgggacaaagagcgagatggttttgttatgggcgaaggtgctggtgtactggtcatggagagcctggagcatgcgatgaagcgggatgcaccaataattgctgaatatttgggaggtgcagtaaactgtgatgcttaccatatgactgatcctaggtcagatggactgggtgtatcgtcctgtattactcagagccttgaagatgcaggtgttgcgccagaggaggtaaattacatcaatgcacatgcaacttcaactcttgctggtgacttggctgaagtaagagccattaagcaagtcttcaagaatccatctgatattaaaatcaattcaacgaagtctatgataggccattgcctaggtgccgctggtgggttagaagctattgccgttgtcaaagccataactactggatgggtgcatcctactattaaccaatttaaccccgagcctgaagttgattttgatacagtagccaacgagaagcagcagcacgaagtgaatgttgctatctctaattcatttggatttggaggtcacaattcagtggtagtatttgcgccattcaagccatgattccaattttttgcttcagaaaatatatagcctgcagcattttctggcagttggtaattagtgaggaattgctagatgtagcatatttgattttaccggcctccatcttcaagggagaaattttgatttgagtgtaaccggattatgatcattagatgccaattcttttcgggttcccgttgtgtatgttatggtgtgacagatctgaaatagtgtaaagacatcagtgatccagctttgtcatgtgtaatttgttcgttgcgtgctttagcttcaatcttcaaagaataataa

SEQ ID NO: 692 - DNA, 1721 bp, Allium cepa
ttaaaaacccttgccgttcgctttccttatatcctttagggtttcacgatgcattccctccgctccccgacactccctcttactcctcccacttcccgccggcgatatcagcagaaatccgccagacctactcagatccgcgcttctgcctccgtagtcgctgcgccgaagcgagaaaccgacccgaagaagcgggtcgtgattacaggaatggggctagtttcggtgtttgggaacgacgtggacacgtactacgataagcttctagaaggggagagcgggatcggtttaatagatcgtttcgatgcgtcgaaatttccaaccagatttgcgggccagattcgtaatttcagcagtgaggggtatattgatgggaagaacgatcggcggttggacgattgcctccgatactgcattgttagtggaaaaaaggcgcttgaaagtgctgggattggtgttgggaccgaggagatggaaaagattgacaaggtgcgagctggtgttttagttgggacaggcatgggcggactaacagtattctctgatggtgttaaagctcttatagaaaaaggccacagaaaaatcacaccatttttcatcccatatgccattacaaatatgggatccgccttgctagctatggatatcggattcatgggtgcaaattattcaatttcaactgcttgtgctacctccaattactgcttctatgctgctgctaatcatattcgtagaggtgaggctgatataatgattgctggtgggactgaagctgctattattccaattggaattggaggttttgttgcatgcagagctttatcacagaggaacgatgaccctaaaactgcatccagaccctgggatcaaggtcgagatggctttgttatgggagagggtgctggaactttggtattggagagtttagagcatgcgttgaaacgtggtgcaccaattattgctgaatacttgggaggttccgttaattgtgatgcctaccacatgaccgatccaagagctgatggactcggagtttcaacttgtattcagagaagtcttgaagatgcaggagtgtccccagaagaggtcaattacataaatgctcatgcaacttctacacttgctggcgatttagctgaaatcaatgctatcaaacaagtctttaagaagccagatggtatcaagatcaatgctacaaagtctatgattggacattgccttggtgcttctggtggtcttgaagcaattgctacagttaaggccataactactggatggctgcaccctagcataaaccaatttaacccagaacctgctgttgagtttgatacggtgccaaacaaaaacagcaacatgaagttaatgttgcaatttcaaattcatttgggtttggtggacacaactcggtggttgtctttgctccatataagccttgatttggttcgagtgaatgaatctcattatctagaggccttggtgtctgagattatatttatggatatgaggctatcaaattgtataatttattttgcaacatttttaaggcttttcttttattagcttttagttttaggtgtttgatcagttgttaattttatctatatccatttaaacttgattgttacttgtcattccattgtattcatccatgttcagtgttgtttaacattttgtgtaagattggttttgtatttattgtttgtttgcggaattttaattca

SEQ ID NO: 693 - DNA, 1966 bp, Allium cepa
tagttacgggggatatggacggatcttccaaagtccatgatgggcaatggccgtaattaacgaaactcaactcaaagttttatactaatgtcacgatctctttcgttcacagtcagctgttccatgttttgtttcacatccaatcccacaaattgatccgctttgtctctcatctaacttcaccatcttcttcatcctcgctctcgtcgcttcttctttctataaataaaccagtttcgttattttagtctctcttcttgataaacataaagtaacctgttaaaattaaaaacccttgccgttcgctttccttatatcctttagggtttcacgatgcattccctccgctccccgacactccctcttactcctcccacttcccgccggcgatatcagcagaaatccgccagacctactcagatccgcgcttctgcctccgtagtcgctgcgccgaagcgagaaaccgacccgaagaagcgggtcgtgattacaggaatggggctagtttcggtgtttgggaacgacgtggacacgtactacgataagcttctagaaggggagagcgggatcggtttaatagatcgtttcgatgcgtcgaaatttccaaccagatttgcgggccagattcgtaatttcagcagtgaggggtatattgatgggaagaacgatcggcggttggacgattgcctccgatactgcattgttagtggaaaaaaggcgcttgaaagtgctgggattggtgttgggaccgaggagatggaaaagattgacaaggtgcgagctggtgttttagttgggacaggcatgggcggactaacagtattctctgatggtgttaaagctcttatagaaaaaggccacagaaaaatcacaccatttttcatcccatatgccattacaaatatgggatccgccttgctagctatggatatcggattcatgggtgcaaattattcaatttcaactgcttgtgctacctccaattactgcttctatgctgctgctaatcatattcgtagaggtgaggctgatataatgattgctggtgggactgaagctgctattattccaattggaattggaggttttgttgcatgcagagctttatcacagaggaacgatgaccctaaaactgcatccagaccctgggatcaaggtcgagatggctttgttatgggagagggtgctggaactttggtattggagagtttagagcatgcgttgaaacgtggtgcaccaattattgctgaatacttgggaggttccgttaattgtgatgcctaccacatgaccgatccaagagctgatggactcggagtttcaacttgtattcagagaagtcttgaagatgcaggagtgtccccagaagaggtcaattacataaatgctcatgcaacttctacacttgctggcgatttagctgaaatcaatgctatcaaacaagtctttaagaagccagatggtatcaagatcaatgctacaaagtctatgattggacattgccttggtgcttctggtggtcttgaagcaattgctacagttaaggccataactactggatggctgcaccctagcataaaccaatttaacccagaacctgctgttgagtttgatacggtgccaaacaaaaaacagcaacatgaagttaatgttgcaatttcaaattcatttgggtttggtggacacaactcggtggttgtctttgctccatataagccttgatttggtttgagtaaatgaatctcattatctagaggctttggtgtctgagattatatttatggatatgaggctatcaaattgtataatttattttgcaacatttttaaggtttttctttcattagcttttagttttaggtgtttgatcagttgttaattttatctatatccatttaaacttgattattacttgtcattccattgtattcatccatgttcagtgttgtttaacattttgtgtgaga

SEQ ID NO: 694 - DNA, 1705 bp, Allium cepa
agtttcgttattttagtctctcttcttgataaacatcgagtaacctgttaaaattaaaaacccttgccgttcgctttccttgtatcctttagggtttcacaatgcattccctccgctccccgacactccctcttactcctcccacttcccgccggcgatatcagcagaaatccgccagacctactcagatccatgcttctgcctccgtcgccgctgcgccgaagcgagaaaccgacccgaagaagcgggtcgtaattacaggaatggggctagtatcggtgtttgggaacgacgtggacacgtactatgagaagcttctagaaggggagagcgggatcggtttaatagatcgtttcgatgcgtcaaaatttccgaccagatttgcgggccagattcgtaatttcagcagtgaggggtatattgatgggaagaacgatcggcggttggacgattgcctccgatactgcattgttagtggaaaaaaggcgcttgaaagtgctgggattggtgttgggaccgaggagatggaaaagattgacaaggtgcgagctggtgttttagttgggacaggcatgggtggactaacagtattctctgatggtgttaaagctcttatagaaaaaggccacagaaaaatcacaccatttttcatcccatacgccataacaaatatgggatccgccttgctagctatggatatcggattcatgggtgcaaattattcaatttcaactgcttgtgctacctccaattactgcttctatgctgctgctaatcatattcgtagaggtgaggctgatataatgattgctggtgggactgaagctgctattattccaattggaattggaggttttgttgcttgcagagctttatcacagaggaacgatgaccctaaaactgcatccagaccctgggatcaaggtcgagatggctttgttatgggagagggtgctggaactttggtattggagagtttagagcatgcattgaaacgtggtgcaccaatcattgctgaatacttgggaggttccgttaattgtgatgcttaccacatgaccgatccaagagctgatggactcggagtttcaacttgtattcagagaagtcttgaagatgcaggagtgtctccagaagaggtcaattacataaatgctcatgcaacttctacacttgctggcgatttagctgaaatcaatgctatcaaacaagtctttaagaagccagatggtatcaagatcaatgctacaaagtctatgattggacattgccttggtgcttctggtggtcttgaagcaattgctacagttaaggccataactactggatggctgcaccctagcataaaccaatttaacccagaacctgctgttgagtttgatacggtgccaaacaaaaaacagcaacatgaagttaatgttgcaatttcaaattcatttgggtttggtggacacaactcggtggttgtctttgctccatataagccttgatttggttcgagtgaatgaatctcattatctagaggccttggtgtctgagattatatttatggatatgaggctatcaaattgtataatttattttgcaacatttttaaggcttttctttcattagcttttagttttaggtgtttgatcagttgttaattttatctatatccatttaaacttgattattacttgtcattccattgtattcatccatg

SEQ ID NO: 695 - DNA, 2089 bp, Eucalyptus grandis
ctctctctctccgccatgcagtccctccactccccgtccctccgcggcgcctcccccctcgacccgctccgcgccgccgccccccgccgccgccgcccggcccccgggcgcgtcgccgtcgtcagggccgcatccatgtccgccccgccgaagcgggagacggaccccaggaagcgggtcgtcgtcaccgggactgggctcgtctccgtcttcggcaacgacgtcgacgcctactacgagaagctgctcgccggggagagcgggatcggcccgatcgaccgcttcgacgcctccaagttccccacccgcttcgccgggcagatccgcgggttctcgtcgcaggggtacatcgacgggaagaacgaccggcggctcgacgattgcttgcgctactgcattgtcgccggcaagaaggcgcttgagcatgctgatctcggcggcgataggctctccaagatcgaaaaggagcgagccggtgtacttgttgggacgggtatgggtggtttgactgtattctccgatggagtaaagaatctaattgagaaaggtcacaggaagataacccccttctttattccttatgccataacaaatatgggatctgccttaattgccattgaacttggtttcatggggccaaattattccatctcaactgcatgtgccacttccaactattgcttttatgctgctgccaatcacatccgtcggggtgaggctgatctgatgattgctggtggaactgaagctgccattattcccattggcttgggtggtttcgttgcgtgcagagccttgtctcagagaaatgatgatccacaaactgcatcaaggccttgggataaagatcgcgatggttttgtcatgggtgaaggagcaggagttttggtattggagagcttggagcacgcaatgaaaagaggtgcaccaattattgctgagtatttgggaggtgcagttaactgtgatgcttatcacatgactgatccaagggctgatggacttggtgtttcctcttgcattgagaggagccttgaagatgcgggggtgtcaccagaggaggttaactacataaatgcacatgcaacctcaactcttgctggggacctggccgagattaatgccataaaaaaggtgttcaaaaatacctcagagatcaaaataaatgcaaccaagtctatgattggacactgtcttggtgctgctggaggtttggaagctattgccacagtgaaagcaatcacaacagggtggcttcatccctctattaaccaatttaatcctgagccctctgtggattttgacactgttgcaaacaagaagcagcagcatgaagtgaatgttgccatatcaaactcgttcggatttggaggacacaactctgtggtggccttctcagcattcaagccttgatcatgttggattattattacgggtaacctgaagattcatctcattcatgggagatctcggaattaatttctcattgagagctgccttatctgctaatagtttagatttgcctgatgccctgtatgtcattcgcaattattcaaaatttagtgtctgccaactaggggaagaactttttatgtcatttctatatttaaaaagaagctatttaatagttgcaagagattttgttcaatttgggtcatcttttggcagaggagatgctctaggttatgtattaagtgatggtcatggaagggtatctttgcaaaagttctctttccgtggaagaactctgtttcggtagaagtgtgtgttcttgctcgtgtgggatgagatgtgtcactggtaagtaaaagatcttcaattttttggctgagaaaagtatctccaatcttagcatcacttctaagcaagtttggaccaagcttagagagtggttgctcttagtggcacagctgtttgcattcaagcccgttatcttcccgttgcggaacattggtgcactgataatgtgaaattctttgagctggtgttgtttcaatttatttagacaggagcattgcgcaatctgattactgaactttaataccaagaaagtattgcagcgagaccaatcatttcttatctgattttc

SEQ ID NO: 696 - DNA, 1762 bp, Avena sativa
cgcatctccgtccgcgcctcggcaacggcggcggctgcgcccccaggcgcgagacggatccgaagaagcgggtggtgatcacggggatggggctggtctccgtcttcgggaacgacgtagacacctactacgacaggctgctcgcgggggagagcggcatcggcctcatcgaccgattcgacgcctccaaattccccacgcgattcgcaggccagatccacggcttctcctccgagggctacatcgacggcaagaacgaccggcgcctcgacgactgcctacgctactgcatcgtcagcggcaagaaggctctcgaatccgccggcctcgcgctcggctccgactccatggagaagattgacaagtctcgggctggtgtacttgtgggcactggtatgggtggcctccaagtgttttctgatggtgttcagaatcttatcgagaagggccacaggaagattactcctttcttcatcccatatgccataacgaacatgggatctgcacttcttggcatggacattggtttcatgggtccaaactactctatttcaacagcatgtgctacatcaaactactgtttctacgccgcagcaaaccatattcgtagaggtgaagcagatattatggttgctggtggcactgaagccgccattattccgattggtgttggtgggtttgttgcatgcagagcactgtcacagaggaatgatgaccctaaaacagcatctaggccttgggacaaggaacgtgatggtttcgtcatgggtgaaggagctggaatactggtcatggagagcttagaacatgctatgaaacgtggtgctccaatagttgcggagtatttaggaggtgctgtgaactgtgatgcttaccatatgactgatcccagagccgatggtcttggtgtttcatcatgcattagacaaagtcttcaagattctggtgtggcaccagaggaggtcaactacatcaatgctcatgcaacttccactcttgctggtgatttggcagagatgaatgccatcaagcaagtctttaaggacccaactgggattaaagtaaacgcaaccaagtccatgataggacattgcctcggtgcagcaggtggtttggaagccattgccgttattaaagcgataaacactggattggtgcatccgagcataaaccagtttaaccgggaggaggcggttgaatttgacaccgtacctaacgtgaaagccgaacatgaagtgaatgttggtatctcaaattcttttggatttggaggacacaactcagtggtagtatttgctccattcaagccttaatgtggtggcacttgctccacaagtcttggtcgaaacagtgagggttttttccggaagctccccgttatttcaatgtgttttctttggtgaagcaactgccccacctgacatccatcagcgctacaatgaacagaggacatgagatccattgcgtttttagatacatctatcttggattagatcgagagcacaccgtgtgacgttttttttccatcatctgcagtccgagtctacctatttcccgtgagacaaaagtcagggaatttctaggtgtgtcatgtagaagcaacaattagatcttctgctttatagagagtgcattgaacgccaaagagtctgtgtgtactagtacattgtccggggaaaatctatatactatcacaattttctgttgtatccagtatgctagtgtgccctgccaggcaaataaaaattgtatggctttcagt

SEQ ID NO: 697 - DNA, 1778 bp, Allium cepa
aataggcatttcctctccgatttaatccattccaattttcttactcctccttttctctctcctatatttttgcactatgcagtccctccgaactcccacacttcccgtcgctcctccactctccagccgccgttcccgccggagctccgctgccctcaacccgatccgtgcctcatcatctaccgtctcaatccctaagcgtgaatccgaccccaaaaaacgggttgtgattacaggaatggggttggtgtcggtcttcggaaatgacgtggatacctactacgataagcttttacaaggggagagcggaattgacttaatagatcgcttcgatgcgtccaaatttccgactagatttgcagggcagattcgtaattttagcagcgaaggatatattgatgggaagaatgatcgaaggttggatgattgtttgaggtattgtatcgttagtgggaaaaaagcgcttgagagcgctggcattggtgttgggaccaaagagctggaaaagattgacaaggtgcgagctggtgttttagttgggacaggcatgggtggactccaagtgttttccgacggtgttcaagctcttatagagaaaggttacagaaaaatcactccattctttatcccatacgctataacaaatatgggatctgctttgcttgccatggatattggattcatgggtgcaaattattcaatctcgactgcttgtgctacatccaactactgtttttatgctgctgctaatcatatccgtagaggtgaggctgatattatgattgctggtgggactgaagctgctattattcccattggaattggaggttttgttgcctgtagagctttatctcaaaggaatgatgatccaaaaactgcatctagaccttgggatcagggccgagatggatttgtcatgggagagggtgctggaactttggtattggagagcctggagcatgcattaaaacgtggagcgccaattatagctgaatacttgggaggtgccgttaattgtgatgcctaccacatgacagatcctagagctgacggacttggtgtttcaacttgcattcagagaagtctagaagatgcaggagtttctcatgaagaggtcaattacataaatgctcatgcaacttctacacttgttggggatttggctgaagtgaatgctataaagcaagtcttcaaggacccaacgggtatcaagatcaatgctacaaagtctatgatagggcactgccttggtgctgctggtggtcttgaagcaattgccacaattaaggccataactactggatggctgcatcctagcattaaccaatttaacccagaacctgctgttgacttcgatacagtcccaaacaaaaaacagcaacatgaagttaatgttgcaatttctaattcattcggattcgggggacataactcggtggtggtctttgctccatataagcgttgaatttcccaagtttaaatatttagattatctagtggcgttggacgcagttgagattatatacccagagatgtggctatcaatttgtataatttattttgcaaaattttcaaggttggtagttttaggtgatttgatcattatattgttgatacctatttaaacttcgttgacacaccgttctattacattcttcattattttgatgtaatatattgctgaaaatgtgaagacataatttggtgttgcaatggttgatgtgctacattgtctggaaactatcacggttttataatcattcaggtaagaaatatta

SEQ ID NO: 698 - DNA, 1648 bp, Secale cereale
gactccccgcttatataaccacctctctcgctctcgcctgcccaactgcaagctccgccatgcacgcccacgccccccacgccctcggcctccgcgtccctccccccacgttcccccgccgccgtgctcgcccgcgacggcgccccgccgcggccgtccgcgcctcggcgtccacctcggcgccgccgcagagagagacggatcctaggaagcgggtggtgatcacggggatggggctggcgtccgtgttcgggaacgacgtggacacattctacgaccggctcctggccggtgagagcggcgtcgggcctatcgaccggttcgacgccagcagtttccccacgaggttcgccgggcagatacgggggttctcgtcggaggggtacatcgacggcaagaacgaccggaggctcgacgactgcatccggtactgcatcctcagcggcaagaaggcgctcgagagcgccgggctcggcgcaggctccgacgcgcacggcaagcttgatgtggggcgggctggtattcttgtggggagtggcatgggtggcctttccgtattctccgatggtgttcagaaccttattgagaagggatacagaaaaatttcacctttctttatcccatatgctataactaacatgggttcagccttgcttgccatggatgttggtttcatgggccccaactactcaatttcaactgcatgtgcaacctccaactactgcttttatgctgccgcaaaccatattcgtcgtggtgaggctgatatcatcgtcgctggtggaactgaagctgccatcattccaatcggccttggaggttttgtagcatgcagagcattatcacaaaggaacgatgacccagtaactgcatctaggccatgggataaagagcgagatggctttgttatgggtgaaggtgccggtgtactggttatggagagcctggagcacgcaatgaagcgtgatgcaccaataattgctgaatacttgggaggtgcggtcaactgtgatgcataccatatgactgatcctagatcagatggactgggtgtatcatcctgtattacaatgagtctcagagatgcaggtgttgcaccagaggaggtgaactacatcaatgcacacgcaacttcgacacttgctggtgacttggctgaagtaagagccattaagcaagttttcaagaatccatctgagatcaagatcaattctacaaagtccatgacaggccattgcctgggtgcagcaggtgggttagaagctatcgctactatcaagtccataaccactggatgggtgcatcctaccattaaccaatttaacccagagcctgaagttgattttgatacagtagctaacgaaaagaagcagcatgaagtgaacgttgctatttctaactcgtttgggtttggagggcacaattcggtggtggtattcgcgccattcaagccgtgattcgccatcgcttcagagatgtaggatccgcgacatcctctttattagatgttagcctgcttgaatttaccggcttttattcatccccgtgtagcaagttttgatgatcggtagagtggtgctgccttcaccgggacactgttgtttatatgatcattctttcgggcgctcctcgtgtgtaccatgctgta

SEQ ID NO: 699 - DNA, 1692 bp, Ananas comosus
cgccgccgccgcggagggagacggatccgaagaagcgggtggtgatcaccgggatggggctggtctcggtgttcgggaacgacgtggacgcgtactacgagaggcttctggaaggggagagcgggatcgggctcatcgaccgcttcgacgcgtccaagttcccgacgaggttcgcggggcagatcagggggttcacgtccgaggggtacattgatgggaagaacgatcgccggctcgacgattgcctcaggtattgcctcgtgagcggcaagaaggcgctccagagcgctgggctcggcgtcggtaccgaggcgcttaagaagattgaaaaggtgcgagctggtgtacttgtggggactggcatgggtggcctcacagtgttctctgatggtgttcaggcccttatagagaaagggtacaggaaaataactccatttttcattccttatgccataacaaacatgggctctgcattgcttgcaatggatattggtttcatgggtgcaaactattccatttcaactgcatgtgctacctccaattactgcttctatgctgctgcaaatcatattcggcggggtgaggctgatataatgcttgcgggtggtacagaagctgcaataattcctattggtgtcggcggttttgtagcatgtagagcattatctcagaggaatgatgatccaaaaactgcttcaaggccgtgggacaaggatcgagatggttttgttatgggtgaaggtgctggagtattggtaatggaaagcctagaacatgcaatgaaacgtgatgcaccaataattgccgagtacttgggaggtgctgtgaactgtgatgcttatcatatgacagatcctagatctgatggtcttggtgtttcatcttgtattgggaagagtcttgaagatgctggagttgcaccagaggaggttaattacataaatgcccatgctacttcaactcttgctggcgacctagcagaggtgaatgctattaaaaaggttttcaaggacccatcgcaaattaaaatgaatgcaacaaagtccatgatagggcactgccttggtgcggccggggggctggaagcaattgcaactatcaaagccataaatactggatggctgcatccctccattaaccaatttaatccagagcctgcagttgaattcgacacagtagcaaacaaaaagcagcagtatgaagtgaatgttgctatatctaattcatttggatttggaggacacaactcggtggtggtatttgcacctttcaagccatgatccatctttcatcggggtgataggaaaaatttccactgttgaagttggattatttgtgcctactcggcttctttctacgtagtatgatttgagtttttggcttgaagagcgagctatcattttacaccggaacctaggttccttcattgtcaagggaaaccctatcttgagctttctttagccccgttttatatctttatttttgcgtcgttatgttgtgagaaactcaaaatttcttggaaattatttcggatatctgatgagaaatattcttttcctttcctaggggaaattcttttctcttgtgcttaaaccgttcactgcatgaagtataggataagatcagtagccgaacagaggggttagtgttactaccttgtaaggtagtttaaagcaaaccgcgcaacacgat

SEQ ID NO: 700 - DNA, 1254 bp, Lolium multiflorum
gaagcgggtggtgatcaccgggatggggctcgtctccgtcttcggcaacgacgtcgacgcctactacgaccgcctgctcgccggggagagcggcatcggccccatcgaccgcttcgacgcctccaagttccccacgcgcttcgcgggccagatccacggcttctcctccgagggatacatcgacggcaagaacgaccgacggctagacgactgcctgcgatactgcatcgtcagcggcaagaaggcgctcgaggccgcgggactcgcgctcggctccgacgccatggacaagattgacaagtctcgggctggtgtacttgtgggcactggtatgggtggcctccaagtgttctctgacggtgttcagaatcttatcgagaaggggcacaggaagattactcctttcttcatcccatatgccataacaaacatgggttctgccctgcttggcatggacattggtttcatgggtccaaactactctatttcaactgcctgtgctacctcgaactactgtttctacgctgcagcaaaccatattcgcagaggcgaagcggatgtgatgattgctggtggcactgaagctgccattattccgattggtgttggtggttttgttgcatgcagagcactttcacagaggaatgatgaccctaaaacagcatctaggccttgggacaaggaacgtgatggtttcgttatgggtgaaggagctggattactggtcatggagagcttagaacatgctatgaaacgtggtgctccaatagttgcggagtatctaggaggtgctgtgaactgtgatgcttaccatatgactgatccaagagccgatggtcttggtgtttcatcatgcattagacaaagtcttcaagatgctggtgtggcaccagaggaggtcaactacatcaatgctcatgcaacatccactcttgctggtgatttggcagagatgaatgccatcaagcaagtctttaaggatccaaccgggatcaaagtaaacgcaaccaagtccatgataggacattgcctcggtgcagcaggcggtttggaagccattgccgttattaaagcgataaacactggattggtgcatccaagcataaaccagtttaaccgggaggaggtgattgaatttgacacggtacctaacgtgaaagccgagcatgaagtgaatgttggtatctcaaattcttttggatttggaggacacaactcagtggtagtgtttgccccattcaagccctaatgggc

SEQ ID NO: 701 - DNA, 1925 bp, Cajanus cajan
gaaaataaataagagcagaagtagtgaattggttgtactaacagtgtagcatttgagcagagagggttgagttgtgtgcttcgtagtctccgccataatgcaagcgcttcaatcccccactctccgcgcttctccgttggacccgcttcgtgaccacaagaggaggtccaccgccgccaagcgcgtcttcttcgtgtcagcgacggcggcgcccaaggtctccgcgccgcagcgccagaaggacccgaagaagcgcgtggtgatcaccggaatgggcctggcctccgtcttcggcaacgacgtggacggctactacgagaagctcctctccgggcagagcggcatcacccccatcgaccgcttcgacgcctccaagttccccacccgcttcggcggccagatccgcggcttctccgccgagggctacatcgacgggaagaacgaccgccgcctcgacgactgcctccgctactgcattgtcgccggcaagaaggccctcgaaagcgccgacctcgccgccgagaaccgctccaagattgataaggagcgtgctggtgttctggttgggtccggaatgggtggtttaacggttttctcggacggcgttcaggctctgattgagaaggggcaccgtaagataacgccgtttttcattccctatgccattactaacatgggttcggctttgcttgggattgaccttggcttcatgggtcccaattattctatttccacggcttgtgctacttccaactactgcttctatgctgcggccaaccatattcggagaggggaggctgatttgatgatcgccggtgggactgaggctgccattatccccattggattggggggtttcgttgcttgcagggcgctctcgcagaggaatgatgaccccaaaactgcttccaggccttgggataaggatcgtgatggctttgttatgggtgaaggtgctggagttttggtgatggagagcttggaacatgccatgaagcgtggggctcctataattgccgaatacttgggaggtgctgttaactgtgatgcttatcacatgactgatccaaggtctgatggacttggtgtgtcttcatgcattcagagcagtcttgaagatgctggcgtgtcacctgaggaggtcaactacataaatgcacatgcaacttccacacttgctggtgacttggcagagattaatgctattaaaaaggttttcaaggacacttctggcatcaaaattaatgccaccaagtctatgatagggcactgccttggtgcagctggaggtttggaagccattgccacagtgaaagccataacaacaggatggctgcatccaaccatcaatcaatttaatccagaacctgcagttgattttgataccgtcgcaagtgtcaaacagcagcatgaagtcaatgttgccatttcaaattcatttggattcggtggacacaactctgtggtggcattttctgctttcaggccctgattgccatgtctgcacttttatgtagaacacgggtttaatttaattgaaattttgttctttttacatcatttgaggctatctattctattcgagtccttcatatataaaagctgtaggcctgtagttgttcatttgtgctaattgtgacttgacaattagctttaagacttttgttgtagaacttttttaatatagctcgaagatttctttagtttggaggtatacggtggatagaatgtcaaaagagcttatattcttcagtattcttattgttaagatgtttactattaggattgtaaccaagataaacttgctgattgctatgaatctttgtagcatcaggggtttatttgaatccaagttattcggcttcttgcgcgcatgggtgataccttattatttcagagcagtttcactttcacgagtttcaaga

SEQ ID NO: 702 - DNA, 2012 bp, Setaria italica
cccagcaggctgcctacttcgctttctaccccaatcccatccggtcatccacaagtccgtctccctccaaaacccacacatcctctgccaccctcgccgcgcggcgcctccgcctccgcccccgccgcggcgtctacataaccgccataaccaccgcacccacctcgctcccccattcgtcggccgcagctccgtctcccgccatgcaagcgcccgcacacaccctcgggctccgcctgccccctccttcctcctccgcacgccgccgcgctcgccggcccgtccgcacggcggcggcggcggccacccaggcggcgccgcggcgggagacggaccccaggaagcgggtggtgatcacggggatggggctggtgtccgtgttcgggagcgacgtgggcgccttctacgaccggctcctgcagggcgagagcggggtcggccccatcgaccgcttcgacgccggcagcttccccacccggttcgcggcccagatcagggatttctcgtcggaggggtacatcgacggcaagaacgaccgcaggctcgacgactgcctccggtactgcatcgtcagcggcaagaaggcgctcgagaacgccgggctcgccaagggctccgacgcgcacgtcaagcttgacaaagtgcgtgctggagttctcgtggggactggcatgggtggccttactgtgttttctgatggcgttcagaatctcatcgagaagggatacagaaaaatttcgcctttctttattccgtatgctataacaaacatgggctcagcgttgcttgcgatggatgttggtttcatgggtcctaactattcaatttcaactgcatgtgccacctccaactattgcttttatgctgctgccaaccatatacggcgtggtgaggctgatatcatcgttgctggtggtactgaagctgcaattattcccattggtcttggtggttttgtggcctgtagggcactatcacagaggaacgatgacccgacaactgcatctaggccatgggacaaggagagagatggttttgttatgggcgaaggtgctggtgtactggttatggagagcctggagcatgcaatgaagcgtgacgcaccaataattgcagaatacttgggaggggcggtaaactgcgacgcttaccatatgactgatcctagatcagatggactgggtgtatcatcctgtatcacaaagagccttgaagatgcaggtgttgcaccggaggaggtgaactacatcaatgcgcatgcaacttccacacttgctggtgacttggctgaagtaagagccattaagcaagtcttcaacaatacatctgagataaaaattaactcaacaaagtcaatgataggccattgcctaggtgcagctggtggattagaagctattgccacggtagaagccataactactggatgggtgcaccctaccattaatcaatttaacccagagcctgaagttgagttcgatacagtagccaatgaaaagaagcagcatgaagtgaatgttgccatctctaattcctttggattcggaggacacaattcggtggtagtatttgctccattcaaggcatgattcgtccttgatacatacgtatacagcctgcagcatgttctcacgattggtaatttagtgaggaatttcttagatgtagcatatgatttttcctcttctttttaaccagcttcaaaggatcaagttttgattcatcgagttatgctgccaaaagcagatttgtttgtttatatgccaattctttcgggtgctcctcatgtatgtgtatccactctattggcctctctgctcgatcaggtatataggcattgccagaattgatttttggcgggcaaataagccacggtctcccatcccaatgcctgcctcgaggtcgaggaggagagaggggggtatcgtaccatggacggaacgtgggaaaccggtcttcctgccggccgacgcgtcggtttccaaccagcccaaaccacccccgccgccggc

SEQ ID NO: 703 - DNA, 1999 bp, Setaria italica
cccagcaggctgcctacttcgctttctaccccaatcccatccggtcatccacaagtccgtctccctccaaaacccacacatcctctgccaccctcgccgcgcggcgcctccgcctccgcccccgccgcggcgtctacataaccgccataaccaccgcacccacctcgctcccccattcgtcggccgcagctccgtctcccgccatgcaagcgcccgcacacaccctcgggctccgcctgccccctccttcctcctccgcacgccgccgcgctcgccggcccgtccgcacggcggcggcggcggccacccaggcggcgccgcggcgggagacggaccccaggaagcgggtggtgatcacggggatggggctggtgtccgtgttcgggagcgacgtgggcgccttctacgaccggctcctgcagggcgagagcggggtcggccccatcgaccgcttcgacgccggcagcttccccacccggttcgcggcccagatcagggatttctcgtcggaggggtacatcgacggcaagaacgaccgcaggctcgacgactgcctccggtactgcatcgtcagcggcaagaaggcgctcgagaacgccgggctcgccaagggctccgacgcgcacgtcaagcttgacaaagtgcgtgctggagttctcgtggggactggcatgggtggccttactgtgttttctgatggcgttcagaatctcatcgagaagggatacagaaaaatttcgcctttctttattccgtatgctataacaaacatgggctcagcgttgcttgcgatggatgttggtttcatgggtcctaactattcaatttcaactgcatgtgccacctccaactattgcttttatgctgctgccaaccatatacggcgtggtgaggctgatatcatcgttgctggtggtactgaagctgcaattattcccattggtcttggtggttttgtggcctgtagggcactatcacagaggaacgatgacccgacaactgcatctaggccatgggacaaggagagagatggttttgttatgggcgaaggtgctggtgtactggttatggagagcctggagcatgcaatgaagcgtgacgcaccaataattgcagaatacttgggaggggcggtaaactgcgacgcttaccatatgactgatcctagatcagatggactgggtgtatcatcctgtatcacaaagagccttgaagatgcaggtgttgcaccggaggaggtgaactacatcaatgcgcatgcaacttccacacttgctggtgacttggctgaagtaagagccattaagcaagtcttcaacaatacatctgagataaaaattaactcaacaaagtcaatgataggccattgcctaggtgcagctggtggattagaagctattgccacggtagaagccataactactggatgggtgcaccctaccattaatcaatttaacccagagcctgaagttgagttcgatacagtagccaatgaaaagaagcagcatgaagtgaatgttgccatctctaattcctttggattcggaggacacaattcggtggtagtatttgctccattcaaggcatgattcgtccttgatacatacgtatacagcctgcagcatgttctcacgattggtaatttagtgaggaatttcttagatgtagcatatgatttttcctcttctttttaaccagcttcaaaggatcaagttttgattcatcgagttatgctgccaaaagcagatttgtttgtttatatgccaattctttcgggtgctcctcatgtatgtgtatccactctattggcctctctgctcgatcaggtatataggcattgccagaattgatttttggcgggcaaataagccacggtctcccatcccaatgcctgcctcgaggtcgaggaggagagaggggggtatcgtaccatggacggaacgtgggaaaccggtcttcctgccggccgacgcgtcggtttccaaccagcccaaaccac

SEQ ID NO: 704 - DNA, 2020 bp, Aristolochia fimbriata
gccgcggtgcgtttctctctcactgactgtgtgagtcgtgacagcgtgagtgagtctgtgtctttggctgtggagatctccgggtccccctctctctcgtcagtcgtcccggccgttttgttttccccagacaatcgaattgctttcattttgagctgttgcgcttaacagatttcgttcaaactctctcgcgctcttctccttagcctcctccacttccccaacatgcagaccctccaggttcaggccccttccctccgggtctcgccatcggaccgtcttccccggcgattcacgcccttccctctacttcgccgccccaatgtccgacgctctcatcccggatctttcgtacgggcttccctctccggggctcccaaccgagagacggatcctaagaagagggtggtcatcactggcatgggtcttgtttcagtcttcgggaatgacgtcgatacctactacgaccgcctcctctcgggtgagagcggcatcggccctatcgacaggtttgatgcttccaagttccccaccagattcggtggtcagatccggggcttcacctccgatggttacatagatgggaagaacgatcggcggctcgatgattgcctcaggtactgccttgtcagtggcaagaaggctctagagaatgcgggcctgggaggcaccgatatttccaagattgacaaggagcgagctggtgtgcttgttgggactggcatgggtggtcttacagtgttctcagatggtgtccaagctcttatagagcgtggatatcggaaaattactccattttttattccatatgctataacaaacatgggttccgcgctgcttggaattgaacttggtttcatgggtcccaactattctatatctactgcttgtgctacttccaattattgtttctatgctgctgctaaccatatccggagaggtgaagctgatctaatgcttgctggtggaactgaagctgcaataattcctattggtttaggtggatttgttgcttgtagagccttatcacaaaggaatgatgatccacagacagcttcaaggccgtgggacaaggaccgagatggttttgttatgggtgaaggagctggggttttggtgatggagagtcttgaacatgcaatgaagcgtggtgcacccataattgctgagtatttgggtggagctgtaaactgtgatgcttatcatatgacggatcctcgtgcagatggactaggggtttcatcgtgcatagagagaagtctagaagatgctggggtggcaccggaagaggttaactacattaatgcacatgccacttccacactcgctggcgatctagcggagataaatgctataaagaaggtcttcaaggacacttcagggatcaaaataaatgcgactaagtcgatgattggtcattgtcttggagcagctgggggcctagaagccattgccacagtgaaagcaattactactggatggctgcatccctcaataaaccaatttaacccggagccttctgttgagtttgatacagtggctaatcaaaagaagcagcatgaagtgaatgttgctgtttctaattcctttggatttggcggacacaactcggtggtggtcttttctgcattcaagccttgatttttagtttgttccgcaattttgttcttgctttgtgcaagctctcctgttcacttcccgagtgttttggtactcacctgtggttggtttctctttcatttttcctcacgccgtccatttgaataggccaaatagttgctagtgggtggtgatattttttggtgtaatgtaatgcaagttaatggagtaactttgatctaggatcaggaatcctagctagttgagggatgaggtgattagtcgtttcactgttgtagcgatgttttgaaatgttttttagagtaatgcattcctgaaatttcaaaaagctctcgctcactggttccgtcggcgtcgtagagtcaaccaggatcggcggccttcactggatcaatctggc

SEQ ID NO: 705 - DNA, 1841 bp, Hordeum vulgare
aagcgggtggtgatcacggggatggggctggtctccgtcttcggcaacgacgtcgacgcctactacgaccgcctgctcgctggggagagcggcgtgggccccatcgaccgcttcgacgcctccaagttccccacgcgcttcgccggccagatccggggcttctcctccgaggggtacatcgacggcaagaacgaccgcaggctcgacgactgcctccgctactgcatcgtcagcggcaagaaggcgctcgagtccgccgggctcccgctcggctccgacgccatggccaagattgacaaggcccgtgctggtgtacttgtggggactggtatgggtggcctccaagtgttttctgatggtgttcagaatcttctcgagaagggctacagaaagataacccctttcttcatcccatatgccataacaaatatgggatctgccctgcttggcatggacattggtttcatgggtccaaactactctatttcaactgcctgtgctacttcgaactattgtttctatgcggcagcaaaccatattcgcaaaggtgaagcagatatgatgattgctggtggaactgaagccgccattattccgattggtgttggtgggtttgttgcatgtagagcactatcacagaggaacgatgaccctaaaacagcatctaggccttgggacaaggagcgtgatggtttcgttatgggtgaaggagctggagtattggtcatggagagcttagaacatgcaatgaaacgtggtgctccaatagtagcagagtatctaggaggtgctgtgaactgtgatgcttaccatatgactgatccgagagccgatggtctcggtgtttcatcttgcatcagacagagtcttcaagatgctggtgtggcacctgaagaggttaactacataaatgctcatgcaacatccacccttgctggtgatttggcagagatgaatgccatcaagcaagtctttaaggacccatctgggataaaagtaaacgcaaccaagtccatgatagggcattgcctaggtgcagcaggtggtttggaagccattgctactattaaagcgataaacactggattggtgcatccgagcataaaccagtttgaccgggagcctgcggttgaatttgacacggtacccaacgtaaaggccgaacatgaaatcaatgttggtatctcgaattcctttggatttggaggacacaactcggtggttgtattcgccccattcaagccttgatgcgacacatggtccagaaatcttggtcagaacagcgaatgtttttttcaggaagctccgagttattttcgatgtgttttcttacgggaagcaattgtcgatttgactgccagcaacattacagtgaacagaggatccaagatccattgcattttagatacacccatctccgattagattgagagcgctgtgtaaccttctgcattatttgcagttgttctacttgttttcgtgtaatttatcatgtagaagcaaacactagttcttctgttccgtagagagagtgcattggaaggcaaggagctgtttgtctgtactacttgatctgggggaaatctatactatcacaagttttttgctgtttccagtccctttgttgtctaataaaaactgtaatgtttcagtcttacgggtggcgctcggtcaaaaatggtcctgcatcctgaatgaaatttttgattctgttgtcggactgagctgagatcgaagtcctttgcagccacatctgaatgtgtcgaattttgctgagaaactgttccaaattgtacgtagaatctgaatacttttgttcttaataaaacatcttacccagt

SEQ ID NO: 706 - DNA, 1803 bp, Vitis vinifera
acatctcagtgctccacgctcatcttcactctcctcttcgcctctctcctccgacgtcaccaccgccgtcgcaaccatgcacgtcctccaatcaccggctctctgccccacgccgccccatcgccttggtcggttcaatgccaaacagcctcgaaagaaagtgtcattcatattatccgccgcctcccccactgtcgctgcgcccaagcgcgaaaaggatccgaagaagcgggtggtgatcaccggaatggggctcgtctccgtctttggaaacgacgtcgacgcctactacgagaagctgctcgctggtgagagcggcatcagcccgattgatcggttcgatgcctctaaatttccgacacggttcggcggccagatccgcggattcgactcccaaggttacattgacggcaagaacgataggcggctcgatgactgccttcgctattgcattgtcgctggaaagaaagctctcgaagacgccgatcttggtggtgctgatatctcgaagattgataaggagcgagctggtgtgcttgttggaactgggatgggtggtcttacagtgttctctgatggtgttcaggctctaatagagaggggtcatagaaaaataaccccatttttcattccttatgctatcacaaacatggggtctgccttgcttgcaatcgatcttggttttatgggtccaaactactcaatttcaactgcttgtgctacctccaattattgcttctatgctgctgctaatcacatccgccgtggggaggctgatttgatgattgctggtggaactgaggctgccattattcccattggcctaggtggttttgttgcttgtagagctttatctcagagaaatgatgatcctcaaactgcttcaaggccatgggacaaagatcgagatggttttgtcatgggtgaaggtgctggtgtattggtaatggagagcttggaacatgcgatgaaacgaggtgctccaattattgctgagtacatgggaggtgcagttaactgtgatgcttatcatatgactgatccaagatctgatgggcttggtgtttcatcgtgcattgagagcagccttgaagacgctggtgtgtcaccagaggaggttaactacataaatgcgcatgcaacctctactattgttggtgacttggctgaagtgaatgccataaaaaaggtattcaagagcacttcagagatcaaaatgaatgcaaccaagtctatgatagggcattgccttggtgctgctgggggtttggaagctattgcaacagtgaaagccataactacaggctggctgcatcctaccataaatcaatttaatccagaaccatcagttgagtttgacaccgttgcaaataaaaagcagcagcatgaagtgaatgttgccatttcaaattcatttggatttggtggacacaactctgtggtagtcttttctgcattcaagccctgatcatccagcttgtctgtatttcctgcaattcgagatttaaactctcggataagcatccaaaattgttcttttacaagagtgaggagtaaacttggggtagaggctgtcattttcttactcttcggagtcatttcatggactctgagccatttgtagtttttcatgttataattaccttgagctccgctttaacattattgtttagtgaacttttggaatctgatgagctagacatgaaattttgtaatgttttttattctctagtggttaggaggagataccttgaaggccctcttgcgttttgctgtgagttcccattgcttttctgcattgat

SEQ ID NO: 707 - DNA, 1760 bp, Triphysaria pusilla
tagacacttttccagtttcctcaccacatcgtgttcatcgaaacactccggctcacctttcagccaccctccgccgccatgcaatcccttcactccgccgccctccgaccctctcccatcgaccccctcctcaaacccccgctctctacctgctttcccggccgcaatgccaaattgccgcctaagaggctccccttcaccatctccgcatccgcaaccaccgtttcggctcccaagcgcgagacggacccgaagaagcgcgttgtgatcaccggcatggggctcgtctctgtgttcggaaatgacgtggatgcgtactacgagaagctgctcgctggcgagagcggcatcactctcatagaccggttcgatgcgtcgaaattccccacgcgcttcggaggtcagattagggggtttaaagctgagggttacattgatggtaaaaatgatcggagattagacgattgcttgagatactgcattgttgctggtaaaaaagcgctcgagggggcggatctcggcggcgataatctcaacaagatcgacaaaatccgagctggtgttcttgttgggacaggaatgggcggtctcaccgtcttttccgacggtgttcaggccctaatcgagaagggtcacaggaaaatcactccgtttttcataccttatgccataacaaacatgggatctgccttgctggggattgatctcggtttcatgggccccaactactcgatttcaaccgcttgcgcaacctcgaattattgtttctatgcggctgcgaatcacatccgtcggggcgaagctgatttgatgctcgccggtgggaccgaagctgccatgatcccgattggattgggaggttttgttgcgtgcagagctttgtctcagagaaatgatgacccgaaaacagcttcgagaccttgggataaagatcgagatggctttgttatgggtgaaggtgctggagtcttggtaatggaaagtttggaacatgcgatgaaacgaggtgcacctataattgcagagtatttgggaggtgcggtaaattgtgatgcttaccacatgactgatcctagagctgatgggcttggtgtctcttcgtgtattcatagtgctcttgtagatgctggtgtttcccctgaggaggttaactacattaacgcccacgcaacttcaaccatagtgggtgacttagctgaggtaaatgctatcaagaaggtattcaagaacacttcagagattaagatcaacgcaactaagtcgatgattggacactgcctgggcgctgccggtggtttggaagctattgcgacagttaaagccatcacaacgggctggcttcatccatcaataaatcaattcaacccagagtcgtcggttgagtttgacaccgttgcaaacaaaaagcagcagcacgaagtcaatgttgccatatcaaattcgtttggattcggtggacacaactcggttgttgcgttttcggcattcaaaccctgatcccttgttcgactatatatattagtagcaaagagcaatcttgcttatcgggagcactaaacgaatctttagatcgtctttgtactagttattcgtttagcattttcagacaaagttgtattcatttggcaaatgtaataaggccgagtgtagctttttgtttgatgactttttccattcattgggatttatatttattaggtgtgtgtgatttgcatcagttttgttctgtcttgctcttgtgaaagctacttttaactagt

SEQ ID NO: 708 - DNA, 1935 bp, Glycine max
cacttgctagattggttgtactgacaatactagctcgcaggcttgtgttctgttctgctttgcattctccgccatcatcgtcatcatcatgcaagcgcttcattcccccaccctccgcacttctcccttggaccctcttcggggccccaacaatgccgccgccaagcgacgcgcctcctctgccaagcgcgtgttcttcgtgtccgccacggtggcgccgaaggtgtccgccccgcagcggcagaaggactcgaagaagcgcgtggttatcacgggaatggggctcgcgtcggtgttcgggaacgacgtggaggggtactacgagaagcttctcgccggcgagagcggcatcacccccatcgaccgcttcgacgcctccaagttccccacgcgcttcggcggccagatccgcggcttctccgccgagggctacatcgacggcaagaacgaccgccgcctcgacgactgcctccgctactgcattgtcgccggcaaaaaggccctcgaaaacgccgaccttgccccagacaaccactccaagattgataaggagcgtgctggtgttcttgtaggctccggaatgggaggtttaacggtgttttctgacggtgttcaggctctgattgagaaggggcacaggaagataacgccgttttttattccgtatgccattactaacatgggttcggctttgcttgggatagaccttgggttcatgggtcccaactattctatatccacggcttgtgctacctccaactattgcttttatgctgcggcgaaccatattcggagaggggaggctgatttgatgattgcgggtgggactgaggctgccattattccaattgggttagggggtttcgttgcttgcagggcgctttcgcagaggaatgatgaccccaaaactgcttccaggccgtgggataaggaccgtgatggctttgttatgggcgaaggtgctggagttttggtaatggagagcttggaacatgccatgaagcgaggcgcacctattattgctgaatacttgggaggtgctgttaactgtgatgcttatcacatgactgatccaaggtctgatggacttggtgtgtctacatgcattcagagcagccttgaagatgcgggtgtgtcaccagaggaggtcaactacataaatgcacatgcaacttccactcttgctggagacttggcagagatcaatgctattaaaaaggttttcaaggacacttctggaatcaaaattaatgcaaccaagtctatgatagggcactgccttggtgcagctgggggtttggaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtagcattttctgctttcaggccttgattgcccagcttagcttgtctgaactttatgtagaacacgggtttaagttaattgaaattttgttctctctacatcattgaggctatttattctatctgagttcgtcatatataaaagctgtaggcctgtagttgttcattttgtgcctaattgtgacttgacaattagctataagactgttttgttgtagaacattttgaatatagctcgaagatttcattatttggaggtatgcagcagcggatagaatgtcaaaactcaaattcttaagcattcttccttattgtagcatcaggggtttatttgaatctcacttgatcggcttcttgaatacatgcttatacaacattatttcagaggggtttcatgagtgatgactttcaagataaatttgtaatctatgaaaagcagtaatttataaatcacgtctttgtact

SEQ ID NO: 709 - DNA, 1919 bp, Triticum aestivum
tcccaatccaatccacgataaacccctccctccaaaaatccatccatccatctttccgctgtgtccggcaccgccaccctcgccgcccggcgcatctcccgcggcttcctcctccaccgccgcgcctatttaaccacctcactcgctctcccgccggcccaactgcaagctccgccatgcacgcccacgccccccacgccctcgggctccgcgtccctcctcccgcgttcccccgccaccgcgctcgcccgcgccggcgccccgccgcggccgtccgcgccacctcggcggcgccgcagagagagacggaccccaggaagcgggtggtgatcacggggatggggctggcgtcggtgttcgggaacgacgtggacacattctacgaccggctcctggccggggagagcggcgtcgggcccatcgaccggttcgacgccagcagtttccccacgaggttcgccgggcagatacgggggttctcgtcggaggggtacatcgacggcaagaacgaccggaggctcgacgactgcatccggtactgcatcctcagcggcaagaaggcgctcgagagcgccgggatcggcgcaggctccgacgcgcacggcaagcttgatgtggggcgggctggtattcttgtgggttctggcatgggtggcctttcagtattctccgatggtgttcagaatcttatcgagaagggatacagaaaaatttcacctttctttatcccatatgctataactaacatgggttcagccttgcttgccatggatgttggtttcatgggccccaactactcaatttcaactgcgtgtgcaacctccaactactgcttttatgctgccgcaaaccatattcgtcgtggtgaggctgatatcatcgtcgctggtggaactgaagctgccatcattccaatcggccttggaggttttgtagcatgtagagcactatcacaaaggaacgatgacccaataactgcatctaggccatgggataaagagcgagatggctttgttatgggtgaaggtgccggtgtactggttatggagagcctggagcacgcaatgaagcgtgatgcaccaataattgctgaatacttgggaggtgcggtcaactgtgatgcttaccatatgactgatcctcgatcagatggactgggtgtatcatcctgtattacaatgagtctcagagatgcaggtgttgcaccagaggaggtgaactacatcaatgcacacgcaacttcgacacttgctggtgacttggctgaagtaagagccattaagcaagtcttcaagaatccatctgagatcaagatcaattctacaaagtccatgataggccattgcctgggtgcagcaggtgggttagaagctatcgccactatcaagtccataactactggatgggtgcatcctaccgttaaccaatttaacccagagcctgaagttgattttgatacagtagctaacgaaaagaagcagcatgaagtgaatgttgctatttctaactcatttggatttggagggcacaattcggtggtggtattcgcgccattcaagccgtgattcgccatcacttcagagatatagaatccgcggcatcctcttgattagatgttagcctgcttgaatttaccggctttgtgtagcaagttttgatgattggtagagtggtgctgccttgaccctgacactgttgtttatatgatcattctttcgggcgctcctcgtgtgtaccatgttgtggaaaacctggaatagtgtaaaggatcattcatcagtattgtaatttggtacatagttcatttggatgttcctccccctccctttcctgtacaagtgccgttgtagacagtttttcgattaatggtctactagtagtccgctggctgatctttttaaaagatcggccggctcacg

SEQ ID NO: 710 - DNA, 1778 bp, Vigna unguiculata
gagagttgttcagtgttcagtgcatcgcattctccgccatcatgcaagcgctaaactcgcccaccctccgcgcgtctcccttggacccgcttcgcgctcctaacaatgccgccaacagaagagccgccgccgccaagcgcgtattcttcgtctccgccacggcggcgcccaaggtttctgccccgcagcgccagaaggaccccaagaagcgcgtggtgatcaccggaatgggcctcgcgtcggtgttcggcaacgacgtcgagggctattacgagaagctccttgccggagagagcggcatcaccgccatcgatcgcttcgacgcgtccaagtttcccacccgcttcggcggccagatccgcggcttctctgcccagggctacatcgacggcaagaacgaccgccgcctcgacgactgtctccgctactgcattgtcgccgggaagaaggccctcgaaagcgccgacctcgctaaggataacctcaccaagcttgataaggagcgtgccggtgttcttgtgggatccggaatgggaggcctaacggtgttttccgacggtgttcagtctctgattgagaaagggcaccggaagataacgccgtttttcattccgtatgccattactaacatgggttcggctttgcttgggattgacctcgggttcatgggtcctaactattctatttccactgcttgtgctacctccaattattgcttttatgctgcggcgaaccatatacggagaggggaggctgatttgatgatagcgggtggaacagaggctgccatcattcccattgggttagggggtttcgtcgcttgcagagcgctttcccagaggaatgatgaccccaaaactgcttcaaggccgtgggatcaggggcgtgatggctttgttatgggtgaaggtgctggagttttggtgatggagagcttggaacatgccatgaagcgaggcgctcctataattgctgaatacttgggaggcgctgttaactgtgatgcttatcatatgacagatccaaggtctgatggacttggtgtgtcttcatgcattcagagcagccttgaagatgctggtgtgtcacctgaggaggtcaactacataaacgcacatgcaacttccactcttgctggcgacttggcagagattaatgctattaagaaggttttcaaggacacttctggcatcaaaattaatgccaccaagtctatgataggacactgccttggtgcagctggggggttggaagccattgccactgttaaagccataacaacaggatggctgcatccaacaatcaatcaatttaacccagaacccgcagtcgattttgatacagtggcaaatgtgaagcagcagcatgaagtcaatgttgctatttcaaattcatttggatttggtggacacaactctgtggtggcattctctgctttcaggccctgattacgacgcagcttgggttatctgcgctttatgtggaacacgggtttaagttatttgaaattttgttctctctagatcagtgaggctgtttgttctatttgagccaatcatatatgaaagccgtaggcctgtagttcagtttgtggtaattgtgacttgacagttagctataagtctgttttaatgagtagacgtttttgaatgtagctggaagtctttagtttggaggtatacagaaggataaaatgccaaatgagcaattcttcatcattcttccatattgtttcagtaaagatatttatcatcattttttccaaaaaaaaaaaaaaa

SEQ ID NO: 711 - DNA, 1967 bp, Citrullus lanatus
aggcttattgagtggctttaccattccgccaaacaaatcatttcaataccaattctccattcttcattccgccattgttatcatcgccttccttcttctatacattcctctctctcgcattccccaaatccccattgttcttccaccatgcaggccgccgttcattcctccactctcaagccctctccattggactcatttcgcaaccgcaaatgctcccccttgctcgttgctgctgcgcctaaatcacggcgacgagtctcttatgtctctgcagctgcggcttccactgtctctgcgcctaagcgggagaaagaccctaagaagcgtgtggtgattactggaatgggccttgtttctgtctttggcaacgatgttgatacttactatgataagttgctttctggtgagagtggtattactctcattgatcgctttgatgcttccaagtttcctactcgcttcggtggccagatccggggattcgcttcacagggatacattgacggtaagaatgatcgtcgccttgatgattgtcttcgttattgtattgttgctggaaagaaggctcttgaagatgctgacctcggtggagataagcgctctaagatcgacaaggagcgtgctggtgtgcttgttggaacagggatgggtggtcttacagtcttttctgatggtgttcaggctttgatagagaaaggtcacaggaagattaccccttttttcattccttatgccattacaaatatggggtctgccttacttgccattgatattggtttcatgggtcccaattattctatatccactgcttgtgccacctctaattattgcttctacgctgctgcgaatcacattcgtcgaggagaggctgatatgatgcttgctggtggaactgaagctgctatcatacctattggactaggaggttttgttgcttgtagggctctatctcagagaaatgatgatcccaaaactgcttcgaggccatgggacaaagatcgtgatggctttgtcatgggagaaggtgctggcatactggtaatggagagtttggagcatgcaatgaaacgaggtgcaccaattcttgctgaatacttgggaggggccgtaaactgtgacgcttatcacatgacggatcctagagcagatggacttggtgtctcttcatgtatcttgagcagtcttgaagatgcaggtgtatcgcctgaggaggttaactacataaatgcacatgcaacttccacccttgctggtgacttagctgagatcaacgccatcaagaaggtgtttaagaatacatcagagatcaaaatcaatgcgactaagtctatgataggccactgcctaggtgctgctggaggtttggaagccattgccactgtgaaagcaattgaaacaggatggttgcatccttccataaatcaatttaacccggagccttcagttgattttgacaccgtcgccaatgtaaagcaacagcacgaagtgaatgttgctatctcaaattcatttggatttggtggacacaactcggtcgtggcattctcggcatccagcattcaaaccttgagcatgttaatgttacgtactacgacgttttgtaggagaatccagtccttagccttgagaatagtcactaatttatttatcaacgaggttgctttgcttgctgcgggcgtcttatctgtctttcaacgttttgctcttttatgcaattccatttgttgctgttttctaatccaataaatgggtttacttgaacttgtgcgagtgtattgggttaggttcatattagatttctgttcgaaattttctcaagaattccatcaaaatgttgtaatgaagaagctttttcattttcttgagaaatcaattttatgtctcctttattcttagatttgaaaaggagatgaacaaaccgttttcattttcttgagaaatcaatattacgtctcctaataaat

SEQ ID NO: 712 - DNA, 1606 bp, Daucus carota
cccacatgtaaattcactcaaaccaccgcacacccttgggagtacttgactcatatctctcattttcaatcccaatccactaaatctctctcttacaccatgcaagctctccaatcttcacctctccgagtctccccactcgacccacttcgcaaacccacctccggcgccgccaccgtcacaaatgtccgcccaccccacaagaaatccttcatctccgccgcagcaaccaccacttccgcccccaaaagagagacagatccgagcaagagagtggtgatcacaggaatgggattggtgtctgtgtttgggaatgatgtggatacttattatgataagctgcttgctggggaatctgggattggtttgattgatagatttgatgcttccaagtttcccacaagatttggtggtcagattcgtgggttttcgtcagaagggtatattgatgggaagaatgataggaggcttgatgattgtctgcgttattgcattgttgctggtaaaaaggctcttgagaatgcagatcttgggggtgataagcgcttcaaggtcgacaaagagcgtgctggtgtactggttggaactgggatgggcggtcttacagtattttctgacggtgttcaggctttaatagagagaggtcatcggaaaattactccgtttttcatcccgtatgccattacaaacatgggttctgcattgcttgcaattgatctcggcttcatgggaccaaattattcaatctctactgcttgtgctacatctaattattgtttctatgctgctgcaaatcacatccggcgaggtgaggctgatttgatgattgctggcggaactgaagctgctattatacctattgggctgggaggatttgttgcatgtagagcattgtcgcagagaaacgatgatccaaagactgcttctaggccatgggacaaagatagagatggctttgtcatgggtgaaggagctggtgttttggtaatggagagtttggaacatgctatgaaacgaggtgcaccaataattgccgagtatctaggaggtgcaatcaattgtgatgcttatcatatgaccgatccaagatctgacggacttggtgtttcttcatgcattcaaagcagtcttatagatgctggagtgtcaccagaggaggtcaactacataaatgcacatgcaacttccactttagttggtgaccttgctgaggtgaatgctgtcaagaaagtattcaagaacacttcaggaattaagatgaatgcaaccaagtctatgataggccactgtttaggtgctgccgggggtttggaggctatcgctgtaattaaagccattactacagggtggttgcatcctacgattaatcaatttaacgccgagccttcagtggagtttgacaccgtggctaatcagaaacaacaacatgaagtaaatgttggcatctcaaattcgttcggatttggtggacacaactctgttgtggcattctctgcattcaaaccgtgaattggcacatccttcattgtatgtagtatgtgtaaccatatcaatctgttctttaccttagttttgtcaatttcttgcagaggcagacatagttatc

SEQ ID NO: 713 - DNA, 1571 bp, Cucumis sativus
aggcttattgagtggctttacaattccgccaaacaaatctcttacaacatcgatttttctctcccaattcctccattgttatcatcgtcacccttcttctatacattcctctccctcgcattccccaaatctccattgttcttccaccatgcaggccgccgttcactcctccactctcaagccctctcccttggactcatttcgcagtcgcaaatgctcccctttccttgtttctgctcctaaatcacgcccacgactttcattcatttctgcatctgcagcttccactgtctctgcacctaagcgggagaaagatcctaagaaacgtgtcgtgattactggaatgggacttgtttctgtctttggtaatgatgttgatacttactatgataagttgctttctggtgagagtggtgttactcttattgatcgttttgatgcttccaagttccctactcgtttcggtggccagatccggggatttgcttctcagggatacattgatggtaagaatgatcgtcggcttgatgattgtcttcgttattgtattgttgctggaaagaaagctcttgaggatgctgaccttggtggagataagcgctctaagatcgacaaggagcgtgctggtgtgcttgttggaacaggaatgggtggtcttacagtcttttctgatggtgttcaggctttgatagagaaaggtcacagaaagataaccccttttttcattccttatgccattacgaatatggggtctgccttacttgccatcgatattggtttcatgggtcccaattattctatatccactgcttgtgccacctctaattattgcttctatgctgctgcaaaccatattcgtcgaggagaggctgatatgatgcttgctggtggaactgaagctgctatcatacctattggcctggggggttttgttgcttgtagggctctatctcagagaaatgatgatcctaaaactgcttcaaggccatgggacaaagaccgtgatggctttgtcatgggagaaggtgctggcatactggtaatggagagtttggagcatgcaatgaaacgaggtgcaccaattattgctgaatacttgggaggggctgttaactgtgatgcttatcacatgacggatcctagagcagatggacttggtgtctcttcatgcatcttgagcagtcttgaagatgcaggtgtatcgcctgaggaggtcaactacataaatgcacatgcaacttccacccttgccggtgacttagctgaaatcaatgccatcaagaaggtgttcaagaatacatcagagatcaaaatcaatgcgactaagtctatgataggccactgccttggcgctgctggaggtctggaagccattgccactgtgaaagcaattgaaacaggatggttgcatccttccataaatcaatttaacccggagccttcagttgactttgacaccgttgcaaacgtaaagcaacaacacgaagtgaatgttgctatctcaaattcattcggatttggtggacacaactcggttgtggcattctcggcattcaaaccttgagcaggaa

SEQ ID NO: 714 - DNA, 1904 bp, Phaseolus vulgaris
aacataaaaaatgaggtgcaaataaatagtttgattgtgtagttgcaatagcacagaacgaagtagtttgagttcactgcatcgcattctccgccatcatgcaagcgctacactcccccactctccgggcttctccgttggaaccgcttcgcgcccccaacaatgctgccaacagaagaaccgccgccaagcgcgttttcttcgtctccgccacggcggcgcccaaggtctccgcccctcagcgccagaaggaccccaagaagcgcgtggtgatcaccggaatgggcctcgcatccgtgttcggcaacgacgtcgagggctattacgagaagctcctctccggacagagcggcatcaccgccatcgatcgcttcgacgcctccaagttccccacccgcttcggcggccagatccgcggcttctccgccgagggctacattgacgggaagaacgaccgccgcctcgacgactgtctccgctactgcattgttgcaggcaagaaggccctcgaaaacgccgacctcgccgcggataacctcacgaagcttgataaggagcgtgccggtgttcttgtgggatccggaatgggaggcttaacggtgttttccgacggtgttcaggctctgattgagaaagggcaccggaagataacgccgtttttcattccgtatgctattactaacatgggttcagctttgcttgggattgaccttggcttcatgggtcctaactattccatttccactgcttgtgctacctccaattattgcttttatgctgcggcgaaccatatacgaagaggggaggctgatttgatgatagcgggtggaactgaggctgccatcattcccattgggttagggggtttcgtcgcttgcagggcgctttcccagaggaatgatgaccccaaaactgcttcaaggccgtgggataaggagcgtgatggctttgttatgggtgaaggtgctggagttttggtgatggagagcttggaacatgccatgaagcgaggcgctcctataattgctgaatacttgggaggtgctgttaactgtgatgcttatcatatgactgatccaaggtctgatggacttggtgtgtcttcatgcattcagagcagcctcgaagatgctggtgtgtcacctgaggaggtcaactacataaatgcacatgcaacttccactcttgctggcgacttggcagagattaatgctattaagaaggttttcaaggacacttctggcatcaaaattaatgccaccaagtctatgatagggcactgccttggtgcagctggggggttggaagccattgccaccgttaaagccataacaacaggatggctgcatccaacaatcaatcaatttaacccagaaccggcagttgattttgatacagtggcaaatgtcaagcagcagcatgaagtcaatgttgctatttcaaattcatttggatttggtggacacaactctgtggtggcattctctgctttcaagccctgattgccctgcttagtatttgcagtttatgtagaacacgggtttaagtcaattgaaattttgttctctctactactttgaggctgtttgttctatttgagcccatcattatataaaagccgtaggcctttagttcagtttgtggtaattgtgacttgacagttagctataagactttgttgtgtagaactttttgaatgtagctcgaagtcattagtttggaggtatacagaggatagaatgagcattcttccatattgtttgagtaaagatatttatcatcaaacttgtatctaagatacttgctgattgctataaatcattgtagcatcaggtggttttatttgaatcattcatgaaaacatggtgatactcaattagagttaggtttcatgagtttctaga

SEQ ID NO: 715 - DNA, 1893 bp, Jatropha curcas
caaacacaaaccatcgttgttatcgccgtctcaaaatctccctcctccctccactaaagcagctaccaccgccaccatgcaagccctccaatccccatctatacgagcatcccctctaagtcccttccacaagaaatcccacaatgcaacgaaacctccaactaaaaaaatttccttcattactgcatcatctaccaatagctctactgttacagccccaaagcgcgagaaagaccctaaaaaaagggtcgtgattacgggtatgggtttggtttctgtctttgggaatgatgtagatgcttactatgataagttgctcgctggagaaagtgggatcggacccatcgaccggttcgatgcctctaaatttccgacccggtttgctggacagatccgggggtttggtgcagagggctatatcgatgggaagaatgataggagactcgatgattgtttgaggtattgcattgttgcaggtaagaagtctctcgaacatgcggatcttggcggggataatctatcaaaggttgataaagagcgagctggtgtgcttgttggaactggaatgggtggtcttacagtcttttctgatggtgttcaggctctaattgagaaaggacacaggaaaattaccccattctttattccttatgctattacaaacatggggtctgcgttgcttgcaatggaaattggtttcatgggtccaaattattcgatctcaactgcttgtgctacctccaattattgtttctatgctgctgccaatcacattcgccgaggtgaggctgatttgatgattgctggtggaactgaagccgctatcattcctattggtttgggaggttttgtagcatgtagggccttatctcaaaggaatgatgatccacaaactgcttcaaggccttgggatagagatcgcgatggctttgttatgggtgaaggtgctggagtgttggtgatggagagcttggaacatgcaatgaaaaggggtgcaccaattatagccgaatacttgggaggtgctgtaaactgcgatgcatatcacatgactgatccaagagctgatggacttggggtctcttcatgcattgaaagaagtcttgaagatgccggtgtctcacctgaagaggttaactacataaatgcacatgcaacttccacccttgctggtgaccttgctgagataaatgctataaaaaaagtattcaaggatacatctgagatcaaaatcaatgcaaccaagtctatgatagggcattgccttggtgctgctggaggtctggaagcaattgcctgtgcaaaggccataaccacaggatggttgcatcccactattaaccaatttaatccagagccatctgttgaatttgacactgttgccaataagaagcagcagcatgaagtgaatgtcgccatttcaaattcctttgggtttggtggacacaactctgtcgtggccttttctgcattcaagccctgagcatctggcttgtctccatatctttttactgcatttctcgtaggagcctgtttttgttacttgagaggagttgcttatggactaggtttaacgaggcttcatcgattaacttgagttactgatagtcattttcttccatccatttgtagtagtcactcccaataatttggatatgaactgtatcttaaggtggttggtcttctttccttcctttttttttttttccttccttaaaaaaaaaattttggaatggaagttatatttcctttttccagtacctggaaacttcactttgaggtctaaaaaccgggggggtttgttcttttcaaaattatagggggaaaacaaccatttgaaaaagtctttaatttataaatccagaaccaaatttgggttcttcaaaaaaaaaa

SEQ ID NO: 716 - DNA, 2272 bp, Populus trichocarpa
attggttttatttatttgcaaacaagtttacaaccacctccaattcactctcaacacagaacacaaacacacaacatcgttactatcgccctctcaaattctccctctccccttctctcaaactccagagtttgccatggaagccctgcaatctctatatctctcttcatctccgttaaacccacttcaccaaaaatctcacaatgcaacaaagcccccacctgagagaatctcattcatcaaagcatcatcatcctccaccgtttcagctccaaaacgagagaaagaccccaaaaagagggttgtcataacgggcatgggattggtctctgtctttggtaatgacgtagatgcttattatgataaattgcttgctggtgaaagtgggattggaaccattgaccgctttgatgcttctaagtttcctacccgcttcgctgggcagatccggggctttaatgcacaaggctatattgatggaaaaaatgataggaggcttgataattgcttgaggtattgcattgttgctggcaagaaggctcttgaagatgcggatcttggagggaataatctatctaagattgataaggagaaagctggtgtgcttgttggaacagggatgggtggtcttacagtcttttctgatggtgttcaatctttaattgagaaaggacacagaaaaattaccccattttttattccttatgctataacaaacatgggctctgccttgcttggaattgaacttggtttcatgggtccaaattactcgatttcaactgcttgtgctacttctaattattgcttctatgctgctgccaatcacattcgccgaggtgaggcagatatgatgattgctggtggaacagaagctgctatcattcctattggtttgggaggttttgttgcatgcagggccttatcacaacgaaatgatgatccaaaaactgcatctaggccgtgggacagagatcgagatggttttgttatgggtgaaggtgcaggagtgttggtaatggagagcttggaacatgcaatgaaacgaggcgcaccaatcattgctgagtacctgggaggtgctgttaactgtgatgcttatcacatgactgatccaagagctgatggtcttggggtgtcttcatgcattgagagaagtcttgaagatgccggtgtgtctcctgaggaggttaactacataaatgcacatgcaacttccactcttgctggtgaccttgctgagataaatgctataaagaaggtatttaagaacacttcagagatcaaaatcaatgcaaccaagtctatgattggacattgccttggtgcttctggaggtttggaagctattgcaactgtgaaggccataacaacaggatggctgcatcctagtattaaccaatttaatccagagccctcagttgagtttgatactgttgccaacaaaaagcaacaacatgcagtgaatgttgctatttcaaattcatttggatttggtggacacaactctgtcgtggccttttctgcattcaagccttgagcacctgacctttcagcatttcttttcatgcattcaagccccgagcatccagcttgtctgcatttcttgtagtgatcagtcttgcttagtcgggatatgcttaattaattcactagtcaatgaggctccatcttctaattcaagttgctgcgtaataatcatcttcctgtcaattttgagttgaactacagcctaaggtttatggatcttttctctcaatgaaatttcatttttctttgcgtttattgaacttttagaaagtaagaggcatgtaatttcattcagttttgacttttaagttgtgcagcagagaaatgaacgtctgcgagggtctctgttctagtactgtcacgttcctttttaactgatgtaaatggaatgcatggtttcacctgtccttgtagaaggtttaaattaattatgtcttcagattcatacaggaatttctggtttccaaaagagttcctcagaagccttcggatcccttgctaagttgttgcatacttgcattggatgtggctactcatatccagattgtccaaatgtggacaaatcttccactcaaaaacaggtgctctacatctgctccatacccaattctgtttaggtctattttatacttaccaggagcaagaatacacatcagaggtacagtaccgataatgcatcgtggaacctgagtatctggacatgacccttccctggtataaaactagaattactctacaaccctaa

SEQ ID NO: 717 - DNA, 1852 bp, Glycine max
cagaaaataaataagacccacttgttagattggttacactagcagcacgcagggttctgttctgctttgcattctccgccatcatcatgcaagcgcttcactctcccaccctccgcgcttctcccttggaccctcttcgtggccccaacaatgccgccgccaaccgccgctcctccagcgccaagcgcgtgttcttcgtctccgccacggtggcgccgaaggtgtccgccccgcagcgacagaaggaccccaagaagcgcgttgtgatcaccggaatgggcctcgcgtcggtgttcggtaacgacgtggagggttactacgagaagctcctcgccggcgagagcggcatcaccgccatcgaccgcttcgacgcctccaagttccccacgcgtttcggcggccagatccgcggcttctctgccgagggctacatcgacggcaagaacgaccgccgcctcgacgactgcctccgctactgcattgtcgccggcaaaaaggccctcgaaaacgccgaccttgcccccgacaaccactccaagattgataaggagcgtgctggtgttcttgtaggctctggaatgggaggcttaacggtgttttctgacggtgttcaggctctgattgagaaggggcacaggaagataacgccgtttttcattccttatgcaattactaacatgggttcggctttgcttgggatagaccttggattcatgggtcccaactactctatatccacggcttgtgctacttccaattattgcttttatgctgcggcgaaccatattcggagaggggaggctgatttgatgatagccggtgggactgaggctgccattattcctattgggttagggggttttgttgcttgcagagcgctttctcagaggaacgacgaccctaaaaccgcttccaggccatgggataaggaacgtgatggctttgttatgggtgaaggtgctggagttttggtaatggagagcttggagcatgctatgaagcgaggcgcacctattattgctgaatatttgggaggagctgttaactgtgatgcttatcacatgactgatccaaggtctgatggacttggtgtgtctacatgcattcagagcagccttgaagatgccggtgtgtcaccagaggaggtcaactacataaatgcacatgcaacttccactcttgctggagacttggcagaaattaatgctattaaaaaggttttcaaggacacttctggcatcaaaattaatgccaccaagtctatgatagggcactgccttggtgcagctgggggtttagaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtggcattttctgctttcaagccttgattgcccagcttagcttgtctgcactttatgtagaacacgggtttaagttaattgaaattttgttccctctacatcattgaggttatttactctagctgagtccatcatcatatataaaaagctgtaggcatgtagttgttcattttgtgcctaattgtgacttgacaattagctataagactattttgtagtagaacattttgaatatagctcgaagattttattagtttggaggtatacagcagcggatagaatgtcaaagagcttatattcttaagcattcttccttattgttaagtattatttgagtctcacggcttcttgaatacatgctggtaagtattatttcagagtgg

SEQ ID NO: 718 - DNA, 1760 bp, Lotus japonicus
aacaacaacaacaacaacgtgagctgaaaagtgaaacacagaggctaatcttaatttcttcatatcctcgtactctccgcaatgcaatctcttcacattcaaccactccaacccactctccgcgcttcaccgctcgacccactccgcaaatcttccaatgccgccaaccggagactccccggcggcaagaggaaaaccttcgtcgtctccgccgccgtcacaaccgccgcgcccaagcgccagaaggaccccaagaagcgcgtcgtgatcaccggcatgggtttagcttccgtcttcggtaacgaagttgatggctactacgacaagctcctcgccggtgagagtgggatcaccccgattgaccggttcgacgcttccaagttcccgacccggttcggtggccagatccgtgggttcagcgcggagggttacatcgacgggaagaatgaccggaggcttgatgattgtctccggtactgcattgtcgccgggaagaaggctcttgagagtgctgacctcggtgctgagaatcgctccaagatcgataaggaacgtgctggtgttcttgttgggtcagggatgggtggtttgacagtgttttctgatggtgtgaaggctttgattgaaaagggtcatcggaagataacgccatttttcattccttatgctatcacgaacatgggttcagctttgcttgggattgatcttggtttcatgggtccgaattattctatttccactgcgtgtgctacttccaattactgcttctatgctgctgcaaaccacattcggaggggtgaggctgatttgatgttggcgggtgggactgaagctgctatcattcccattgggttaggggggtttgtggcgtgcagggcactttctcagagaaatgatgaccctaaaactgcttctaggccttgggacaaggaccgtgatggctttgtcatgggtgaaggtgctggagttttggttatggagagcctggaacatgccatgaggcgaggcgcgcctatcattgctgagtacttaggaggtgctgttaattgtgatgcttaccacatgactgatccgagatctgatggacttggtgtgtctacatgcattcaaagcagccttgaagatgctggtgtgtcgcctgaggaggtcaactacataaatgcacatgcaacttccacaaatgctggtgatttggcagagattaatgctattaaaaaggttttcaaggacacttctggcatcaaaattaatgccacaaagtctatgatagggcactgccttggggctgccggtggtttggaagctattgccacagtgaaagccataacaacgggatggctgcatccatcaatcaatcaatttaatccagagcctgcagttgattttgacacagtggcaaatgttaaacaacagcatgaagttaatgttgccatttcaaattcatttggatttggtggacacaactctgttgtggcattttctgctttcaagccctgatagaccagcatttgtcttcacttccatgtagaacacgagtctaaattgattgaaattttgttctccctgcatcattgaggctatatattttattgaagtccatgatacataaaagttgtatgcctgtctgtagttgttcattatgtgctaattgtggcttgaagttagcgttgggactattttgctgtagaacttttggaatatagctcaaagattcaattggtttttgaggtttactgcgaatagaaagtgttcaatgagct

SEQ ID NO: 719 - DNA, 1638 bp, Nicotiana benthamiana
gacaaaacattactcctatttcccttctctctactggaaaagcgtattagtacaaccacatcgttcacatcgaaagctcttctctcctgcttcttcttcctcactaaaccatgcaatcaatccaatctccatctttccgtccatctccactcgatccactcaaaaaaaccgtcccccaattcaccaatgttaggccattgagtcatgtcaaacgagtatcctttatttcagcttcagcaaccactgtttccgctcctaaaagggagaaagatccaaagaaaagggttgttataactgggatgggccttgtttctgttttcggtaatgacgtcgatacttactatgacagacttttggctggtgaaagtgggatttcactcattgatcgttttgatgcttctaagttccccacaagatttgggggacaaattcgtgggtttacatcggacggatatattgatgggaagaatgataggaggcttgatgattgtcttaggtatgccattgttgctgggaaaaaagctcttgaaaatgcagatcttggtggtgacagacttggaaagattgacaaggagcgagcaggtgttttggtaggaacaggaatgggtggtcttacagttttctcagatggcgtccaaaatcttattgaaaagggtcacaggaaaattactccgttttttataccatacgccataacaaacatgggttctgccttgcttggtattgatcttggttttatgggaccaaactactcaatctcaactgcttgtgctacctccaattattgtttttatgccgccgccaatcacattcgcagaggtgaagctgatttgatgctagctggtggtaccgaagctgccataatacctattggattaggaggttttgtggcgtgcagagctttgtctcaaaggaatgatgatccgcaaactgcttccagaccatgggacaaagaaagagatggctttgttatgggcgagggagctggagttttggtgatggaaagtttggagcatgcaatgaaacgaggagcaccaataattgcagaatatttgggtggtgcagttaattgtgatgctcatcacatgactgatccccgagctgatggtcttggtgtttcgtcatgtattcagagcagccttgaagatgctggagtgtcaccagaagaggttaattacatcaatgctcatgcaacttccaccattgttggtgatatagccgaggtaaatgctattaagaaggtattcaagaacacctcaggaatcaaaatgaatgcaaccaagtctatgatagggcattgcttgggtgctgctggtggtatggaagctattgcaacagttaaagctattacaaccggctgggtgcatccttcaattaaccaatttaatcctgagtcttcagtggagtttgatactgttccaaacaaaaaacagcagcatgaagtgaatgttggaatctcaaattcctttggttttggtggtcacaactctgtcgtcgccttttctgcattcaagccttaatccagctcacttcaggaaagagcaatcctcgttttgtggaggcataatatagagaattactgtgaaacagaggatgtttcaaataaacaaggtgcggcgagaggtgaccagttggcaa

SEQ ID NO: 720 - DNA, 1788 bp, Arachis hypogaea
aacgcaacgcaattaacaaactaacagagacattttcacaaacacctggtagctctaaaaccacttctctctatctctctgtctctctggagttgcattcgctaattgttactgttccaccatcatgcaagccattcacacacccacgctccgcgtctctccgttggacccacttcgcaaatcaaccaatgctcccatatccacgcgccgcgcatcgaagagggtgtccttcaccgtctccgcagccgccgtctcccccaaggtttcggctcctcagaggcagaaggatccaaagaagcgcgttgtaatcaccggaatgggcctagcatccgtcttcggcaacgacgtcgacactttctatgacagactcctcgccggggagagtggtatcaccaccatcgaccgctttgatgcctccaagtttcccaccaggttcggcggccagatccgtgggttcagctctgaaggctacatcgatggcaagaacgatcgcaggctcgatgattgtctccggtactgcattgtcgccggtaagaaggctctggagaacgctgacctcgggggcgaaaagctcaacaagcttgacaaggaaaaggcaggtgttcttgtcgggtcagggatgggtggtcttacagtattttcggatggggttcaggctctaattgagaaaggacatcgcaaaataacgccgttcttcattccttatgccattactaacatgggttctgctttgcttggaattgatcttggtttcatgggtccaaactattccatatcaactgcgtgtgctacctccaattattgcttttatgctgctgcaaatcacatccgcaggggagaggctgatttgatgatagctggtgggactgaagctgccatcattccaattgggttagggggttttgttgcatgcagggccctctctcagagaaacgatgaccctaaaactgcttcaaggccatgggataaagaccgagatggctttgtaatgggtgaaggttctggagttctggtaatggagagtcttgaacatgccatgaggcgaggtgcgcctattattgctgaatatttgggaggtgctgttaactgtgatgcttatcacatgactgatccaagatctgatgggcttggtgtttcttcatgcattcagagcagccttgaagatgctggtgtctcccctgaggaggtcaactatataaattgccatgcaacttctactcttgctggtgacttggcagagattaatgctattaagaagattttcaagaaaactgatggcatcaaaatcaatgcaacaaagtctatgattgggcactgccttggtgcagccggaggtttggaagccattgcaacagtgaaagccataacaacagggtggctgcatccgtcaatcaatcaattcaatccagaaccagcagttgattttgatacagttgccaatgtcaagaagcagcatgaaattaatgttggcatttcaaattcatttggatttggtggacacaactctgtggtggcattttctgctttcaagccctgatagtctggtctgtcaccacaaatgtagaacaggattataaattaattgcaattttgttctttctacatcattgaggcaacttcctttatttgagtctttgattcgtgaaagctgcaaggcctgtagttcttatatttgtgctaattgtgatttgatagcataaagaacattttgcgtatagctcgaatatttatttagtttggagtgctgtggtggatacagaaatttctatagagcttatcttcaacatt

SEQ ID NO: 721 - DNA, 1648 bp, Nicotiana benthamiana
aaaacattattcctttttcccgtctctctactggaaaagcgtattagtacaaccacatcggtcacatcgaaagctcttctctcctgcttcttcttcctcagtaaaccatgcaatcaatccaatctccgtcgttccgcccatctccactcgatccactcagaaaaaccgtcccccaattcaccaatgttaggccattgagtcatgctaaaagagtgccctttatttcagcttcagctaccactgtttccgctcctaaaagggagaaagacccaaagaaaagggttgttattacagggatgggcctggtttctgtattcggtaatgacgtcgatacttactatgacaaacttttggctggtgaaagtggaatttcactcattgatcgttttgatgcttctaagttccccacaagatttgggggacaaattcgtgggtttacatcagacggatatattgatgggaagaatgataggaggcttgatgattgtcttaggtatgccattgtcgctgggaaaaaagctcttgaaaatgcagatcttggtggtgacagacttggaaagattgataaagagcgggcaggtgttctggtaggaacaggaatgggtggtcttacggttttctcagatggggtccaaaaccttattgaaaagggtcacaggaaaattactccattttttataccatatgccataacaaacatgggttctgccttgcttggtattgatcttggttttatgggaccaaactactcaatctcaactgcttgtgctacctccaattattgtttttatgccgccgccaatcacattcgcagaggtgaagctgatttgatgctagctggtggtactgaagctgccataatacctattggattaggaggttttgtggcatgtagagctttgtctcaaaggaatgatgatccacaaacagcttccagaccatgggacaaagaaagagatggctttgttatgggcgagggggctggagtcttggtgatggaaagtttggagcatgcaatgaaacgaggagcaccaataattgcagagtatttgggtggtgcagttaattgtgatgctcatcacatgactgatccccgagctgatggtcttggtgtttcgtcatgtattcaaagcagccttgaagatgctggagtatcaccagaagaggttaattacatcaatgctcatgcaacttccaccattgttggtgatatagcagaggtaaatgctattaagaaggtattcaagaacacctcaggaatcaaaatgaatgcaaccaagtctatgatagggcattgcctgggtgctgctggtggtatggaagctattgcaacagttaaagctattacaaccggctgggtgcatccttcaattaaccaattcaatcccgagccttcagtggagtttgataccgttccaaacaaaaaacagcagcatgaagtgaatgtcggaatctcaaattcctttggttttggtggtcacaactctgttgtcgccttttctgcattcaagccttaatcccagctcatttcagcaaagagcaataactccttttgtggaggcataatatagagaattactgtgaaacagaggctgtttcatctcttatggctataaacaaggcgcggcgagagatgaacagttgtcaa

SEQ ID NO: 722 - DNA, 1673 bp, Lippia dulcis
caaatccaacacttccaaacactttctccttaccacatcgtttccatcgaaaactccgactgcccatctccacccatccgccatcatgcaatccctccaaaccaccgcgctccgcccttctccgctcgaccccctccggaaaccgtcgcactccgccgctctacccagcaacaatgccaaacccccagccaagaggcgccccttcaaaatcactgcatccgcatctactgcttcggcgcccaagcgcgagactgaccccaagaagcgcgtggtaatcacgggcatgggtcttgtgtccgtgttcggaaacgatgtagatgcgtattacgagaagctgctggcaggcgagagcggcatcactctcattgaccggtttgatgcgtcgaagtttcccacgcgcttcgggggtcagattcgggggttcacatccgaggggtacattgatgggaagaatgatcggagattggatgattgtttgaggtactgcattgttgctgggaaaaaggcgcttgagagtgcggatctcggtggcgataaacttaataagattgacaagattcgagctggtgttctggttgggactggaatggggggtctgactgtattttctgacggtgttcaggctctaattgagaaaggtcacaggaaaattactccatttttcattccgtatgccataacaaacatgggatccgccttgcttgcaattgatcttggcttgatggggccaaattattcaatttcaactgcctgtgctacctcaaattactgcttctatgcggctgcaaatcatatccgtcgaggtgaagctgatattatgattgctggtggaactgaagctgcaattattccaattggattgggaggttttgttgcatgtagagctttgtcccaaagaaatgatgatcccaaaactgcttccagaccttgggacaaggatcgagacggctttgttatgggtgagggtgctggagtcttggtcatggaaagtctggaacatgcaatgaaacgagatgcacccataattgcagagtatttgggaggtgcagtaaattgtgatgcatatcacatgactgatcccagagctgatggacttggtgtctcttcatgtattcagagcgcccttgaagatgctggtgtttcccctgaggaggtaaattatattaatgcccatgcgacttccaccatcgtgggcgacctagctgaactaaatgctattaagaaggtattcaagaacacttcagggatcaaaatcaatgcaactaagtcaatgatagggcactgcctaggtgctgctggtggcttggaagctattgcaacagttaaagaccattaacacaggatggcttcaccccacaattaatcaatttaatcgagagccttccgttgattttgacactgttgcaaacgaaaagcagcagcatgaagtcaatgttgccatttcaaattcatttggatttggtggacacaactccgtcgtggcattttctgcattcaagccttgatcctgttcaccatccctctctctctctcactgtacgagtttaccgcaaggcattagctctttttgtgtaataattttgggtttagcttttagatttgaggactgttgtcattccttggattcatttcagatacatttctgcggctgatttagttccattactactttc

SEQ ID NO: 723 - DNA, 2219 bp, Cicer arietinum
aaaaacgcccgataagaattgaactcgataataaaattgacgagacatagggtatataaaagaagaaattcatgtgaaatgtgaaattgatataaacaaggaaaaaaggtgttggtgttggtaacttggtacaccattaaatagcatatgaattcataagcaaattagccacacaagttgttcgttgctattgcaacatttgagctttgtattctccgctcctaacaacaacgacaacaatgcagtcacttcagattcaacaactaccctccaccctccgcccttcaccgctcgacccactccgcagaaaaacatccaatgccgccgccactaaaatcaaacccacctctaagagactctcccacatctccgccgcggtcaccaccaccgctccacaaagagagaaggatcccaagaagcgtgttgtgatcaccgggatgggtctcgcttccgtctttggaaacgacgttgacggtttctacgataagcttctcgccggcgagagtggaatcacatccattgaccgcttcgatgcttccaagtttccaacgaggttcgctggtcagatccgcgacttcaattctgaaggttacatcgatgggaaaaatgaccggagacttgatgattgtctccggtattgcattgtcgccggaaagaaggcactcgagaatgctgaccttggcgctggaaatctctctaagattgataaagagcgtgctggtgttttggttgggtctggaatgggtggtttaaccgttttttctgagggagttaagaatttgatagagaaaggacatagaaaaataacacctttttttattccttatgctattaccaatatgggttcagctttacttggaattgatttaggtttcatgggtccaaattattctatttcaactgcttgtgctacttcaaattattgtttttatgctgctgccaatcatatacgtaggggtgaggctgatttgatgattgcgggtgggactgaagctgctattattcctattggtttggggggttttgttgcttgcagggcactttctcagagaaatgatgaccctaaaactgcttctaggccttgggataaagaccgtgacggttttgttatgggtgaaggttctggagttttggtgatggagagcctggaacatgccatgaagcgaggtgcacctatcattgctgaatacttgggaggtgctgttaactgtgatgctcatcacatgactgatccaagatctgatggacttggtgtgtctacatgcatccagagcagccttatagatgctggtgtgtcccctgaggaggtcaactacataaatgcacacgcaacttccactcttgctggtgacttggcagagattaatgctatcaaaaaggttttcaagaacacttctggcatcaaaattaatgccaccaagtctatgataggacactgccttggtgcatctgggggtttggaagctattgccacagtgaaagccataacaacaggatggctgcatccttcaatcaatcaattcaatccagaacctgcagttgattttgatacagtgccaaatgttaagaagcagcatgaaattaacgttggcatttcaaattcatttggatttggtggtcacaactctgtcgtggccttttccgctttcaggccctgattgccagcaacctgtctgcacttcatgtagaacattgaatctaaattaattgaaattttgttctctacatcattgaggctatttagtttatgagtccataatatataaaagctgtagtcctgtaattgttcattttatgctaattgtgatctgatggttagcaccaaggctattatgctgtagaacttttttaatgtagcacggaggtttcattggtttggagttatacagcagatagaaagtgtggaaagagcttatttatacatttttcttactgttaagtaaagatatttattagcaaacatgtatgatgtcgtcgtctatgatacttgttattaaatctttgttggttttatttgaatcagttcatagcctttttagatacatgatcacacaaaagctaaatctgtcgttcctggaaaccagttatgtgcatgcatagaatctctgtaatagccatctgtgttttttgataaaaaaaggtaataagcatgtgttgtttagttgtttttggctgattataatttggctgcatgctgtcctcccagatgcagttttggg

SEQ ID NO: 724 - DNA, 1633 bp, Cleome spinosa
cgcaaatcacactactccacaacatcgtgattgtcgctctctctctctctctctctctctctcagttcctgaattcgccatgcaagttctgcaatcgccctctcttcgcgcctcgccgccgaatcctcttcggaaacactccaatcgacagtcccatcagattgccaatgcgagacccacaaggaaacggcatttcatcgccgcgtccgccgccgtttcggcgccgaaacgcgagaccgacccgaagaaacgggtcgtaatcacgggtacgggtctcgtgtcggtgttcggaaatgatgtggacgcttactacgagaaattgttggccggtgagagcggaatcagcaacatcgacagatttgatgcgtccaagttcccgacccggttcggtggccagatccgtgggtttagctcggaagggtatatcgatgggaagaacgaccgccggcaagacgattgcttgaagtattgcattgtcgccgggaagaaggctcttgagagtgcggatcttgggggtgacaagcttaacaagattgataagatacgagccggagtactagttggaactggtatgggtggtctgaccgtcttttcagacggtgttcaggctctgatagagaaaggtcacaggagaataactcctttcttcattccttatgccataacaaacatgggttctgccttactggcaattgatcttggtcttatgggtccgaactattccatctcaactgcttgtgccacttcaaattactgcttttatgcggctgcgaatcacatccgtcggggcgaggctgatatgatgctcgctggtggaactgaggccgccattattcctattgggttgggaggctttgttgcttgcagggctctgtcccagagaaacgatgaccctaaaactgcttcaaggccatgggacaaggacagagatgggttcgtcatgggtgaaggagccggtgtactggtgatggagagcttggaacatgcattgaaacgaggtgctcctattatagcagaatacctcggaggggctattaattgtgatgcttaccatatgaccgatccaaggtctgatgggcttggtgtctcttcttgcatcgagagatgccttgaagatgctggtgtatcacccgaggaggtgaattacattaatgcacacgcaacatccactctggcgggtgatcttgctgagatcaatgcaattaagaaagtgttcaagaacacttcagagatcaaaatcaatgccaccaagtccatgataggtcactgccttggtgcagccggaggcttggaagccattgccacagtgaaggccatcaccactggatggcttcatcccactatcaaccaatttaaccctgaaccggctgtggacttcgacaccgtccccaaccagaagaagcagcacgatgtcaatgtcgccatatcgaactcgtttggattcggcggacacaactctgtggtggcgttctctgcgttcagaccctgaaggcaacaacagttatccgttttctccgtctctctgtttatttcttcatcttctgcagtttcttgggtcacaagtcagtcggccatttcgttatcttggtatcacccttttgatgaggttttgtagtctcgccgttcggaacat

SEQ ID NO: 725 - DNA, 1896 bp, Trifolium pratense
acattcattcattcaacttcgttctctccgtcatttcatcaaacactaacaatgcaatcacttcagattcaacaactaccttcaacccttcgtccttcaccactcgaaccactccgcaaaaaatctaccaatgccgccaccgccgccaaacccaaatcctctaaaagattcacccgtgtctccgcctcagtcaccaccactgctcctcaaagacagaaggatcctaagaaacgtgttgtgattactggaatgggtcttgcttctgtatttggtaacgatgttgatggttactatgagaagcttcttgctggtgagagtgggatcacatcaattgatagatttgatgcttctaagtttccgactcggtttgctggtcagatccgtgggtttagctctgaaggttacatcgatgggaagaatgaccggagactcgatgattgtctccggtactgcattgtcgccgggaagaaagcacttgaacatgctaacctcggcggcgaaaatctctccaagattgataaggagcgtgctggtgttttggttgggtctggaatgggtggtttaacagtgttttctgagggagttaagaatttgattgagaaaggacatagaaagataacaccttttttattccttatgcaattacgaatatgggttcggctttgcttgggattgatttgggtttcatgggtccaaattattcaatttcaactgcttgtgctacttcgaattattgtttttatgctgctgccaatcacattcgtaggggtgaggcggatttaatgatagcaggtgggactgaagctgctattattcctattggtttggggggttttgttgcttgcagggcactttctcagagaaatgatgaccctagaactgcttctaggccttgggacaaagaccgtgatggttttgttatgggtgaaggttctggagttttggtgttggaaagcttggaacatgctatgaaacgaggtgcacctatcattgctgaatacttgggaggtgctgttaactgcgatgcctatcacatgactgatccaagatctgatggacttggtgtgtccacatgcatccagagcagtcttgtagatgccggtgtgtcacctgaggaggtcaactacataaatgcacatgcaacttccacccttgctggtgacttggcagagattaatgccatcaaaaaggttttcaagaacacttctggcatcaaaattaatgccaccaagtctatgatagggcactgccttggtgcagctgggggtttggaagctattgccacagtgaaagccataacaacaggatgggtgcatccatcaatcaatcaatttaatccagaacctgcagttgattttgatacagtgccaaatgtcaagcagcagcatgaaattaacgttggcatttcaaattcttttggatttggtggacacaactctgtcgtagccttttccgcattcaggccctgatttccaagcttgtcttaaggcaccgatttccaagcttgtctccacttcatgtagaacatcgaatctaaattaattgaaattttgttctctctacatcattgaggctatttattttatgagttcttactatataaaagctgtagtcctgtaattgttaattttatgctaattgtgaacagacagttagctctaagattatttgctgtagaactttttaaatgtagcaggaaggtttcattggttcgaattatacagccagcggatagaaagtgtcataagagcttatttaagcattcttccttgttgttaagtaaagatatttattagcatgtattcatcatacttctttttattgaatccttgttggttatatttgaatcagttcatagctcttttggatacgtgatgatacactactaacactagt

SEQ ID NO: 726 - DNA, 1977 bp, Trifolium pratense
cattcacttcgttctctccgtcatttcatcaaacactaacaatgcaatcacttcagattcagcaactaccttcaactcttcgtccttcaccactcgaaccactccgcaaaaaatcttccaatgccgccaccgccgccaaaaccaaatcctctaaaagattcacccgtgtctccgccgcggtcaccaccactgctcctcaaagacagaaggatcctaagaagcgtgttgtgattaccggaatgggtcttgcttctgtatttggtaacgatgttgatggttactatgagaagcttcttgctggtgagagtgggatcacatcaattgatagatttgatgcttcaaaatttccaactcggtttgctggtcagatccgtgggtttagctctgagggttacatcgatgggaaaaatgaccggagacttgatgattgtctccggtactgcattgtcgccgggaagaaagcacttgaacatgctaacctcggcggtgaaaatctctctaagattgataaggagcgtgctggtgttttggttgggtctggaatgggtggtttaacagtgttttctgagggagttaagaatttgattgagaaaggacatagaaagataacaccattttttattccttatgcaattacgaatatgggttcggcattgcttgggattgatttgggtttcatgggtccaaattattcgatttcaactgcttgtgctacttcgaattattgtttttatgctgctgccaatcacattcgtagaggtgaggctgatttgatgatagctggtgggactgaagctgctattattcctattggtttggggggttttgttgcttgcagggcactttctcagagaaatgatgaccctagaactgcttctaggccttgggacaaagatcgtgatggttttgttatgggtgaaggttctggtgttctggtgttggaaagcttggaacatgctatgaaacgaggcgcacctatcattgctgaatacttgggaggtgctgttaactgtgatgcctatcacatgactgatccaagatctgatggacttggtgtgtctacatgcatccagagcagccttgtagatgccggtgtgtcacctgaggaggtcaactacataaatgcacatgcaacttccactcttgctggtgacttggcagagattaatgctatcaaaaaggttttcaagaacacttctggcataaaaattaatgccaccaagtctatgatagggcactgccttggtgcagctgggggtttggaagctattgccacagtgaaagccataacaacaggatgggtgcatccatcaatcaatcaattcaatccagaacctgcagttgattttgatacagtgccaaatgtcaagcagcagcatgaaattaacgttggcatttcaaattcatttggatttggtggacacaactctgttgtggccttttccgctttcaggccctgattttcacacttgtcttcaggccccgatttccaagcttgtcttcacttcatgtagaacatcgaatctaaattaattgaaattttgttctctctacatcattgaggctatttattttacgagttcttaatatataaaagcattagtcctgtaattgttaatttatgctaattgttgacagacagttagctcgaagactatttgctgtagaactttttaaatgtagcaggaaggtttcattggtccggagttatacagcggatagaaagtgtcaaaagagcttatttaaacattcttgttgttaagtaaagatatttattagcatgtattcatcattcttcttgttattgaatctttgttggttatatttgaatcagttcatagctcttttggatacgtgatgatacactactaacactagtatattctcaagaatggtttagattatgagatgtaccacatttaatgttggacatggttcaaattagattacctatgaaggacttgtgagaaaaagtaa

SEQ ID NO: 727 - DNA, 1732 bp, Brachypodium distachyon
atttaaccacctcgcgctctctcccgcgcgcctcactgcctcggctagtccaaaccgcaggctcccaaccatgcaatcccacgccgcccacgccctcgggctccgtggcccccctcccgcgctccccggccgccgccgcgctcgcccgtggcggcgccccgccacggccgtccgcgccgccgtggcgccgcagagggagactgacccgaggaagcgggtggtgatcacggggatggggctggtgtcggtgttcgggagcgaagtggacggcttctacgaccggctcctggccggggagagcggggtgcggactatcgaccggttcgaccccggcagcttccccacgagattcgccgggcagatacgggggttctcttcggaggggtacatcgacgccaagaacgaccggaggatggacgactgcatccggtactgcatcgtcagcggcaggaaggcgctcgagagcgccgggctcgacagaggctccgacgcgcacggcaagattgatctagggcgggctggtgttcttgtgggaactggcatgggtggcctttcagtgttctccaatggtgttcagaaccttattgagaagggatatagaaaaatttcaccattctttatcccatatgctataagtaacatgggctcagctttgcttgctacggatgttggtttcatgggtcccaattactcaatttcaactgcatgtgcaacctccaactactgcttttatgctgctgcgaaccatattcgtcgtggtgaggctgatgttatcgttgctggtggaactgaagcagctatcattccaattggccttggaggttttgtggcctgtagagcactatcacaacggaatgatgacccagaaactgcatctaggccatgggataaagagcgagatggctttgttatgggtgaaggtgctggtgtactggttatggagagcctggggcacgctataaagcgtgatgcaccaataattgctgaatacttgggaggtgcggttaactgtgatgcttaccatatgaccgatccaagatcagatggattgggtgtatcatcctgtattgcaaagagtctagaagatgcaggtgttgcgccagaggaggtgaactacatcaatgcacacgcaacttctacacttgctggtgacttggctgaagtaagagccatcaagcaagtcttcaagaatttgtcggagactaagattaattcaacaaagtctatgataggacattgcctgggcgcagctggtgggttagaagctattgccactatcaaatccataaccaatggatgggtccatcctaccattaaccaatttaactcagagcctgaagttgactttgatacagtagctaatgaaaagaagcagcatgaagtgaatgttgccatttccaactcatttggatttggagggcacaattcggtggtagtattcgcgccgttcaagccatgatttgccttagcttccaaaacatacaacccggcacgtgacattctctcgtggctgataatttagcaaggagaatgcctttatgtagcatgcttgattttataccggcttttgttcgccttcaaggagcaagttttgatgattgcttgagccgttgtttatacgattattctttcgggtgctccccgactcctcgtgtgtacagtgttgtaagaaactggaacattgtaaagaatcctcagtaatttctaatttggttatatagtttgatagttt

SEQ ID NO: 728 - DNA, 1699 bp, Brachypodium distachyon
tcggctagtccaaaccgcaggctcccaaccatgcaatcccacgccgcccacgccctcgggctccgtggcccccctcccgcgctccccggccgccgccgcgctcgcccgtggcggcgccccgccacggccgtccgcgccgccgtggcgccgcagagggagactgacccgaggaagcgggtggtgatcacggggatggggctggtgtcggtgttcgggagcgaagtggacggcttctacgaccggctcctggccggggagagcggggtgcggactatcgaccggttcgaccccggcagcttccccacgagattcgccgggcagatacgggggttctcttcggaggggtacatcgacgccaagaacgaccggaggatggacgactgcatccggtactgcatcgtcagcggcaggaaggcgctcgagagcgccgggctcgacagaggctccgacgcgcacggcaagattgatctagggcgggctggtgttcttgtgggaactggcatgggtggcctttcagtgttctccaatggtgttcagaaccttattgagaagggatatagaaaaatttcaccattctttatcccatatgctataagtaacatgggctcagctttgcttgctacggatgttggtttcatgggtcccaattactcaatttcaactgcatgtgcaacctccaactactgcttttatgctgctgcgaaccatattcgtcgtggtgaggctgatgttatcgttgctggtggaactgaagcagctatcattccaattggccttggaggttttgtggcctgtagagcactatcacaacggaatgatgacccagaaactgcatctaggccatgggataaagagcgagatggctttgttatgggtgaaggtgctggtgtactggttatggagagcctggggcacgctataaagcgtgatgcaccaataattgctgaatacttgggaggtgcggttaactgtgatgcttaccatatgaccgatccaagatcagatggattgggtgtatcatcctgtattgcaaagagtctagaagatgcaggtgttgcgccagaggaggtgaactacatcaatgcacacgcaacttctacacttgctggtgacttggctgaagtaagagccatcaagcaagtcttcaagaatttgtcggagactaagattaattcaacaaagtctatgataggacattgcctgggcgcagctggtgggttagaagctattgccactatcaaatccataaccaatggatgggtccatcctaccattaaccaatttaactcagagcctgaagttgactttgatacagtagctaatgaaaagaagcagcatgaagtgaatgttgccatttccaactcatttggatttggagggcacaattcggtggtagtattcgcgccgttcaagccatgatttgccttagcttccaaaacatacaacccggcacgtgacattctctcgtggctgataatttagcaaggagaatgcctttatgtagcatgcttgattttataccggcttttgttcgccttcaaggagcaagttttgatgattgcttgagccgttgtttatacgattattctttcgggtgctccccgactcctcgtgtgtacagtgttgtaagaaactggaacattgtaaagaatcctcagtaatttctaatttggttatatagtttgatagtttctccgcc

SEQ ID NO: 729 - DNA, 1908 bp, Euonymus alatus
ccagcttcctcacacaaactgactgaaaccaagtcatccattcatcgataacatcgaagagaaaaccaccatgcaatcccttcaatctacatctcttcgcgcatctcctctcaatccattccagaagaagagtagctgtgatcgaagcaatgccaagattcccaagagagtctctttcatcaaggcatcctcagcttctgtttcggctcccaagcgcgagaaggaccccaaggagcgcgtcgtcatcaccggaatgggcctcgtctccgttttcggcaacgaagttgataagtattacgacagattgctcaccggagagagcgggatcgggctcatagaccggttcgatgcctctaagttcccgacccggttcgggggccagatccgtggtttcaattcggagggttatattgatgggaagaatgataggcggcttgacgacagcttgcggtactgcattgttgctggcaagaaggcgctcgaggatgcggatcttggcggagacgatttgtccaagattgacaaggagcgagctggtgtgcttgtgggaacggggatgggtggtctttcagtattttccgatggtgttaaggctctaattgagaaaggacacaggaaaataacccctttcttcattccttatgctataacaaatatggggtcggcattgcttgcaattgaacttggtttcatgggacctaactattcaatttcaactgcatgcgctacttccaattattgcttttatgctgctgccaatcatattcgtcgaggtgaggctgatttgatgattgctggtggaacggaagcagccatcatacctattggtttggggggctttgtagcatgtagggcgttgtctcagagaaatgatgatccacaaactgcttcaaggccatgggacaaagatcgtgatggctttgttatgggggaaggagctggagtattggttatggagagtttggagcatgcgatgaaacgaggtgcaccgattattgcagagtacttagggggtgctgtcaactgcgatgcgtatcacatgactgatcccagagctgacggacttggggtctcctcttgcattgagagaagccttgaagatgctggtgtgtcacctgaagaggtgaactacataaatgcacatgcaacttccactcttgctggtgacttggctgaaataaatgctatcaaaaaagtattcaagaacacttcagggatcaaaattaatgcaaccaagtctatgatagggcactgccttggagctgctggaggtttggaagctattgccactgtgaaagccataaccacaggatggctgcatccttctattaatcaatttaatccagagccttcagttgactttgacactgtccctaataaaaaacagcagcatgaagtgaatgtcgccatttcaaattcatttggattcggtggacacaactctgtcgtggccttttctgcattcaagccatgattacagtatttctgcttcttccattgggggtcgcatcaattcactcggcacttggttgttaatagtcaatgagtccacctcatcgtctacctctgacttgagctgttgcaggttctgtcagttctattttagctttcgccatgtaataattgctagttgaactctcaagtttagtcaatccgccgtttctcttctttgctgttttttttgttagaacttttggattattaaggttattggagcatttggattttgtctagttaaattatgcagcagatagagaataaaatgacatttctcgctgagattatattattgtaatagatggcatttgggatcctcgcaatgcattgtctctcttgatacagcggtttgattatccggattcagaaatccctgcgtgataatttttctcaagaatccctgagatgttg

SEQ ID NO: 730 - DNA, 1813 bp, Panax ginseng
cagtggtatcaacgcagagtacatggggactcacctcgtttttgtcgatccattccttatatacacatttccctcacttccattcatcagcttcaccattttctctctatatccatcactttctctctccatatctatcttcaccatgcaagctcttcaaccttcccacctccgaccctccccgctcgacccacttcgcaaaaactccggcgctgccatttccaatgccaagccgccgagaaagatctcattcatcactgcttcatccaccaattccgcccccaagagagagaaagatccgaagaagcgcgtggtaatcactggaatgggcctagtctctgttttcggtaacgatgttgatgcttattacgataagctgctctccggcgaatcaggtattgggccaatcgaccgatttgatgcctccaagttcccgacccgatttgggggccagattcgtgggtttaattcggaagggtatattgacgggaagaatgaccggcggcttgacgattgtcttaggtactgcattgttgctggcaaaaaggcacttgaaaatgctgatcttggaggcgataagcggactaagattgacaaggagcgtgctggtgttcttgttggaactgggatgggtggtcttacagtattttctgatggggttcaggctctcatagagagaggtcacaggaaaatcaccccgtttttcataccttatgccattacaaacatgggttctgccttgcttgcaattgatcttggcttcatggggccaaactattcaatttcaactgcttgtgccacctctaattattgcttttatgctgccgccaatcacatccgtcgaggtgaggccgatttgatgattgctggtggaactgaagctgctattattcctattggattgggaggctttgttgcttgtagagcattgtctcagagaaatgacgatccaaagactgcttctaggccatgggacaaagacagagatggctttgttatgggtgaaggtgctggagttttggtaatggagagcttggaacatgcaatgaaacgaggtgcaccaataattgctgaatacttgggaggtgcagttaattgtgatgcttatcatatgactgatccaagatctgatggacttggtgtttcgtcatgcattcaaagcagtcttcaagatgctggtgtttcactggaggaggttaactacataaatgcacatgcaacttctactatagttggcgaccttgctgaggtgaacgctgttaagaaggtgttcaagaacacttcagggataaaaatgaatgcaaccaagtctatgataggccactgcttgggtgctgctgggggtttggaagctattgcaacagtgaaggccattactacagggtggcttcatcctacaataaatcaatataaccctgagccttcagttgagttcgacaccgttgcaaatcaaaagcaacagcatgaagtgaatgttggcatctcaaattcatttggatttggcggacacaactcagtggtggccttttctgcattcaaggcataagttagctcgtcttctttgtcctttgtagtcatagcaatctgtgcttatctgaggtttagtccaattccttgtggaggctacaaaacaaattttagcattcatagttgtccttttttgtatcaatttccggtttgactcttgattgagttctctcagctctctcaccttagatatttgttgaaacagtgaggcagaaagttgtccagttttgaattatgtaatgaatagttgacgatcgaccttgtggttcattaactttacttggac

SEQ ID NO: 731 - DNA, 1965 bp, Medicago truncatula
gtcaaagttgccgttatatttatgaactccgaaatttccaatgcagaagaaaacatagttattaccgtcaaaatacattaaataccaacaacttgttagtactaactatcttaccttacattacacactcattcacactcactcaccttcttcgtactctccgtcagttagtgtcagtcatttcatcaaacacttacaatgcaatcagttcagattcaacaacaacttccctccactctccgtccttcaccgctcgaaccacttcgccgtaaatcctccaatgccgccaccgccaccgccaaaacaaagagagttactcgtatctccgccgcggtcaccaccaccactgcgcctcaaagagaaaaggatccaaagaagcgtgttgtgattaccggtatgggtcttgcttcggtgtttggaaatgacgttgatgcttactatgataagcttctcgctggtgagagtggtatcacttccattgatagatttgatgcttccaaattcccaactcgattcgctggtcagatccgtgacttcagttctgagggttacattgacgggaagaatgaccggagactcgatgattgtctccggtactgcattgtcgccggtaagaaagcactcgaacacgctaatctcggtgctgcaaatttatccaagattgataaggaacgtgctggtgttttggttgggtcaggaatgggtggtttaactgtattttctgaaggagttaagaatttgattgaaaagggatatagaaagataacacctttttttattccttatgctattacaaatatgggttcagctttgcttgggattgatttaggttttatgggtccaaattattctatttctactgcttgtgctacttcaaattattgtttttatgctgctgccaatcacattcgtagaggtgaggctgatttgatgatcgccggtgggactgaggctgcgattattccgattggtttgggtggttttgttgcttgtagggcactttctcagagaaatgatgaccctaaaactgcttctaggccttgggataaagcacgtgatggttttgttatgggtgaaggttctggagttttggtattggaaagcctggaacatgccatgaagcgaggtgcacctattattgctgaatatttgggaggtgctgttaactgtgatgcttatcacatgactgatccaagatctgacggactcggcgtgtctacatgcatccagagcagccttgaagacgccggtgtgtctcctgaggaggtcaactacataaatgcacatgcaacttccactcttgctggtgatttggcggagattaatgctatcaaaaaggttttcaaggacacttctggcatcaaaataaatgccaccaagtctatgataggtcactgtcttggtgcagctgggggtttggaagctattgccacggtgaaagccataacaacaggatggctacatccatcaatcaatcaattcaatccagaacctgcagttgattttgatacggtggcaaatgtcaagcagcagcatgaaattaatgttggcatttcaaattcatttggattcggtggacacaactctgtcgtggctttttctgctttcaggccctgattgccaggcttgtcttctcttcatgtagaacactgaatctaaattaattgaaattttgttctctctacgtcattgaggctatttattaatgagttcataatatataaaagtgtagtcctgtaattgttcattatatgctaattgtgaacagccagttagctccaaagacttttgctgtagaactttttaaatgtagcactaagatttcattggtttgaagttatatagcggagagaaagtgtcgagagagcttatttagacattcttccttattgttaattaaagatatatattagcatgtatttatgatacttcttgttattgaatctttgtcggttataattaaat

SEQ ID NO: 732 - DNA, 1679 bp, Helianthus annuus
ccaccatgcaagctcaagctctcctccaatcaccccacttccgggtctccccactcgacccgctccgaacccgccccaaacccaccaacttcaaaccccgaaccaccgtcattgcatccgccaccgcccctaaacgcgaaaaagaccccaaaaaacgggtcgtcatcacgggtatgggtctggtatccgtattcggaaacgatgtggatacttactatgagaaattgttagcaggggagagtggaatcgggttgattgatcggtttgatgcgtccaagtttccgacccgattcggtgggcagattcgtgggtttaagtctgatgggtatattgatgggaagaatgataggaggcttgatgattgtttgaggtattgcattgttgctggtaaaaaggcgcttgaagatgctgatcttggtggtgataaattatctaagatcgataaggagcgtgccggtgtgcttgttggaacaggaatgggaggtcttactgtgttttccgacggagttcagaatctaatcgaaaagggttacagaaaaatcacaccttttttcattccttacgccataacaaacatgggttcggctctgctcgctattgatgttggattcatgggtccaaattactcgatttcaaccgcatgtgctacttcaaattattgcttttatgctgctgcaaatcatattcgaagaggggaagctgacatgatgattgctggtggcactgaagctgccattattcctattggtttgggtggttttgtggcgtgcagggccctttctcagagaaatgatgacccgcaaacggcttctagaccatgggataaagacagagatggttttgtcatgggtgaaggtgctggtgtgttggtgatggagagcttagaacatgcaatgaaaaggggtgcaccaataattgccgaatacttgggcggggcggttaattgtgacgcttatcatatgactgatccacgatccgacggtcttggtgtttcttcttgcattcaaagcagccttgaagatgctggtgtgtcaccagaggaggttaactacataaatgcacacgcaacgtcaacattggttggtgatctggcggaggtaaatgctgtaaagaaggtgttcaaaagcactgacgggatcaaaatgaattcaaccaagtctatgattggacactgcctaggtgcagccggaggtctagaagccattgctacggtcaaagccattcaaacaggatggttgcatcccaccataaatcaatttaacccagagcctgcagttgaatttgacaccgttgccaatcaaaagcaacaacacgaagtcaacgttgccatttcaaattcatttggttttggtggacacaactccgttgtagcgttctctgcattcaaaccttgatatgatctcttccaagtcatttttgaggcttcatcagttgttcttgttctttattgtatgtcattataagcgcgttttgattttgtaatcgttgttttgtatgtgattctggtttaaaagacatctacgacatttgcataccgatttaggcattgaattttgagttgggacaagtttggggattagcattgggttacagacagtttgtagcttttgttttgtgtattattcggtatgtcaaatttgttcatcctctcttttggctacgttttaagagattgtgtt

SEQ ID NO: 733 - DNA, 1779 bp, Tripterygium wilfordii
cagctgccatgcccaccttttgttcacaacttcctcacacaaactgactgaaaccaagccatccatccatcgataacatcgaagagaaaaaccaccatgcaatcccttcaatctacatctcttcgcgcatctcctctcaatccattccagaagaagagtggcggtgatcgaagcaatgccaagattcccaagagagtctccttcatcaaggcatcctcagctcccgtttctgctcccaagcgcgagaaggaccccaagaagcgcgttgtcataacgggaatgggccttgtctccgtttttggcaacgaagttgataagtactatgacaaattgctcgccggagagagcgggatcgggctcatagaccggttcgatgcctctaagttcccgactcggttcgggggccagatccggggcttcagttcggagggttatattgatgggaagaatgataggcggcttgacgactgcttgcggtactgcattgtcgctggcaagaaggcgctcgaggatgcggatcttggtggagacgatttgtccaagattgacaaggagcgagctggtgtgctcgtgggaacggggatgggtggtcttacagtcttttccgatggtgttcaggctctaatagagaaaggacccaggaaaataacccctttcttcattccctatgctataacaaatatgggatcggcattgcttgcaattgaactcggtttaatgggacctaattattcaatttcaactgcatgcgctacttccaattattgcttttatgctgctgccaatcatattcgtcgaggtgaggcggatttgatgattgctggcggtacagaagcagccatcatacccattggtttggggggttttgtagcatgtagggccttgtctcagagaaatgatgatccacaaactgcttcaaggccatgggacaaagatcgagatggctttgttatgggggaaggagctggagtattgattatggagagtttggagcatgcgatgaaacgaggtgcaccaattattgcagagtacttagggggtgctgtcaactgcgatgcatatcacatgactgatcccagagctgatggacttggggtgtcctcttgcattgagagaagccttgaagatgctggtgtgtcacctgaagaggttaactacataaatgcacatgcaacttccactcttgctggtgacttggctgagataaatgctgtcaaaaaagtattcaagaacacttcagggatcaaaattaatgcaaccaaatcgatgatagggcactgccttggagcttctggaggtttggaagctattgccactgtgaaagccataaccacaggatggctgcatccttctattaatcaatttaatccagagcctgcagttgactttgacactgtcgctaatcaaaaacagcagcatgaagtgaatgttgccatttcaaattcatttggatttggtggacacaactctgtcgtggccttttctgcattcaagccatgattacacagtatgtctgcttcttccattagaggttgtatcaagtcactcggcactcagttgttaataatcaacgagtccacttcatcttctacctcttacttgagctattgaggttctgtcagttctattttagctttggctgtgtaatacttgctatttgaactcttaagtttaggcaagccgttgttgtttctcttcgctgtcttttcaattggaacttttggattattaaggttattggagcatttgatttttgtctagttgaatatgtagcagata

SEQ ID NO: 734 - DNA, 1874 bp, Elaeis guineensis
cggccgaagtacgttcctaaggccgtccgaaccgagaccgctgcagaccattccggcgtccccgtccaccggaaccggccgtacccgcccgttgtccccctccttccggtcctcccgtctcgtcgcccgcccgacgtcctcccccggtccgcgggccgtcctcctccgcccgatccgtcctcgcggcccggccgtccgcgcctccgtcgcggcggcggcggcggcggcgccccggagggagacagatccaaggaagcgggtggtgataacggggatggggctggtgtcggtgttcgggaacgacgtcgatgtttactaccagaagctgctggaaggggagagtgggatcgggccaatcgaccggttcgacgcctccaagttgccgacgaggttcgccggccagatcagggggttctcgtcggaggggtacatcgacgggaagaatggccgccggctcgatgactgcctgcggtactgcctcgtcagtggcaagagagcgctcgagagcgctgggctaggcgttgggagcaaggccctcggcaaggttgacaaggcacgagctggtgtacttgtggggacgggcatgggtggcgttacagtgttatgtgatggtatctggtctctcacagagagcaactacaagaaagtaactcctttttctattccttatgccataacaaacatgggctcggccctgctggcaatggatattggcttcatgggtgcaaactattcaatttcaactgcctgtgctacttcgaattattgtttctatgctgctgccaaccatattcgtcgtggtgaggctgatgtaatgattgctggtggtacagaagccccaattattcccatgggtgttgggggttttgtggcatgtagagcattgtcacagagaaatgacgaccccacaactgcatcaaggccatgggacaaagatagagatggctttgttatgggagaaggtgctggagtcttggttatggagagtctggaacatgcaatgaaacgtgatgcacctattattgctgagtacctgggaggtgctgttaactgtgatgcttatcatatgacgtgtcctagagctgatgggctcggcgtgtcctcttgcatccaaaaaagtctggaacatgctggtgttgcaccagaagaggttaactatataaatgcccatgcaacttctacacctgccggtgatctagctgaggtgaatgcaattaaacaggtgttcaagaacccatcagacgtcaagatcaatgcaaccaagtccatgatagggcactgccttggtgcagccgggggtttagaagcgattgcaacagtgaaagccatagctactgggtggctgcatccaacaatcaaccaattttccggagcctgcagttgaatttgatacagtggcaaataaaaagcagcaacatgaggtgaatgttgccatttctaattcatttggatttggaggacacaactcggtggtggtgtttgcgccttttaagccatgatccatcatagtttgcctttggcattctgtttcaactacagaattttccacattgagggggaaaagaatttagttgtttcaagtaggcattttccattttactgaagcaagttttgacaacaaaagcttttaattatgtgggagtagtagcgttaggtggtttaatgcggcggcttcggtcattttaagtttaggaagagcattcatactgcgggccccctgtgattgaactctgagagatgttgtgtctttaacattgattagtttttccacaaaaagaagtgcttagtttattacaaaaaaaaaacaatagaacgttacgtaccgaaaccggaacggacaaccaaggggaaggtaggagacccccccccccccc

SEQ ID NO: 735 - DNA, 1992 bp, Amaranthus tuberculatus
caccctcttctcattttagcttccttcctcgaccacatcgtcatccattttcctccattgtagctcttcttctccccacaattctgcttctcaatctctcctttctccctcctccttcttcttcttccctctgcaacaccatcatccaacaatgcaagctcttctctccccaaatctccgaccttctcccctcgacccattccacaaaaagtcccaattcccaaaatgcaaaaccccaaacagagtctccttcttcacgcctcgagcgtctgtttctccgtctcaagtagcacctaaaagagaaacagaccctaaaaagagggttgtaattacaggaatgggtcttgtttctgtgtttgggaatgacccagatgttttttatgaaaagcttcttgatggggttagtgggattgcccccattgatcgttttgatgcttctaagttccctactcgatttgctggacagatccgtgatttttcttctgaagggtatattgatggaaagaatgatcgtcgtcttgatgattgtcttcgttattgcattgttgctggaaagaaagctcttgaatctgctgatcttgggtctgataatctctctaagattgacaaagtgcgagcgggtgtgcttgtgggaactggtatgggtgggctcacagttttttctgatggtgttcaagcgttgattgagaaaggtcacagaaaaataactccatttttcattccatacgccataactaatatggcatccgcattgcttgccattgatcttggtttgatgggacctaattattcaatatcaaccgcctgtgctacttcaaattactgtttctatgctgctgctaaccatatccgtcgtggagaagctgatgtaatggttgccggtggaactgaagctgctattcttcctattggtttgggaggttttgttgcatgcagagctttgtcgcagaggaatgatgatcctcagacagcttcgaggccatgggacaaagaaagggatggctttgtgatgggtgaaggagctggtgtactggtaatggagagtttggagcatgcaatgaaaagaaatgctccgattattgctgagtacctgggaggtgcagtaaattgtgatgcttatcacatgactgatcctcgatctgatggacttggtgtttcctcatgcatcgagagaagcctagaagatgctggtgtgtcacctgaagaggtcaactacataaatgctcatgcaacctccacaattgttggtgacttggctgaggtgaacgccgttaagaaagtctttaaaaatacatctgaaatcaagatgaatgcaactaagtctatgataggacattgtcttggtgctgccggtggtctggaagctatcgctacagttaaagcttgtacaactgggtggttgcatcctaccattaatcaatttaatccggagccatcggtcgagtttaatacagttccaaataaaaagcaacagcatgaagtgaatgttgcgatttcaaattcttttggatttggcggtcacaattcggtggtagtattctccgccttcaaaccttgattggttgcataatgaagattttgtggttgtcaaggagagcttagagtttgtgcgcttcgtaactttcagacaattgtattcttttcattcttctctacccgtgatgaattttcgaaggaaacaggggaacttttctgcgatctccattctccggtctttagatcaaaagataataagtaaaatctgtagcttagagaagtagacatacatctttcatctatattttcagttgagctagtgaaccaaactgttggcggcttctttgggactatttgtttcatacaattgaatataatttagatgactacattgaaatttgtatgttaaaagtaatttctaaggtggattgttcattagagcattaggactactttgttctatttttgaaataaagttgtcatttcttggagattgatgttgatgtcgatgtcgat

SEQ ID NO: 736 - DNA, 1872 bp, Echinacea purpurea
gacaaacgcaggatttggttagatctgccactaaaacacatcagcgacagttgtattctccatcctcttatctaccataccctcttcactcaaatccatccaacaacatgcaagcacaagctcttctgcaatcaaccccacttcgggtctccccactcgacccgattcacaaaccaaccaatgccaaatcttcttcactctccacgcgccgccgcgcagttatttccgccgtcgccgccgccgcccccaagcgggaaaaagatcccaagaaacgggtcgtcattacgggtatgggcctggtttccgttttcggaaacgatgttgatacgtactatgagaagctcttggcgggtcagagtggaatcgggttgatagaccggttcgatgcgtccaagtttccgacccggtttggtggtcagattcgtgggtttaaggctgatgggtatattgatgggaagaatgaccggaggcttgatgattgtttgcggtattgcattgttgctggtaagaaggcgcttgaagatgctgatcttggtggggacaaactctctaagattgacaaggagcgtgctggcgtgctggttgggacaggaatgggaggtcttacagtgttttctgatggagtccagaatctaatcgaaaagggttacagaaaaatcacaccctttttcattccttacgccataacaaacatgggttctgctttgcttgctattgatcttggattcatgggtccaaactactcgatttcaactgcatgtgctacttcaaattattgcttttatgctgctgcaaatcatatccgaagaggggaagctgatatgatgattgctggcggcactgaagccgccatcattcctattgggttgggtggttttgtggcatgtagggccctctctcaaagaaatgatgacccacaaacggcttctagaccttgggacaaagatagagatggttttgttatgggtgaaggtgctggtgtgttggtgatggagagcttagaacatgcaatgaaaagggatgctccaataattgccgagtacttgggtggagcggtaaattgtgatgcttatcatatgactgatccgcgatctgacggtcttggtgtttcttcttgcattcaaagcagccttgaagatgctggtgtgtcaccagaggaggttaactacattaacgcacacgcaacttcaacattggttggtgatttggcggaggtaaatgctgtaaagaaggtattcaaaagcactgcaggaataaagatgaatgcaaccaagtctatgattggacactgcctaggtgcgtctggaggtctggaagccattgctacagtcaaggccattcaaacaggatggctgcatcccacaataaatcaatttaacccagagcccgcagttgaatttgacactgttgcaaatcaaaagcaacaacacgagatcaacgttgccatttcaaattcatttggtttcggcggacacaattctgtggtggcgttctctgcattcaaaccttgatatgatcccttcgagtcatttttgaggcttcgctagcttatctaaaccgcttgttcttgttctttattgtacgtcattacgagcacattttgatcttatgatcgttgtttcatgtgattcgggttctctataacatatgctataattggtcttgtggccaatctgtaccaatttagacattattgagttttgagttggaacatgattcggagactagcattgggttatagggtttcagacagtttgtagcttttgcaatgtgtattattcagtatgttgttaaatttgtttctcctctcttttaggtatgttataagatgattttataagtttgtttatcctctcttttaggtatgttata

SEQ ID NO: 737 - DNA, 1834 bp, Nicotiana tabacum
ggaaaaacattgctcctgtctgtctcccttctctctactggaaaagcgcattagtacaacggaaccacatcgttcacatcgaaagctcttctctcctgcttcttcttcctcagtaaaccatgcaatcaatccaatctccatctttccgtccatctccactcgatccacttaaaaaaaccgtcccccaattgaccaatgttaggccattgagtcatgctaaaagagtgccctttatttcagcttcagccaccactgtttccgctcccaaaagagaaaaagacccaaagaaaagggttgttataactgggatgggccttgtttctgtgttcggtaatgacgtcgatacttactatgacagacttttggctggtgaaagtggtatttcgctcattgatcgttttgatgcttctaagttccccacaagattcgggggacaaattcgtgggtttacatcagatggatatattgatgggaagaatgataggaggcttgatgattgtcttaggtatgccattgttgctgggaaaaaagctcttgaaaatgcagatcttggtggtgacagacttggaaaggttgataaggagagagcaggtattctggtaggaacaggaatgggtggtcttacggttttctcagatggcgtccaaaaccttattgaaaagggtcacaggaaaattactccattttttataccatatgccataacaaacatgggttctgccttgcttggtattgatcttggttttatgggaccaaactactcaatctcgactgcttgtgctacctccaattattgtttttatgctgccgccaatcacattcgcagaggtgaagctgatttgatgctagctggtggtactgaagctgccataatacctattggattaggaggttttgtggcatgtagagctttgtctcaaaggaatgatgatccacaaactgcttccagaccatgggacaaagaaagagatggctttgttatgggcgaggggtctggagtcttggtgatggaaagtttggagcatgcaatgaaacgaggagcgccaataattgcagagtatttgggtggtgcagttaattgtgatgctcatcacatgactgatccccgagctgatggtcttggtgtttcgtcatgtattcaaagcagccttgaagatgctggagtgtcaccagaagaggttaattacatcaatgctcatgcaacttccaccattgttggtgatatagcagaggtaaatgctattaagaaggtattcaagaacacctcaggaatcaaaatgaatgcaaccaagtctatgatagggcattgcctgggcgctgctggtggtatggaagctattgcaacagttaaagctattacaaccggctgggtgcatccttcaattaaccaatttaatcccgagccttcagtggagtttgatactgttccaaacaaaaaacagcagcatgaagtgaatgtcggaatctcaaactcctttggttttggtggtcacaactctgtcgtcgcctttcctgcattcaagccttaatccagctcacttcagcaaagagcaatcctccttttgtggaggcataatatagaggattacagtgaaacagaggctgtttcatctccgcatggctataaacaaggcgctgcgagagatgaacaattgtcaattcttttatataataatttttggcttgtagttcttagcttagcaacgaacattcttacttttcgcatgtgttttcactccttaaattagcttggaccttcacagcttgattagacaacaatgctatcggttttgaattatgtgaaagatgcgagctttgaaatagcggccgcatg

SEQ ID NO: 738 - DNA, 1667 bp, Platanus occidentalis
gagccaatgccaggatcaccaggaagcaaccatcgaagctgatctctgcttcagcttcaaccacagcctcagctcccaagagagagacggatcccaagaagcgagtggttatcacagggatgggccttgtctccgtcttcggcaacgacgtcgatgcctactacgaccgcctcctcgccggtgagagcgggatcagtctcatcgaccgcttcgacgcctccaaattccccacccgtttcggtggccaaatccgcggcttcacctcccaaggttacatcgatggcaagaacgaccgtcgcctagacgattgtctcagatactgcctcgtcgctggtaagaagtccctcgaggatgctggccttggcggcgataacctctccaagattgacaaggagcgagctggtgtgcttgttggaacaggcatgggtggtcttacagtttttgctgaaggtgttaaaaatcttctagataaaggctacagaaaaataactccatttttcattccttatgctataacaaacatgggatctgctctccttgcaattgacctgggttttatgggtccaaactattcaatttcaactgcctgtgctacctccaattattgtttctgtgctgctgccaaccacatccggcgaggtgaggctgatttaatgattgctggtggaactgaagctgcaattattcctattggttggggggttttgttgcttgtagagctttatcacagagaaatgatgatccacaaactgcttcaaggccgtgggacaaagatcgagatggctttgttatgggagaaggtgccggggtgttggtaatggagagcttggaacatgcattgaaacgtgatgcaccaattattgctgaatacttgggaggtgcagtcaactgtgatgcctatcatatgactgatcccagagctgatgggcttggtgtttcatcatgcatcgaaagaagccttgaagatgctggtgtgtcaccagaggaggttaactacataaatacgcatgcaacttccactcttgctggtgaccttgctgaggtgaatgccataaaaaaagtattcaagaacacttcagagataaagataaatgcaaccaagtctatgatagggcactgccttggtgcagcagggggtctagaagccattgctaccatgaaggccataactacagggtggctgcatcctactattaaccagtttaatccagagccttcagttgagttcgatacagttgcaaatgaaaagaagcaacatgaagttaatgttgccatttcaaattcttttgggtttggaggacacaactcagttgtggccttttcagcattcaagccttgatcacccagttgtgattctggaagaacaatctttctcatttgtgacttcccacattcgatttcttgtagaggcaattttcaactcttttacttctggcttcctacataaggtcatttagctgggctttgttttttatgaatgcaattttgttaaagaacttgaacttgaacttgactaaccatcttcaagttaaggcttcctaggaactgaaggggcgtagtgcatgaggtttcgttcagttttgcagtatgtagttgataaaagcacatggtgaagggtgaattatatatattgctctagggtgtattcttaccagacatttctgaac

SEQ ID NO: 739 - DNA, 1808 bp, Panax ginseng
aatctgaactctcgtttttatcgaatttccatttctcctgtattcataaatctccctcacttcgatccgtcagctccaccatgcatgctcttcagtcttcgcctctccgagcttccccgctcgacccactacgcaaaaactccgccaccaccatttccaatgtccagccacccaaaagggtctcattcatcacagcttcatccaccaattccgcccccaagcgagagaaagatccgaagaagcgagtggtaatcaccggaatgggattagtctccgtttttgggaatgtagttgatgcttattatgataagcttctctccggcgattctgggattggacccatcgaccgatttgatgcctccaagttcccaactcgatttgctggccagattcgtgggttttcgtcggaagggtatattgatggaaagaatgaccggcggcttgacgattgccttcgttattgcattgttgctgggaaaaaggcactcgaagatgctgatcttggcggagataagcgctcaaagattgacaaggagcgggctggtgtaattgttggaaccggaatgggtggtcttacagtattttctgatggtgttcaggctctcatagagagaggtcacaggaaaatcacaccgtttttcataccttatgccataacaaacatggggtctgccttgcttgcaattgatcttggcttcatgggaccaaactattcaatttctactgcttgcgccacctctaattattgcttttatgctgctgccaatcacatccggcgaggtgaggctgatttgatgattgctggtggaactgaagctgctattattcctatcgggttgggaggctttgtggcatgtagagctttgtcccagagaaatgacgatccaaagactgcttccaggccatgggataaagatagagatggctttgttatgggtgaaggtgctggagttctggtaatggagagcttggaacacgcaatgaaacgaggtgcaccaataattgctgaatacttgggaggtgcagttaattgtgatgcttatcatatgactgatccaagatctgatggacttggtgtttcatcatgcattcaaagcagtcttcaagatgctggtgtgtcgccggaggaggttaactacataaatgcacatgcaacttccactatagttggtgaccttgctgaggtaaacgctgttaagaaggtattcaagaacatttcagggatcaaaatgaatgcaaccaagtcgatgataggccactgcttgggtgctgctgggggtttggaggccatcgcgacagtgaaagccattactacagggtggttgcatcctacaataaatcaatttaactctgagtcttcagttgagtttgacaccgttgcaaatcaaaagcaacagcatgaagtgaatgttggcatctcaaattcatttggatttggtggacacaactcagtggtcgccttttctgcattcaagccatgatttagctcatcttcttcattctttgtagccataggcaatctgtgcttatccgaggtttagtccaatttcttgtggaggctgcaagcttagaggattcatagttatccttttctgtatcaatttccgatttaactcttggttgaggcctctcattccttttacccttttagatacatgttgatactgtgaggcagactaggcatgagaagttatccagttttgaattatgtaatttatagttggagactggccatggggttcactaatttttacctggcatctgttttttactggagcatgttttgttagttggtaatgaagatgcgt

SEQ ID NO: 740 - DNA, 1926 bp, Panax ginseng
tgttggtatgactttataagcccacttttgaaaagattacaaatttagctctaccctaagcctcactatttgtgtgtgggcagttagatcccaaaaccataatctgaactctcgtttttatcgaatttccatttcccctgttttcacaagtctccctcacttcgatccgtcagctccaccatttactctctccaccatgcatgctcttcaatcttcgcctctccgagcttccccgctcgacccactacgcaaaaactccgccaccaccatttccaatgttcagccacccaaaagggtctcattcatcacagcttcatccaccaattccgcccccaagcgagagaaagatccgaagaagcgagtggtaatcaccggaatgggattagtctccgtttttgggaatgaagttgatgcttattatgataagcttctctccggcgaatctgggattggacccatcgaccgatttgatgcctccaagttcccaactcgatttggtggccagattcgtgggttttcgtcggaagggtatattgatggaaagaatgaccggcggcttgacgattgccttcgttattgcattgttgctgggaaaaaggcactcgaagatgctgatcttggcggagataagcgctcaaagattgacaaggagcgggctggtgtaattgttggaaccgggatgggtggtcttacagtattttctgatggtgttcaggctctcatagagagaggtcacaggaaaatcacaccgtttttcataccgtatgccataacaaacatggggtctgccttgcttgcaattgatattggcttcatgggaccaaactattcaatttctactgcttgcgccacctctaattattgcttttatgctgctgccaatcacatccggcgaggtgaggctgatttgatgattgctggtggaactgaagctgccattattcctatcgggttgggaggctttgtggcatgtagagctttgtcccagagaaatgacgatccaaagactgcttccaggccatgggataaagatagagatggctttgttatgggtgaaggtgctggagttctggtaatggagagcttggaacacgcaatgaaacgaggtgcaccaataattgctgaatacttgggaggtgcaattaattgtgatgcttatcatatgactgatccaagatctgatggacttggtgtttcatcatgcattcaaagcagtcttcaagatgctggtgtgtcgccggaggaggttaactacataaatgcacatgcaacttccactatagttggtgaccttgctgaggtaaacgctgttaagaaggtattcaagaacacttcagggatcaaaatgaatgcaaccaagtcaatgataggccactgcttgggtgctgctgggggtttggaggccatcgcgacagtgaaagccattactacagggtggttgcatcctacaataaatcaatttaactctgagtcttcagttgagtttgacaccgttgcaaatcaaaagcaacagcatgaagtgaatgttggcatctcaaattcatttggatttggtggacacaactcagtggtcgccttttctgcattcaagccatgatttagctcatcttcttcattctttgtagccataggcaatctgtgcttatccgaggtttagtccaatttcttgtggaggctgcaagcttagaggattcatagttatccttttttgtatcaatttccgatttaactcttggttgaagcctctcattcctttttacccttttagatacatgttgatactgtaaaggcagactaggcatgagaagttatgcagtattgaattatgtaatttatagttggagactggccatggggttcactaatttttacctggcatctgttttttactggagcatgttttgttagttggtaatgaagatgcgt

SEQ ID NO: 741 - DNA, 1605 bp, Gossypium hirsutum
caacactccctcccaggcctgccaagaaattctcttccattaccgcttcatcccccactgtttcagctcccaagcgcgaaaaggaccccaagaaacgggtcgttattacgggaatggggttggtttccgtttttgggaacgatgtggatgcttactatgaaaagctgctggctggagagagcgggatcggaatcatcgaccgcttcgatgcttccaagtttcctactcggttcgccggtcagatccgggggttcacttctgaaagttacattgatggaaagaacgataggaggcttgacgattgcttgaggtactgcattgttgcaggcaagaaggcgttggaagatgctgatctcggcgccgataacttatccaagattgataaggagcgaactggagtgcttgttggaactggtatgggtggccttacggtgttctctgatggcgttcaaaatttgatagagaaaggttatagaaaaataacaccattcttcattccttattctataacaaacatgtcatctgccttgcttgcaattgaacttggttttatgggtcccaattattcaatttcaactgcttgtgctacctccaattattgcttttatgctgctgctaatcacatccgtcgaggtgaggctgaattgatgattgctggtggaactgaggctgcaatcattcctattgggctgggaggttttgttgcctgtagggcattgtctcaaagaaatgatgatcctcgaactgcttcaagaccatgggacaaagatcgagatggctttgtaatgggtgaaggtgctggtgttttggtaatggaaagcttggaacatgcaatgaaaagaggtgcaccaattattgctgagtatttgggtggagctgttaattgtgatgctcatcacatgactgatccaagagctgatggttttggggtgtcttcatgcattgagagaagtcttgaagatgctggtgtgtcccctgaggaggttaactacatcaatgcacatgcaacttctactcttgctggtgacctagctgagatcaatgctattaaaaaggtattcaagaatacatcagacatcaaaatcaatgcaacaaagtccatgatagggcattgtctgggcgcatcgggtggtttagaagccattgccacagtgaaggccatcacaacaggatggctgcatccctccataaatcaatttaatccagagccttcagttgagtttgacactgtggccaaccaaaagaaacaacacgaagttaatgttgcaatttcgaattcattcggatttggtggacacaactcagtggttgccttttcggccttcgagccttgaaagtctttgtcatttagttttgcattggttagggaagatagagagagagataggcgttggcttgcttcaataattgaagccaaaaatgtaacagttagtgttgtaataataagttttaagtcaaatggaagcgcttaggagtcatttcccccgtccccctctttaaactactcttaatgttatgctctaaattatgtttagttattgagaagactggactatttaaatcaaaatatcatatcaatgatcctcggtttgcaggatcattcat

SEQ ID NO: 742 - DNA, 1915 bp, Echinacea purpurea
atataattttcatgacatacttaagtttatgttggccaacccttgacaaacgcaggatttggttagatctgccactaaaacacatcagcgacagttgtattctccatcctcttatctaccataccctcttcactcaaatccatccaacaacatgcaagcacaagctcttctgcaatcaatcccacttcgggtctccccactcgacccgattcacaaacccaccaatgccaaatcttcttcactctccacgcgccgccgcgcagttatttccgccgtcgccgccgccgcccctaagcgggaaaaagatcccaagaaacgggtcgtcattacgggtatgggtctggtctccgttttcggaaacgatgttgatacgtactatgagaagctcttggcgggtcagagtggaatcgggttgatagaccggttcgatgcgtccaagtttccgacccggtttggtggtcagattcgtgggtttaaggctgatgggtatattgatgggaagaatgaccggaggcttgatgattgtttgcggtattgcattgttgctggtaaaaaggcgcttgaagatgctgatcttggtggggacaaactctctaagattgacaaggagcgtgctggcgtgctggtcgggacaggaatgggaggtcttaccgtgttttctgatggagtccagaatctaatcgaaaagggttacagaaaaatcacaccttttttcattccttatgccataacaaacatgggttctgctttgcttgctatcgatcttggattcatgggtccaaactactcgatttcaactgcatgtgctacttcaaattattgcttttatgctgctgcaaatcatatccgaagaggggaagctgatatgatgattgctggcggcactgaagccgccatcattcctattgggttgggtggttttgtggcatgtagggccctctctcaaagaaatgatgacccacaaacggcttctagaccttgggacaaagatagagatggttttgttatgggtgaaggtgctggtgtgttggtgatggagagcttagaacatgcaatgaaaagggatgctccaataattgccgagtacttgggtggagcggtaaattgtgatgcttatcatatgactgacccgcgatccgacggtcttggtgtttcttcttgcattcaaagcagccttgaagatgctggtgtgtcaccagaggaggttaactacattaacgcacacgcaacttcaacattggttggtgatttggcggaggtaaatgctgtaaagaaggtattcaaaagcactgcaggaataaagatgaatgcaaccaagtctatgattggacactgcctaggtgcgtctggaggtctggaagccattgctacagtcaaggccattcaaacaggatggctgcatcccaccataaatcaatttaacccagagcccgcagttgaatttgacactgttgcaaatcaaaagcaacaacacgagatcaacgttgccatttcaaattcatttggtttcggtggacacaattctgtggtggcgttctctgcattcaaaccttgatatgatcccttcgagtcatttttgaggcttcatcagtttatctaaaccgcttgttcttgttctttactgtacgtcattatgagcacattttgatcttatgatcgttgtttcatgtgatacgggttctctataacatatgctataattggtcttgtggccaatctgtaccaatttaggcattgttgagttttgagttggaacaagattcggagactagcattcggttataggatttcagacagtttgtagcttttgcaatgtgtattattcagtatgttgttaaatttgttctcctctcttttaggtatgttataagatgattttataagtttgtttatcctctcttttaggtatgttata

SEQ ID NO: 743 - DNA, 1971 bp, Lupinus angustifolius
tctctttacttcgacatttcctaagacctaagataaaacattgttattatcctttttctctcctttcacattaaaaacacaacagcattagctgaacacttaaaataagaagcttactgttttctcttctctctctctctctgaaaatcccacaccacttatttctctccttccaaaatcacacttcgcattctccgccacctaccaccaccgtatcctccgccgtaacaatgcaaaccctaaactccccaaccctccacttctctcccctagacccattcctcaccaaatcacccaatgccaccgccaaacccaaacgcgtctctttcataaccgcttccgccaccgtgacccccaaagtctcagcccctcagagagagaaggacccgaagaagagagttgtggtaacgggaatgggtctcgcttccgtattcggaaacaatgtagatcaatactatgagaagcttcttgctggtgagagtggggttagcctcatagaccggttcgatgcgtcgaagttcccgacccggttcgctgggcagatccgtgggttcagttcggagggttacatcgatgggaagaatgaccggaggctcgatgattgtctccggtattgcattgttgcggggaagaaggcgcttgaaagtgctgaccttggtgctgataaacttaacacgattgacaagcaacgggctggtgttcttgttgggtcaggcatgggtggtctgacagtattttcagatggagttaaggctctaattgagaaaggacatcgaaaaataacaccctttttcattccttatgccatcactaatatgggttcagcattgctcggaattgaccttggcttcatgggtccaaattattcgatatcaactgcatgtgctacctccaattattgtttttatgctgcagcaaaccacatccgtagaggagaggctgatttgatgatagcaggtgggactgaagctgccatcattcccattgggttagggggttttgttgcatgcagggccctatctcagagaaacgatgacccgaaaactgcttcaaggccatgggacaaggaccgagatggctttgtaatgggagaaggttctggagtactggtattggagagtctagaacatgccatgaagcgaggcgcgcctattttggcggagtacttgggaggtgctgttaactgtgatgcctatcacatgaccgatccacgagctgatggacttggtgtgtcttcatgcattaagagcacccttgaagatgctggtgtgtcacctgaggaggtcaactacattaatgcacatgcaacttccacccttgctggtgatttggcagagattaatgccattaagaaggttttcaaagacacttctggcatcaaaattaatgccaccaagtctttgatcggacacagccttggtgcttctgggggtttggaagctattgccactgtgaaagccataacaacaggatggctgcacccatccatcaatcaatttaatccagaacctgcagttgattttgacacggtcccaaatgtaaagaaacagcatgaagttaatgttgcaatctcaaattcatttggatttggtggacacaactctgtggtggcattttctgcattcaagccttgatttcccagcttaagaacattgaaatctaaaataattgaaattttctgatagttccttttgttgagtccatgatttataaaagttgcaggccttagttaattttgtgctgatttgaattcactgttacttttagagaccattttgttgtagaacttttttatcatagttggaaaattttatggtttggaggtaatacagtggatagaaagtaacttgacagatatttttatcattcttcattattctcaagtaacgatattcatattatcaggaatggctatatgcattatattctgtacttacacctaatttgtcaaccattttttccaacgtaatt

SEQ ID NO: 744 - DNA, 1789 bp, Zostera marina
acacttctctccccctcctgtccctcttccttccacgatgcaatctctccaaatctcaacatcgcaaccgcaaactcaccatatcttccgccgcaatgctccgccaccaccgtcacgtatctctcccacgcggagggtccggttcaatccaatccgagcaacggcgactgtttcggcgccgaagagggagactgatccgaagaagaggattgtgattacgggaatggggttagtgtccgtgttcgggaatgaggttgatagattttacgagaggttattggaaggggagagtgggattaaacccatcgataggttcgatgcgtccaaattcccgaccaaatttgctggtcagatcaaggggtttgtaagtgaagggtacatcgacgggaagaacgacaggaggttggatgactgtctacgttactgtattgttagtggaaagaaagctttggaaaatgctgggattggagttggaacagcggaaatggaaaagatcaacaaggagagagctggtgttcttgtgggaactggcatgggtggtcttacagttttctctgacggtgttcaaaatctcattgaaaagggtcacaggaaaataaccccgtttttcattccatatgcaattacaaacatggggtctgctttacttgccatggatattggtttcatgggtgctaattattctatttcgacggcatgtgctacatccaactactgcttctattctgctgcaaaccatattcggcgaggtgatgttgatataatgcttgctggtggaactgaagctgcaattattcctattggactcggtgggtttattgcatgcagagctctgtcacagagaaacgatgaccctgaaaccgcatcaaggccatgggacaagggaagagatggttttgtcatgggtgaaggagctggagtgttggtaatggagagccttgaacatgcaatgaaacgtggtgctacgattattgctgaatatttgggaggagctgttaattgtgatgcccatcacatgacagatcccagggctgatggactcggtgtttcaacatgcatcaagaaaagcctggaagatgctagagtatctcctgaagaggttaattatatcaatgcacatgctacttctactcttgccggagacctggccgaggtgaatgccatcaaacaagttttcaaaaacacatccgagataaaaatcaatggaaccaagtccatgataggtcactgtctaggcgcttctggaggtttagaggccatcgctactgtaaaagcaattaccaccggttggctgcatcctactattaatcaatttaatcctgaggaatcagttgagttcgacacagtagctaataaaaagaagcaacacgaagtgaatgttgccatctctaattcctttggtttcggcggacacaactctgtggtggtttttgctccatttaaaccttgatgggtcgatcaaaacttaacaaacagtcaagtcagtcttcacggtatctattcttcttgtttttgacattgagaggtattaagcgattctgcaattcagagacattgtattttatgagagacggtgacaaaatggaggttgctatatttctggaatttagtccaattctttttaggttatctctaaagtagaaactagaaaatgatacaccaatttaggatgtatcttgttctgagttcttaataaatagaggtaatcttgttttttctcctcttctctcttgtaggctgcaacagttgtattttctctatatcaagaaatatttatgttgatttatta

SEQ ID NO: 745 - DNA, 1996 bp, Papaver somniferum
ccccatctctacttcacagcagaaagtgaggaaaaagaaaacagataaaaaggttgtctataaatactagtcgctgcatcaaccaacaatcagattaatagattgtatcgaaccccattctctctttcaaagcgggaaatctacatcttcttctctagagatttgtagggaaaatgcagactttgcaatcagcagctcttcgtgtgtcaccattagaatcacttcgaaaacaatctccgcttctcaacaataacaacaatgtgagtaacaagaatagatcgaaactgaagagaaatccatctttggtgatatctgcttcttccaaaacgagtgtgaatgcaccgaaaagagaaaaagatcccaaaaagagagttgttattacaggaatgggtttagtttctgtatttggtaatgatgtcgatacttactatgaacgtcttcttgccggtgagagtggaatttcacttattgatcgttttgatgcttccaaatttccaactcgttttggtggtcagatccgtggatttgattctcaaggttatattgatggcaagaatgatcgtcgtcttgatgattgtcttcgttattgtctcgttgctggtaaaaaagcacttgaagatgctggtcttgggggtgaaaatctctcaaagctagacaaagagcgaggaggtgtgcttgtcgggacaggcatgggtggtctcacagtgttttcagatggtgttcaggctctaatagaaagaggccacaggaaaataacgccctttttcattccatatgccataactaatatgggttctgcgttgcttggaattgaactcggcttaatgggtccaaactattccatttccactgcatgtgctacttccaattattgcttctacgctgctgctaaccacatccgacgaggtgaggctgatttaatgattgccggtggaactgaagccgcaatcattcccatcggattaggaggttttgttgcatgtagagccctatcacagagaaatgatgatccacaaacagcttcaaggccatgggacaaagaacgagatggttttgttatgggtgaaggcgctggagtgttggtaatggagagcttggagcatgcaatgaagcgcggtgcaccaattcttgctgagtacttgggaggtgcagtaaactgtgatgctcatcatatgactgatcctagggccgatggacttggtgtttcaacatgtattgaaaaaagtcttgaagatgctggtgtgtcgccagaggaggttaactatataaatgcacatgctacgtccacacttgctggagacctggctgaggtgaatgccataaagaaggtattcaagaacacatccagtatcaagattaatgcaactaagtctatgattgggcattgccttggtgcagcaggggggttagaagccatcgccacagtgaaagccatcaatactggatggttgcatccttctatcaaccaatttaacccagagcctgcagttgatttcgacactgttgctaatgtaaagaagcagcatgaagtgaatgttgccatttccaattcttttggtttcggaggacacaactctgtcgtggtcttttcagaattcaagccttgagattaattggattcatccttcatttctcggaagaacggttttgctccctccaatttaagctgttttctttttgatttcttcttagtcttagtccctgcacatgtatttcgttcaacgcttgtttcactttctttcggtttctctcatagtaatttatcatggaatttgaagaatttatttgttatattctctcgaggagaagtcatgaatatttgaggaactagtagtgtatggattgtggtaatttaactgattataggtgagcacatgccaaaggcttagtttatttctgttccaagactgtctcgatgtatttcacttgcgagatatgcaggattttggacatttggatgtcatatgttggttaaatctgataacccttttctaaa

SEQ ID NO: 746 - DNA, 1728 bp, Papaver somniferum
tctctagagatttgtagggaaaatgcagactttgcaatcagcagctcttcgtgtgtcaccattagaatcacttcgaaaacaatctccgcttctcaacaataacagcaatgtgagtaacaagaatagatcgaaactgaagagaaatccatctttggtgatatctgcttcttccaaaacgagtgtgaatgcaccgaaaagagaaaaagatacccaaaaagagagttgttattacaggaatgggtttagtttctgtctttggtaatgatgtcgatacttactatgaacgtcttcttgccggtgagagtggaatttcacttattgatcgttttgatgcttccaaatttccaactcgttttggtggtcagatccgtggatttgattctcaaggttatattgatggcaaaaatgatcgtcgtcttgatgattgtcttcgttattgtctcgttgctggtaaaaaagctcttgaagatgctggtcttgggggtgaaaatctctctaagctagacaaagagcgaggaggtgtgcttgtcgggacaggcatgggtggtcttacagtgttttcagatggtgttcaggctctaatagaaagaggtcataggaaaataacgccctttttcattccatatgccataactaatatgggttctgcgttgcttggaattgaactcggcttaatgggtccaaactattccatatccactgcatgtgctacttccaattattgcttctacgctgctgctaaccacatccgacgaggtgaggctgatttgatgattgccggtggaactgaagccgcaatcattcccatcggattaggaggttttgttgcatgtagagccctatcacagagaaatgatgatccacaaacagcttcaaggccttgggacaaagaacgagatggttttgttatgggtgaaggtgctggagtgttggtaatggagagcttggaacatgcaatgaagcgcggtgcaccaattcttgctgagtacttgggaggtgcagtaaactgtgatgctcatcatatgactgatcctagggccgacggacttggtgtttcaacatgtattgaaaaaagtcttgaagatgctggtgtgtcgccagaggaggttaactatataaatgcacatgctacttcaacacttgctggagacctggctgaggtgaatgccataaagaaggtattcaagaacacatccagtatcaagattaatgcaactaagtctatgattgggcattgccttggtgcagcaggggggttagaagccatcgccacagttaaagccatcaatactggatggttgcatccttctatcaaccaatttaacccagagcctgcagttgatttcgacactgttgctaatgtgaagaagcaacatgaagtgaatgttgccatttccaattcttttggtttcggaggacacaactctgtcgtggtcttttcagaattcaagccttgagattaattggattcatccttcgtttctcggaagaacggttttgctccctccaatttaagctgttttctttttgatttcttcgtagtctaagtccctgcacatgtatttcgttcaatgcttgtttcattttctttcattttctcttgtagaaatttatcatgaaatttgaagaacttatttgttacattctctcgaggagaacgtcatgaatatttgaggaactagtagtgtagggattgtggtaatttaactgattataggtgagcacatg

SEQ ID NO: 747 - DNA, 1625 bp, Ambrosia trifida
acaaacatagtatttggtaagatctgtcactaaagtcttataacaacaccacatcagtgacagttgtatctatccgtcggtatctccatatcccttatcataaccataaccatcatcatctaccttcttcctcttcacacaacacatcgatccatcaataaacccactaatccttcatcttcctgcaccatgcaagcccaagctctcctccaatcaacccctcttcgggtctccccactcgacccgattcacaaacccattaacctcaaaccaccttcactctccaccacgcgccgccgagccgtcatctccgccgtcgccgccgccccgaaacgtgaaaaggatccgaagaaacgggtcgtcattacgggtatgggtctggtatccgtttttggaaatgatgtggatacttattatgagaagctgttggctggtgagagtggaatcgggttgattgaccggtttgatgcgtccaagtttccgacccggtttggtgggcagattcgtgggtttaaggctgatgggtatattgatggaaagaatgacaggagacttgatgattgtttgagatattgcattgttgctggtaaaaaggctcttgaagatgctaatcttgctgctgataatcgctccaagattgataaggagcgtgctggtgtgcttgttggaacaggaatgggaggtctaacagtattttctgatggagttcagtctctaatagaaaaaggttacagaaaaatcacaccgttctttattccatacgcaataacaaacatggcatctgcattattagctattgatctgggctttatgggcccaaactactcaatttcaaccgcttgtgctacttcaaactactgctttcatgctgctgcaaatcatatccgtagaggtgaagctgatttgatgattgctggcggcacagaagctgccattattccaattggattgggtggttttgttgcgtgtagagcattgtctcagagaaatgatgacccacaaactgcttcaaggccttgggaccaaggtagagatgggttcgttatgggtgaaggtgctggtgttttggtgatggagagcttggagcatgcaatgaaaagagatgcacccatacttgctgaatacttgggtggtgctattaactgtgatgcttatcatatgactgacccgcgttctgatggactcggtgtttcttcttgcattcaaagcagtttagaggatgctggtgtgtcagcagaggaggttaactacatcaatgcacacgcaacttcaacattggttggtgacctagctgaagtaaatgcgataaagaaggtgttcaaggacaccgcaggaatcaaaatgaacgcaaccaagtctatgatagggcactgtttaggcgcggccggaggtctggaagccattgctacagttaaagccattcaaacagggtggctacatccatccataaaccaatttaacccggagcctgcagttgaattcgacactgttgcgaatgtaaagcagcagcatgaaattaatgttgcgatttcaaattcatttggtttcggcggacacaactctgttgtagcgttctctgctttcaagccttgatttgatgtaattgcatcatggacatatttagg

SEQ ID NO: 748 - DNA, 1742 bp, Flaveria ramosissima
accttcatctctcaaatccaccaccatagccaccaccatgcaagctcaagctctccttcaatcaacccaccttcgcatctcccctctagaccccctccgccacaaccaccgccaccaatttccgaccaatgtcaaacccacacgcagacccaccgtcgtaatgtccgccaccgcccccaaacgagaaaaagaccccaagaaacgggtcgttatcacgggtatgggtcttgtgtccgtgttcgggaacgatgttgacacttactatgagaagttgttagcaggggaaagtggaatcgggttgattgacagattcgatgcgtctaagtttccgacccgattcgggggtcagattcgtgggtttaagtccgatgggtatattgatgggaagaacgatcggaggcttgatgattgtttgaggtattgcattgttgcggggaagaaagctcttgaagatgctgatcttgggggtgataaacgatctaagattgataaggagcgtgctggtgtgcttgttgggacaggaatgggaggtctcactgtgttctctgatggagtccagaatctaattgaaaagggctacagaaaaatcacaccttttttcattccttatgccataacaaacatgggttctgctttgcttgctattgatcttggatttatgggtccaaattactcaatttcaactgcatgtgctacttcaaattattgtttttatgctgctgcaaatcatattcgaagaggggaagctgatatgatgattgctggtggcacggaagccgctattattcctattgggttgggtggttttgtggcgtgtagggccctctctcaaaggaatgatgacccgcaaacggcttctagaccatgggacaaagatagagatggttttgtcatgggtgaaggtgctggtgtattggtgatggagagcttagaacatgcaatgaaaagggatgcaccaataattgccgaatacttgggtggggcggtaaattgtgatgcttatcatatgactgatccacgatccgacggtcttggtgtttcttcttgcattcaaagcagccttgaagatgctggtgtgtcaccagaggaggttaactacataaatgcgcacgcaacttcaacattggttggtgatctggcggaggtaaatgctgtaaagaaggtattcaaaagcactgcagggatcaaaatgaatgcaaccaagtctatgattggacactgcctaggtgcagccggaggtctggaagccattgctacagtcaaagccattcaaacaggatggctgcatcccaccataaatcaatttaacccagagcccgcagttgaatttgacaccgttgccaatcaaaagcaacaacatgaaatcaacgttgccatctcaaattcatttggtttcggtggacacaactccgttgtggcgttctctgcatttaaaccttgatatgatcgcttccaactcatttttgaggctttgtcagtttgtctaatctgcttgttctttattgtatgtcactataagcacgttttggtcttatcattgttgttttgaaattctggttgaaatcgacctccataacatatgctatttatggtcttgtggccattgtataccgatttaggcgttgaattttgagctgaagcaagattcggaaattagcatttgtttacaggatttcagacagtttgtagcttttcctatgtgtattattcggtatgttaatttattcatcctctacttttag

SEQ ID NO: 749 - DNA, 1749 bp, Panax ginseng
ctcttcaatcttcgcctctccgagcttccccgctcgacccactacgcaaaaactccgccaccaccatttccaatgtccagccacccaaaagggtctcattcatcacagcttcatccaccaattccgcccccaagcgagagaaagatccgaagaagcgagtggtaatcaccggaatgggattagtctccgtttttgggaatgtagttgatgcttattatgataagcttctctccggcgattctgggattggacccatcgaccgatttgatgcctccaagttcccaactcgatttgctggccagattcgtgggttttcgtcggaagggtatattgatggaaagaatgaccggcggcttgacgattgccttcgttattgcattgttgctgggaaaaaggcactcgaagatgctgatcttggcggagataagcgctcaaagattgacaaggagcgggctggtgtaattgttggaaccggaatgggtggtcttacagtattttctgatggtgttcaggctctcatagagagaggtcacaggaaaatcacaccgtttttcataccgtatgccataacaaacatggggtctgccttgcttgcaattgatcttggcttcatgggaccaaactattcaatttctactgcttgcgccacctctaattattgcttttatgctgctgccaatcacatccggcgaggtgaggctgatttgatgattgctggtggaactgaagctgctattattcctatcgggttgggaggctttgtggcatgtagagctttgtcccagagaaatgacgatccaaagactgcttccaggccatgggataaagatagagatggctttgttatgggtgaaggtgctggagttctggtaatggagagcttggaacacgcaatgaaacgaggtgcaccaataattgctgaatacttgggaggagcagttaattgtgatgcttatcatatgactgatccaagatctgatggacttggtgtttcatcatgcattcaaagcagtcttcaagatgctggtgtgtcgccggaggaggttaactacataaatgcacatgcaacttccactatagttggtgaccttgctgaggtaaacgctgttaagaaggtattcaagaacatttcagggatcaaaatgaatgcaaccaagtcaatgataggccactgcttgggtgctgctgggggtttggaggccatcgcgacagtgaaagccattactacagggtggttgcatcctacaataaatcaatttaactctgagtcttcagttgagtttgacaccgttgcaaatcaaaagcaacagcatgaagtgaatgttggcatctcaaattcatttggatttggtggacacaactcagtggtcgccttttctgcattcaagccatgatttagctcatcttcttcattctttgtagccataggcaatctgtgcttatccgaggtttagtccaatttcttgtggaggctgcaagcttagaggattcatagttatccttttctgtatcaatttccgatttaactcttggttgaggcctctcattccttttacccttttagatacatgttgatactgtaaaggcagactaggcatgagaagttatccagttttgaattatgtaatttatagttggagactggccatggggttcactaatttttacctggcatctgttttttactggagcatgttttgttagttggtaatgaagatgcgttccgcctctaaacaaggctcgtgtaaa

SEQ ID NO: 750 - DNA, 1724 bp, Valeriana officinalis
acgttcaaaatccaccttcactcttcactacatcgttctcatcgatctctctttctctcactataaattcaccaccacactcctaccctctctccgccgtcatcatccaccatgcaagcactccaatctccatctctccgaccttctccactcgactcaattcgcaaacaatccccaaacctcaccaccagaatcaatgccaactctacccaaaaagctcccattcatcgctgcatcggcatcgcaaactaccgccgtcgcccccaaacgcgagaaggatccgaagaaacgagttgttatcactggaatgggcttagtctcggtcttcggtaacgacgttgatacttactataatcgccttctggaaggggagagtggaattagtttgattgatcgttttgatgcttcaaagttcccgactcgattcggtggtcagattagggacttcaattccgaaggttacattgatggcaaaaatgaccggcggcttgatgattgtttgcggtactgcattgttgctggtaagaaggctctagaacatgcagatctcggcggcgaaaaacgctccaaggttgataaagaacgtgccggtgtgttggtcggtacaggaatgggggggctgacggtattttctgacggtgttcaagctctaatagaaagaggatacagaaagataacgccgttcttcataccgtatgctataacaaacatggggtccgctttgctgggaatagacttaggatttatggggccaaattattcaatttcaactgcatgtgccacctcaaattattgcttctatgctgccgccaatcacatccggagaggtgaggctgatttgatggttgccggcggcactgaagccgccattatccccatcggtttgggtggatttgtagcttgtagagctttgtctcaacgaaatgatgatcccaaaactgcttctaggccttgggataaggatcgtgacggctttgttatgggtgaaggtgctggcgttttggtaatggagagtttggaacatgctatgaaaagaggagcaccgataatagcagaatatttaggaggagcagttaattgcgacgcttatcacatgactgatcctcgatccgacggtctcggtgtctcttcttgtattcaaagcagtcttcttgatgccggtgtttcccctgaagaggttaattacataaatgcccatgcaacttcaactatagttggcgacttggctgagataaacgctataaaaaaagtcttcaaggatacttcaggcatcaaaattaactcaaccaagtcaatgatcgggcactgtctcggagcagcaggaggtttggaagccatagcttcggtgaaagcaattactaccggctggcttcatcctactatcaatcaatttaatccagagccttcagttgactttgacactgtcgcgaataaaaaacaacaacatgaagttaatgttgcgatttcgaattcgtttggatttggaggacataattcggttgtagcgttttcggcgttcaagccatgagtgtattgagagctatataagagagtgtactttactaatcatgcgagtttttcataacgagggagcctttttattataatcatcaaagtaaatggaagattcacatttgtctgttgttttgttttataatttctgttttgagctcaagaactgtttaatctttctcttcttgaactatcattttgagtaattagtt

SEQ ID NO: 751 - DNA, 1880 bp, Trigonella foenum-graecum
ctatactctccaattctattaaataccaaagattaatgagaacttgttaagaagtaagtacctacctactattccacacctttcattcattcactcaccttcttcgttctctccgtcattacatcaaacagatacgatacaatgcaatcacttcagattcagcaacttccctctactcttcgcccttcacctctcgaaccacttcgcagaaaatcctcctccaatgccgccgccaccaccgccgccaaaaccaagagactcacccgcatctccgcctcggctaccactgctccgcaaagacagaaggatccaaagaagcgtgttgtgatcactggaatgggtcttgcttcggtgtttggaaatgatgttgatgcttactatgacaagcttctcgctggtgagagtggtatcacttcgattgatagattcgatgcttccaaatttcccactcggttcgctggtcagatccgtgacttcagttctgagggttacatcgacgggaagaatgaccggagacttgatgattgtctccggtactgcattgtcgccgggaagaaagcacttgaacacgctaatctcggcgctgcaaatctatctaagattgataaggaacgtgctggtgttttggttgggtcaggaatgggtggtttaacggttttttctgaaggagttaagaatctgattgaaaagggacatagaaaaataacaccttttttattccttatgctattaccaatatgggttcagcattgcttgggattgatttaggttttatgggtccaaattattctatttcaactgcttgtgctacttcaaattattgcttttatgctgctgccaatcacattcgtaggggtgaggctgatttgatgatagccggtgggactgaggccgctattattccgattggtttgggtggttttgttgcttgcagggcactttctcagagaaatgatgaccctaaaactgcttctaggccttgggataaagaacgtgatggttttgttatgggtgaaggttctggagttttggtaatggaaagcctggaacatgccatgaaacgaggtgcacctatcattgctgaatacttgggaggtgctgttaactgtgatgcttatcacatgactgatccaagatctgacggactcggtgtgtccacatgcatccagagcagccttgaagatgccggtgtgtcacctgaggaggtcaactacataaatgcacatgcaacttccactcttgctggtgacttggcggagattaatgctatcaaaaaggttttcaaggacacttctggcatcaaaattaatgccaccaagtctatgataggtcactgccttggtgcagctgggggtttggaagctattgccacagtgaaagccataacaacaggatggctgcatccatcaatcaatcaatttaatccagaaccagcagttgattttgatacagtggcaaatgtcaagcagcaacatgaaatcaatgttggtatttcaaattcatttggatttggtggacacaactctgtcgtggctttttccgctttcaggccttgattaccaagcttgtctgctcttcatgtagaacattgaatctaaattaattgaaattttgttctctctacatcattgaggctatttattttatgagtccataatatataaaagttgtagtcctgtaattgttcattgtatgctaattgtccaaagactattttgctgtaaaactttttaaatgtggcacgaagatttcattggtttggagttataacagcggatagaaagtgtcgaaagagcttctttaagcattcttacttttgtcaagtaaagatatattagcatgtatttatgatacttcttgttattgaatcgttgttggtc

SEQ ID NO: 752 - DNA, 1796 bp, Olea europaea
atttgggaaagaaagaaaaacagctcactaaactcgcaccaaacatccacatagtactcatcgacactcgcaatctccgcccccacgcagccatgcaagccgtccactctgccgctctctgcccctcccctctggaacctctccgcaagcccatgcctacctccccattattttcgaataccaacaatgccaaacccccgaatccccacaccaaaaacccccttcatcatctccgcttcttcagctcccaagcgcgagactgaccccaagaagcgcgtggtcattacgggcatgggcctggtctccgttttcggaaacgacgtcgacgcttactacgagaaacttctcgccggcgagagtggtatcgccgccatagaccgatttgatgcatcgaaatttcccacccggttcggcggacagattcggggattcaaatccgagggttatattgatgggaagaacgatcggaggcttgatgatagtcttagatactgcattgttgctgggaaaaaagccctcgaaaatgccgatctaggtagagaagatttggggaagattgataaggtgcgagctggtgttctagttggaactggaatgggtggtcttacagtgttttcggacggtgttcaggctttaatagagaaaggtcacaggaaaatcactccatttttcataccttatgccataacaaatatgggttctgctttgcttgcaattgatcttggcttgatgggaccaaattactcaatttcaactgcttgtgctacctccaattattgtttctatgcggctgccaatcacatccgtcgaggcgaggctgatttgatgctagctggtggaactgaagctgccattattcctattggattgggaggttttgttgcatgtagagctttgtctcagaggaatgatgatccccaaacagcttctaggccttgggacaaggaccgagatggctttgttatgggtgaaggtgcgggagtcttggtgatggaaagtttggaacatgctatgaaacgagatgcaccaataatagccgagtatttgggaggtgcggtgaactgtgatgcttatcatatgactgatccccgatctgatggacttggtgtatcttcatgcatccagagtgcccttgaagatgctggtgtctcaccagaagaggttaactacattaatgcccacgcaacttccaccatagtaggtgacttagctgaggtcaatgctgttaagaaagtattcaaggacacttcacagatcaaaatgaatgcaactaagtctatgatcgggcactgccttggtgctgctggtggtctggaagctattgcaacagtgaaagctataacaacaggctggctgcatcctacgataaatcaattcaacccggagccttccgttgagtttgacaccgttgcaaaccaaaagcagcagcatgaagttaacgttgccatttcaaattcattcggatttggtggacacaactctgtcgtggcgatttctgcattcaagccctgatcctgttcttagtggttctcttgtggcaatagcaatttcactcattcgagctgcgtttggataaccgcggctgcttcatatttattctgcatgttgctggatttgttcatcgagtgtatttgttattttctgtaataattttgagtttagcgcttaaatatgtcatcaattttcgttggatgtgtttttgaactgactgctgatttatattcaggttagttcatggaaaccttgtgtacaagttatttttacatgtttataattatataataaaaagctattta

SEQ ID NO: 753 - DNA, 1580 bp, Gossypium hirsutum
ctatgtattcactctcccacatcggccaaccaagagattcacttccatcaccgcttcatccaccaccgtttcggctcccaagcgggagaaggaccccaaaaaacgggtcgttgttacgggtatgggcttggtatccgtttttgggaacgacgttgatgtttattacgataaattgttgtctggggaaagtgggattggactcatcgaccggttcgatgcttccaagtttccgactcggttcgccggtcagatccgggggtttacttctgaagggtatattgatggaaagaacgataggcgactcgatgattgcttgaggtattgcattgttgctggtaagaaggcacttgaagatgctgatcttgggggtgataaattatctaagattgataaagagcgaaccggagtgcttgttggaactggtatgggcggtcttactgtgttctctgatggtgttcaaaatctaatagagaagggtcatagaaaaataacaccatttttcattccttatgctataacaaacatgggatctgccttgcttgcaattgagcttggtttcatgggtcccaattattcgatttctaccgcttgtgcaacgtccaattattgcttctatgctgctgccaatcacatccgtcgaggtgaggctgatttgatgattgctggtggaactgaagctgcaattattcctattgggttggggggttttgtcgcctgtagggcattgtctcaaagaaacgaagatccacaaactgcttcaaggccatgggacaaagagcgggatggctttgttatgggtgaaggtgctggagtattggtgatggaaagcttggaacatgcaatgaaaagaggtgcaccaattatcgccgagtacttaggtggagctgttaattgtgatgcttatcatatgactgatccaagagccgacggtctcggggtgtcttcatgcatcgagagaagccttgaagatgccggtgtgtcccctgaggaggttaattacatcaatgcacacgcgacttcaactcttgctggtgacctggccgagataaacgctattaagaaggtattcaagaatacatcagagatcaaaatcaatgcaacaaagtctatgatcggccattgtctgggcgcagcaggtggtttagaagccattgccactgtgaaagccattacaactggatgggttcatccaaccattaatcaatttaatccagagccttcagttgagttcgacactgttgccaatgaaaagcagcagcatgaggttaacgttgcaatatcgaattctttcggatttggtggacacaactctgtggtggcattttctgcattcaagccatgaaagtttcatcatttattagggaaaagatagaatcgttgttcattacagctgagggactgcttcaatctttgtaacatttcatgagagccatttttcatcattagttttgttataattttgacttggatattagctaccctaagaaaattgtgaacccctatttaaattagttgatttatgagggtaatgattttattgaagtcagaacagatagccggattgttaaaccggtgtaatt

SEQ ID NO: 754 - DNA, 1711 bp, Triphysaria pusilla
cgcccctcccccatcgacccccctcctcaaaccccctcgctcgacctgctttcccggacacaatgccaagctgccgtctaagaggctccccttcacaatctccgcatccgccccgaccgtttcggctcctaagcgcgagacggacccgaagaagcgcgtcgttatcaccggcatgggcctcgtctctgtgttcggaaatgacgtggatgcgtactacgagaagctgctcgctggcgagagcggcatcactctcatagaccggttcgatgcgtcgaaattccccacgcggtttggcggccagattagggggtttaaagctgagggttatattgatggtaaaaatgatcggagattagacgattgcttgagatactgcattgttgctgggaaaaaagctctcgagggggcggatctcggcggcgataatctcaacaagatcgacaaaatccgagcaggtgttcttgttggtacaggaatgggtggtctcaccgccttttccgatggtgttcaggccctaatcgagaagggtcacaggaaaatcactccgtttttcataccttatgccataacaaacatgggatctgccttgctagggattgatctcggcttcatgggccccaactactcgatttcaaccgcttgcgcaacctcaaattattgcttctatgcagctgcgaatcacatccgtcggggcgaagctgatttgatgctcgctggtgggaccgaagctgccatgatcccgattggattgggaggttttgttgcgtgccgagctttgtctcagagaaatgatgacccgaaaacagcttcgagaccttgggataaagatcgagatggctttgttatgggtgaaggtgctggagtcttggtaatggaaagtttagaacatgcgatgaaacggggtgcgcctataattgcagaatatttgggaggtgcagtaaattgtgatgcttaccacatgactgatcctagagctgatgggcttggcgtctcttcttgtattcatagtgctcttcaagatgccggtgtttcccctgaggaggttaactacattaacgcccacgcaacttcaaccatagtgggtgacttagctgaggtaaatgctatcaagaaggtattcaagaacacttcagagattaagatcaacgcaactaagtcaatgattggacactgcctcggcgctgctggtggtttggaagctattgcgacagtgaaagccatcacaacgggctggcttcatccatcaataaatcaattcaacccagagtcgtcggttgagtttgacaccgttgcaaacaaaaagcagcagcacgaagtcaatgttgccatatcaaattcgtttggattcggtggacacaactcggttgttgcgttttcggcattcaaaccctgatcctttgttcgactatatctattagtagcaaagagcaatcttgcttatcgggagcactaaacgaatctttagatcgtctttgtactagttgttcgtttagcattttcagacaaagttgtattcatttggcacatgtaataaggccgagtatagctttttgtttgatgactttttccattcattgggattcatatttattaggtgtgatttgcatcagttttgttctgtcttgctcttgtgaaagctacttttaactagtcgtttgtgaaagctacttttaactagtgtttgggtctttatcggctaccgactatccac

SEQ ID NO: 755 - DNA, 1776 bp, Gossypium hirsutum
taaagttttcgtttttattagttgctcagtcttactttgttgttatcgccctaagcactttccccagttcccacgagtcatggaagctattcaagcctcatctcttcgagcttcccctctaaaacctctcctaaaacccaagttcaatatccatttccccaatgcatcgagactcgttcccagggcaaccaagaaattctcttccatcaccgcttcatcccccaccgtatctgctcccaagcgcgagaaggaccccaaaaaacgggtcgttattacgggtatgggattggtttccgtttttgggaatgatgtcgatgcttattacgataagttgctggctggggaaagcgggatcggactcatcgaccggttcgatgcttccaagtttcctacccggttcgccggtcagatccggggtttctcttctcagggttacattgacggaaagaacgataggcgacttgacgattgcttgaggtactgcattgttgcaggaaagaaggctttggaagatgctgatctcgggggcgataagttatccaagatcgacaaggagcgagctggagtgctagttggaactggcatgggtggtctaacagtattctctgacggcgtccaaaatctgatagagaaaggctatagaaaaataacaccattcttcattccctatgctataacaaacatgtcatctgccttgctagccattgatcttggtctcatgggtccaaattattcaatttcaactgcttgtgctacctccaattattgcttctatgctgctgccaaccacatccgtcgaggtgaggctgaaatgatgattgctggtggaactgaggctgcaattattcctattgggctggggggctttgttgcctgcagggcattgtctcaaagaaatgatgatcctcaaactgcttcaagaccatgggacaaagaccgagatggctttgttatgggtgagggtgctggagtattggtaatggaaagcttggaacatgccatgaaaagaggtgcaccaattattgctgagtacttaggtggagctgttaattgtgatgcttatcatatgaccgatccaagatctgatggtcttggggtgtcctcatgcattgagagaagccttgaagatgctggtgtgtctcctgaagaggtaaactacataaatgcacatgcaacttctactcttgctggtgatctggctgagataaatgctattaaaaaggtattcaagaatgcatctggcatcaaaatcaatgcaacaaagtcgatgatagggcactgtctgggtgcagcgggcggtttagaagccattgccagtgtgaaagccattaccacgggatggctgcatccctccataaaccaatttaatccagagccatcagttgagtttgacactgttgccaacaaaaagcagcagcacgaggttaatgttgcaatctcaaattcatttggatttggaggacacaactcggttgtggcattttcagccttcaagccatgaaagtctgttactacatgttctgcatttgttaggaaagatgatgatagagaatattgatccttaaaagagcgagtcaggcatttgtttgtggatgtggaggctgcttcaatccttgtgtaacttttcgtgagagccaatttgtgattttgtcattgttggaatgattttgagttgaattctagctttagcctaggaattggtgaactcgtatattttcaacaccaacacgactatatttgatgaggcaattaatgaaggagagattttgttctgtt

SEQ ID NO: 756 - DNA, 1654 bp, Prunus persica
acagcacgcaagcacgagatcactctctctcactctctctcactaacatcgttggcgtcgtcacctctctctctcctcccattatctcagtcaattagtcaagcaccatgcaggccctccaatcctcttccctccgacccgctcccctggacccgattcggaaacggaccccccatttccccagtgtcactcccagacccaccagctcgaggcgcgtctcattcatctccgcctcctcggccccggccgtgtccgccccgaagcgcgagaaggacccgaagaagcgggtagtcatcaccggcatgggcctcgtgtccgtcttcggcaacgacgtcaatgcttactacgacaagctactcgccggagagagtggcgtgggtcccatcgaccggttcgatgcgtccaagttcccgacccggttcgggggccagatccatgggttctcgtcagaggggtacattgatggcaagaacgatcgacgactggacgattgcctacggtactccattgttgctgggaagaaagctctagaggatgctgatcttggtggcgacaagcgctcaaagcttgataaatcgagggctggggtgcttgtcggatcaggaatgggtggtcttactgtcttttctgatggtgtccatgcattgatagagaaaggccacaggaaaataaccccatttttcattccttatgctattacaaacatggggtctgcgttgcttggtattgatctgggttttatgggaccaaattattcgatttcgactgcttgtgctacttcaaattactgtttctatgctgctgcgaatcacattcgtcgaggtgaggctgatttgatgattgctggcggaaccgaagctgccttaattcctgttggtcttggaggttttgttgcgtgcagggccttatctcagagaaatgatgatccaaaaactgcttcaaggccatgggacaaagatagagatggatttgttatgggtgaaggtgccggagtattggtaatggagagcttggaacatgcaacaaaacgaggtgcaccaattattgccgagtacttgggaggggctataaactgtgatgcttatcatatgactgatccaagagctgatgggcttggtgtatctacatgcatagagagaagccttgaagatgctggtgtgtcacctgaggaggttaactacatcaatgcgcatgccacttccactcttgctggtgacttggctgagataaatgctataaagaaggtgttcaagaacactagagatattaaaatcaatgcaactaagtctatgatagggcactgtcttggtgcttctgggggtttggaagctattgctacagttaaagccataacaacgggatggctgcatccttccataaatcaatttaatccagagccttcagtggagtttgacactgttgccaatgtaaagaagcagcatgaagtaaatgttgccatatcgaactcatttggatttggtggacataactctgtcgttgccttttctgcattcaagccctgatcatcccagcttgtgttcaagttttgtactacatcaaatgttgcttagaggagatcttaaattgtttctgaggcagagcttcatccttttacttttgaggccacttgtagttttgtaataattcaaagtta

SEQ ID NO: 757 - DNA, 1972 bp, Solanum phureja
ctctctctcttgctgtagaagcacaaaacacactccccctttctctctctctaaaaatagtaatacactcacatcgttcacatcgaaaagctttttgcttctacttctgcttctgcttcttcttcttcttcttgctccgccacctcaaatctcaaaacccatttcagttaacaatggaagcaatgcaatctctatcatttcgtccatctccactcgatcctcttcgaaaaaacatgccccaattcaccaatgtaaggtcattgggtgctaaaagagtgccttttattatatcagcttctgcatccactgtttctgctcccaaaagagagaaagacccaaagaaaagggttgttataactgggacgggtcttgtttctgtgttcgggaatgatgtcgatacttactatgaaagacttttggctggtgaaagtgggatttcgcttattgatcgttttgatgcttctaagtttcctacaagatttgggggacaaattcgtgggtttacatctgaagggtatattgatgggaagaatgataggaggcttgatgattgtttaaggtatgccattgttgctggcaagaaagctttggaaaatgcagatcttgggggtgatagattagaaaagattgataaggagcgagcaggtgttcttgtaggaacaggaatgggtggtcttacggttttctcagatggcgtccagaatttaattgaaaagggtcataggaaaattactccattttttataccatatgccataacaaacatgggttctgctttgcttggtattgatctaggttttatgggaccaaactactcaatctcaactgcttgtgctacctccaattactgtttttatgctgccgcaaatcatattcgcagaggtgaagctgatttgatgcttgctggtggaactgaagctgccatgatacctattggtttaggaggttttgtggcatgcagagctttgtctcaaaggaatgatgatccacaaactgcttccagaccatgggacaaagatagagatggatttgttatgggagagggggctggaatcttggtgatggaaagtttggagcatgcaatgaaacgaggagcaccaataattgcagagtatttgggtggtgcagttaattgtgatgcttatcacatgactgatccccgagctgatggtcttggtgtttcttcatgtattcttagcagccttgaagatgctggagtgtcaccagaagaggttaactacattaatgctcatgcaacttccaccattgttggtgatctagccgaaataaatgctgtcaagaaggttttcaagaccacctcaggaatcaaaatgaatgcaaccaagtctatgatagggcattgcctcggtgctgctggtggtctggaagctatcgcaacaattaaagctattacaaccggctgggtgcatccttcaattaaccaattcaatcctgagccttcagtggagtttgatactgttccaaacaaaaaacagcagcatgaagtgaatgttgcaatttccaattcctttggttttggtggtcacaactctgtcgtcgccttttctgcattcaagccttaattcagctcagtttagctagagcaaacttctggagtaatataggggattaatgtgatacacagtggctgtttctttcatttccgtgtgggcgacttgcttggcgcagcgagagaggaacaattgtcaattcttttatgtactaataatctttagcttgtagtttcatagcaatgaacattttaacttttcactccttaaattagcttggaccttcatagcttggttaaacaacaatgccatcagttttgaattatgcaagagatttgaaagatgatatgatcttttgatattaacaactctctgatggcaccttgttttcgaaagaaataactagttaacctgtaagctgtataaacagccatattcacaactatactcgttgctactaa

SEQ ID NO: 758 - DNA, 1747 bp, Chrysanthemum coronarium
ctaaaacacaccattttccacacacaaacatatcaaccaccatgcaaactcaatctcaagcactacttcaacaaccccatttccgggtgaccaccagccccgacccatttcgccgccagcagcccatcaccttcaagcccaccaccctccgccgcaaacccatcacagccgccatctcatccgccccacaaagagaaactgacccaaagaaaagggtggtcataactggcatgggcttagtgtcagtctttggaaatgatgttgatacgtattatgagaagcttttagctggtgaaagtgggattggtttgattgatagatttgatgcttccaagtttcctaccagatttggtggacagatacgtgggtttaagagtgatgggtatattgatgggaagaatgataggaggttggatgattgtttgaggtattgtattgttgctggtaagaaagctttggagagtgctggtcttggtgctgatcaacgtgatcagattgataaagagcgtgctggagtgctcgttggaacaggaatgggaggtcttactgtattttctgatggtgtccaaaatcttatcgaaaagggttacaggaaaatcactccttttttcattccatatgccataacaaacatgggttcggccttgctcgctattgatcttggatttatgggaccaaattactccatttcaacggcatgtgctacttcaaaccattgcttttatgctgctgcaaatcatattcgtcgaggtgaagctgatttgatgattgctggtgggaccgaagccgccattattcctattgggctgggtggttttgtggcttgtagagcactttctcaaagaaacgatgatccacaaacagcttctaggccatgggataaaaacagggatggatttgttatgggtgaaggtgctggcgttctggtaatggagagcttggaacatgcaatgaaaaggggtgcgccaattatcgctgaatacttgggtggggctgtaaattgcgatgctcatcatatgaccgatccacgagctgatgggcttggtgtttcttcttgcattaagaatggtcttgaagatgctggtgtgtcagccgaagaggttaactacatcaatgcacacgcaacttcaactccagttggtgatctggccgaggtgaatgctataaagaaggtattcaagagtacagaagggatcaaaatgaacgcaaccaagtccatgattggacactgcttaggtgcagctggaggtctagaagccattgctacattgaaggccattcaaacaggatggttgcatcccaccataaatcaaattgacccggaacctgcagttgaatttaacacagttgcaaatcagaagcaacaacacgaagtcaatgttgcgatatcaaattcatttggctttggtggacacaattcagttgttgtattttctccattcaaaccttaatgtgatctggactttcttcccatggagcagcatagtcattttagaggcttcattaatttgtcaaatcactgcttcttgttattcttgtatgtcatcatcagcacatttagtacttataatcgttgttttttgtagtatttctctttaaaaatgaccgcgggaacatgctagaaatggtcttatggccaatgtaccgatttaagcacaaagttgagttgaaacaaagaggttgtggcattgggttatttcaccattccagacagtttgtagctttcggaaataatattacagttggc

SEQ ID NO: 759 - DNA, 1791 bp, Castanea mollissima
tttcttcttctctctttataaaaaagcttaacccccctcccaacacacaaaaagcaaaaaccaccacatcgttatcatcgtcacactacttcaccatgcaatcccttcaatcttctcctccgtgtctccgcccatctccgctaaccccacttctccaaaaccaatccaaatccaaatcccatttccatttccgcccctctcgcagcagcttccgccgccgcagcagcagtggcgcttccgtcattgtcaacgtctccgccccgaagcgagagcacgacccgaagaagcgggtcgtgattacgggcatgggtctggtctcggttttcgggaacgaggtcgatgagtactacaacaggttgctctctggcgagagtgggatcggcccgattgatcggttcgatgcttccaagtttccgacccggttcgccggtcagatccgcgggttcaactccgagggttacattgacggcaagaacgaccgccgcctcgacgattgcctccggtactgcattgtcgccggcaaaaaggcactcgtcgacgccgatctcggcggcgataagctctccaagattgataaggaacgggctggtgtgctagtgggaacagggatgggtggtcttacagtcttttcagacggtgttcaggctttaatagagaaaggtcacaggaaaataacccctttttcattccctatgctataacaaatatggggtctgcattgctaggaattgatcttggcttcatgggtccaaattattcaatttcaacggcttgtgctacctctaattattgcttctacgctgctgcaaatcacattcgccggggtgaggctgatctgatggttgcaggtgggactgaagctgctgttattcccattggattggggggttttgttgcatgcagggccttatctcagaggaatgatgatccaaaaactgcttcaaggccatgggataaaggtagagatggatttgttatgggtgaaggtgctggagtattgataatggagagcttggagcatgcgatgaaacgaggggcacctatcattgctgagtatttaggaggtgctgttaactgtgatgcttatcatatgactgatccaagagcagatggacttggtgtgtcttcatgcattcaaagcagccttgaagatgctggtgtgtcacccgaggaggttaactacataaatgcccatgcaacttctactcttgctggtgacctggcagagataaatgccataaaaaaggttttcaaggacacttcagggatcaaaattaatgcaactaagtcaatgattgggcattgccttggtgctgctgggggtttggaagccattgccactgtgaaagctataaatacaggatggctgcatcctagtataaatcaatttaatccagagccttcagttgactttgacacggttgcaaatacaaagcagcagcatgaagtgaatgttgctatttcgaattcatttggattcggtggacacaactctgttgtggccttttctgcattcaaaccttgatcatccagtcattttggatttcttttgggaaatgagctgtggttattcgagattttgtttaaactttgatattgcggctgcttcattttctaaatttctggagttgctgcatacttgtcaagccacatttagtttgttaatttctgtgatgatttagatttgaatttaagctcgaggatttccagacatctttactaaagaactatccgatctattgggctagtggtgtataagaatttattcaattttaatttatttagtggata

SEQ ID NO: 760 - DNA, 1876 bp, Ricinus communis
tgccagcattgtaacatgggtattactacgccctttgcagattgtcgaggccaattttgttggttcatctttgaaagaacaacaaatggaaaaagaaattccaaaaaacaacagcaagaatttcacttacgaaacgccaacgtggcagagattagctgaaagtagtttaaccccagcccactgccctctgctacttgtatgtagctttgcctctatttctttcgcttctcccaattcatcgttgttatcgctaccacttccgccaccaccccaccaccatgcaagccctgcagtccccgtctctccgaccatcccctctaaccccgctccataaaaatactcacaatgcagcaaaacgcccaactaaaaaggtctcctttatcaccgcatcatcaacaaataacaacacgacgatttcagctccaaagcgagagaaagaccccagaaaaagggtagtcataactggtacgggtttggtatctgtgtttgggaatgatgtcgatacttactacgataaattgcttgctggagaaagtgggatcggacttattgataggttcgatgcgtctaagtttcctactagatttggtggacagatcagggggtttaattcacaaggttatattgatgggaaaaatgatagaaggcttgatgattgtttgaggtattgcattgttgctggtaaaaaagctcttgagcatgctgatcttggtggtgataagttgtctaagattgataaagagcgagctggtgtgcttgttggaacagggatgggtggtcttacagtcttttcagatggtgttcaggccctaattgaaaaaggacacaggaaaattaccccattctttattccttatgctataacaaacatgggatctgccttgttagctattgaacttggtctcatgggtcctaattattcaatttcaactgcttgtgctacctccaattattgcttctatgctgctgccaatcatattcgcagaggtgaggctgaattgatgattgctggtggaactgaagccgccatcattccaatcggtttgggaggttttgtagcatgtagggccttatcacaaaggaatgatgatccacaaactgcctcaaggccatgggacaaagatcgagatggctttgttatgggtgaaggtgctggagtgttggtaatggagagtttggaacatgcaatgaaaaggggtgcaccaataattgctgagtacttgggaggtgctgttaattgtgatgcttatcacatgactgatccaagggctgatggacttggggtctcttcctgcattgagagaagtcttgaagatgccggtgtgtcacctgaggaggttaactatataaatgcacatgcaacttccactcttgctggtgaccttgctgagataaatgctattaaaaaagtattcaagaatacgtctgacatcaaaatcaatgcaaccaagtctatgataggacattgccttggtgctgctggaggtctggaagcaattgcctgtgtgaaggccattaccacaggatggttgcatcctacaattaatcaatttaacccagagccatcagttgaatttgacactgttgccaataagaagcagcagcacgaagtgaatgttgccatttcaaattcctttggattcggtggacacaactctgtggtagccttttctgcatttaaaccctgagagcatggccttcttctgcattcgggccgcggtcatttacatttaccatggcctgcatttcttgtaggaaccactggagagttgcttgcttatagacagagtcatcgacatcacttcccccttttagctttttgagctgctgatagtagtcagtttctcatttcagtatcaagtctatcttaagaagg

SEQ ID NO: 761 - DNA, 1948 bp, Ricinus communis
ctgaaagtagtttaaccccagcccactgccctctgctacttgtatgtagctttgcctctatttctttcgcttctcccaattcatcgttgttatcgctaccacttccgccaccaccccaccaccatgcaagccctgcagtccccgtctctccgaccatcccctctaaccccgctccataaaaatactcacaatgcagcaaaacgcccaactaaaaaggtctcctttatcaccgcatcatcaacaaataacaacacgacgatttcagctccaaagcgagagaaagaccccagaaaaagggtagtcataactggtacgggtttggtatctgtgtttgggaatgatgtcgatacttactacgataaattgcttgctggagaaagtgggatcggacttattgataggttcgatgcgtctaagtttcctactagatttggtggacagatcagggggtttaattcacaaggttatattgatgggaaaaatgatagaaggcttgatgattgtttgaggtattgcattgttgctggtaaaaaagctcttgagcatgctgatcttggtggtgataagttgtctaagattgataaagagcgagctggtgtgcttgttggaacagggatgggtggtcttacagtcttttcagatggtgttcaggccctaattgaaaaaggacacaggaaaattaccccattctttattccttatgctataacaaacatgggatctgccttgttagctattgaacttggtctcatgggtcctaattattcaatttcaactgcttgtgctacctccaattattgcttctatgctgctgccaatcatattcgcagaggtgaggctgaattgatgattgctggtggaactgaagccgccatcattccaatcggtttgggaggttttgtagcatgtagggccttatcacaaaggaatgatgatccacaaactgcctcaaggccatgggacaaagatcgagatggctttgttatgggtgaaggtgctggagtgttggtaatggagagtttggaacatgcaatgaaaaggggtgcaccaataattgctgagtacttgggaggtgctgttaattgtgatgcttatcacatgactgatccaagggctgatggacttggggtctcttcctgcattgagagaagtcttgaagatgccggtgtgtcacctgaggaggttaactatataaatgcacatgcaacttccactcttgctggtgaccttgctgagataaatgctattaaaaaagtattcaagaatacgtctgacatcaaaatcaatgcaaccaagtctatgataggacattgccttggtgctgctggaggtctggaagcaattgcctgtgtgaaggccattaccacaggatggttgcatcctacaattaatcaatttaacccagagccatcagttgaatttgacactgttgccaataagaagcagcagcacgaagtgaatgttgccatttcaaattcctttggattcggtggacacaactctgtggtagccttttctgcatttaaaccctgagagcatggccttcttctgcattcgggccgcggtcatttacatttaccatggcctgcatttcttgtaggaaccactggagagttgcttgcttatagacagagtcatcgacatcacttcccccttttagcttttgagctgctgatagtagtcagtttctcatttcagtatcaagtctatcttaagaaggtcttgcttaatttttcttttcaaattaccatttcattgtcattttccttggaactttagcttaagatctgctgtgatcatgtggttttgatttcaaattaattatgtagcggatacgaacaagcaatcataaaaagtctttttgaattatgtaattacgataactgttattttctttttccatatgagatccattcttgctgctttattaaacagcagtaacaagata

SEQ ID NO: 762 - DNA, 1525 bp, Flaveria ramosissima
cacctccccaatcgaccccctccgccgccacaaccaccgccaatttccgaccaatgtcaaacccccacgcagacccaccgtcgtaatgtccgccaccgcccccaaacgcgaaaaagaccccaagaaacgggtcgttatcacgggtatgggtcttgtatccgttttcgggaacgatgttgacacttactatgagaagttgttagcgggggagagtggaatcgggttgattgatagattcgatgcgtctaagtttccgacccgatttgggggtcagattcgtgggtttaaatctgatgggtatattgatgggaagaatgatcggaggcttgatgattgtttgcggtattgcattgttgcggggaagaaggctcttgaagatgctgatcttggtggggataaacgatctaagattgataaggagcgcgctggtgtgcttgttggaacaggaatgggaggtctcactgtattttctgatggagtccagaatctaatcgaaaagggttacagaaaaatcacaccttttttcattccttatgccataaccaacatgggttctgctttgcttgctattgatcttggattcatgggtccaaattactcaatttcaactgcatgtgctacttcaaactattgtttttatgctgctgcaaatcatattcgaagaggggaggctgatatgatgattgctggtggcacggaagccgctattattcctattgggttgggtggttttgtggcgtgtagggccctctctcaaaggaatgatgacccgcaaacagcttctagaccatgggacaaagatagagatggctttgtcatgggtgaaggtgctggtgtattggtgatggagagcttagaacatgcaatgaaaagggatgcaccaataattgccgaatacttgggtggggcggtaaattgtgatgcttatcatatgactgatcctcgatctgacggtcttggtgtttcttcttgcattcaaagcagccttgaagatgctggtgtgtcaccagaggaggttaactacataaacgcgcacgcaacttccacattggtaggtgatctggcggaggtaaatgctgtaaagaaggtatttaaaagcactgcaggaatcaaaatgaacgcaaccaagtctatgattggacactgcctaggtgcagccggaggtctggaagccattgctacagtcaaagccattcaaacaggatggctgcatcccaccataaatcaatttaatccagaacccgcagttgaatttgacaccgttgcaaatcaaaagcaacaacatgaaatcaacgttgccatttcaaattcatttggttttggtgggcacaactccgttgtggcgttctctgcattcaaaccttgatatgattgcttgcaagtcatttttgaggcttcgtcagtttgtctaatccacttgttcttgttctttattgtatgtcattataagcacatttagatcttatcctctttgtttcatgtgattctggttgaagacgacctccataacatttgctattatgtc

SEQ ID NO: 763 - DNA, 2011 bp, Gossypium raimondii
gtgaaacatgaaattactcaaagaaaatctgcaaaaccaaatataatttcacgtttagttcttataaattgtttagatttttttgttcaatttgacatttaacgtcaaatttatctcaaccatcattaaattattgaacaatcaccaccaaacaattatgctttactgcaattttctctttgcctaactttgatttttgattataagtattgaattttaatcctcttattttgtcttctaacttgtgtattttgctcttctgcacttagttatcatcgccctttagcttagctctttccgccattatcaacaatgcaagctcttcaagctcctacccttcgagcttccccattaaaccctctcaaaaaacccaacccaaatccccattttcgctatgtattcactctcccacatcggccaaccaagagattcacttccatcaccgcttcatccaccaccgtttcggctcccaagcgggagaaggacccaaaaaaacgggtcgttgttacgggtatgggcttggtatccgtttttgggaacgacgttgatgtttattacgataaattgttgtctggggaaagtgggattggactcatcgaccggttcgatgcttccaagtttccgactcggttcgccggtcagatccgggggtttacttctgaagggtatattgatggaaagaacgataggcgactcgatgattgcttgaggtattgcattgttgctggtaagaaggcacttgaagatgctgatcttgggggtgataaattatctaagattgataaagagcgaaccggagtgcttgttggaactggtatgggcggtcttactgtgttctctgatggtgttcaaaatctaatagagaagggtcatagaaaaataacaccatttttcattccttatgctataacaaacatgggatctgccttgcttgcaattgagcttggtttcatgggtcccaattattcgatttctaccgcttgtgcaacgtccaattattgcttctatgctgctgccaatcacatccgtcgaggtgaggctgatttgatgattgctggtggaactgaagctgcaattattcctattgggttggggggttttgtcgcctgtagggcattgtctcaaagaaacgaagatccacaaactgcttcaaggccatgggacaaagagcgggatggctttgttatgggtgaaggtgctggagtattggtgatggaaagcttggaacatgcaatgaaaagaggtgcaccaattatcgccgagtacttaggtggagctgttaattgtgatgcttatcatatgactgatccaagagccgacggtctcggggtgtcttcatgcatcgagagaagccttgaagatgccggtgtgtcccctgaggaggttaattacatcaatgcacacgcgacttcaactcttgctggtgacctggccgagataaacgctattaagaaggtattcaagaatacatcagagatcaaaatcaatgcaacaaagtctatgatcggccattgtctgggtgcagcaggtggtttagaagccattgccactgtgaaagccattacaacaggatgggttcatccaaccattaatcaatttaatccagagccttcagttgagttcgacactgttgccaatgaaaagcagcagcatgaggttaacgttgcaatatcgaattctttcggatttggtggacacaactctgtggtggcattttctgcattcaagccatgaaagtttcatcatttattagggaaaagatagaatctttgttcatgacagctgagggactgcttcaatctttgtaacatttcatgagagccatttttcatcattagttttgttataattttgacttggattttagctaccctaagaaaattgtgtacccctatttatattagttgatttatgagggtaatgattttattgaagtcagaacagatagccggattattaaaccggtgtaattgtacctagaatctcatttttatactctctgatcccacct

SEQ ID NO: 764 - DNA, 1941 bp, Euphorbia esula
catctccccttggcttcccctctaaaccctctccaagagaagactcgcaatgccaccaaaaccccacctaaaagagtctccttcatcactgcctcttcctccaccattaatcccgctacttcaccccctaaacgcgagaaagaccccaaaaaacgagtcgtaattaccggtatgggattggtttctgtcttcggaaatgatgtcgacgtctactatgatactttgctttccggcaagagtgggatcggaccaattgaccgctttgatgcctccaaatttccgactaggttcggcggccagatccgggggtttgattccgaaggctatatcgatgggaagaatgataggagacttgatgattgcttgaggtattgcattgtcgctgggaagaacgcctttgaaaatgcaggtcttggaggggatactctatccaagattgataaagagcgagctggtgtgcttgtgggaacagggatggggggtcttactgtcttttcagatggtgttcaggctctaatcgagagaggacataggaaaattaccccgttctttattccatatgctataacaaacatggggtctgccttgctaggaattgaacttggtctcatgggtccaaattattcaatttcaactgcctgtgctacctccaattattgcttctatgctgctgcaaatcacatacgccggggtgaggctgagatgatgattgctggtgggactgaggctgccataattcccattggtttgggaggttttgtagcttgtagggccttatcccagaggaatgatgatccacaaactgcttcaaggccttgggataaagaccgagatggctttgttatgggtgaaggtgctggagtcttggtaatggagagcttggaacatgcaatgaaacgaggtgctcctattcttgcagagtacttgggaggtgctgttaactgtgatgcttatcacatgactgatccaagagctgatggacttggggtctcttcctgcattgagagaagtcttgaagatgctggtgtgtcacctgaagaggtaaactacataaatgcgcatgcaacttccactctggctggtgaccttgctgagataaatgctataaagaaagtattcaagaatacttctgaaatcaaaatcaatgcaaccaagtctatgataggacattgccttggtgctgctggagggcttgaagctattgcttgtgttaaggccataaacaccggatggttgcatcccactatcaaccaatttaacccggagccttcagttgaatttgacactgtagccaacacaaaaaagcagcatgaagtcaatgttgccatttcaaattcgttcggatttggtggacacaactctgttgtggtgttctcatcattcaagccctgagaaattccccttgcctgtgtttcttcttcttcttcttcaacattaaggtccagggcataaacctttgtgcatttcttgtaggaatgagtcttgtttactagagagagagatagagttgcttatggagcatagatattgaggctgcttgttctttttaagttgagctgcaaatagtgtcctcttccagacatttgtagttttcttaccccaaataacctgaatgctttcttttccttttttttttaagttaaatttgtacttcagttttcttggaactttacattagggtgacctgtggcaattgagtttgatcagtcttaaattttatgcagtggttaccggcaaagtcgatttgaattaagctttaagttataatgtcctcttgttctgttaaaaatctatcctccatttaaagtggacttggtatggaacttactattacctatcctgtctattaatggagtttaagtttcctatttatatcatgcatattcttttttattacattagtaggtagaatatacattcacgtcaataaaaatcaatatt

SEQ ID NO: 765 - DNA, 2230 bp, Pinus taeda
agctactcagcatctgcaacaggattccttgcaacacttgtcttgtgatgcccaaatactaaattcatctactccatccacctttgcatgacacaatcttcgcagaaactgctggatttgcaattgcattcaggggagttgtggttcttgtgtctgaatatatacctgctttggtgtatggaacgcattagcctgcagtaaatcaaaaaattcccaggcttctcaggacagggcaatggcgagctcggcacttgcaggcatgactgcttctttatccatagctggattcgaacccagtcgaggaacttgcagtcgttcgatttctagatttgatggtctcagggctgctgaagctgagctctctgatgtttctctgctcttgggcgttcggcctaacaggctatctcgtgctggtcccaagaccggcgtccgagccatgttacttccttcagtcaatgcccttaacagagaaaaagatcctaaaaagagagtggttattacaggcatggggctagtttctgttttcggaaataatgttgacacatattatgaaagactcctggaaggtcagagtgggattgcccctatagaccgctttgatgcttcaaagtttcccacaagatttggaggacagattcggggattctcatctgagggttatattgatccaaagaatgaccgtcgtctggatgattgtattagatattgcctggttagtgggcaaaaggcacttgaagatgcagatctgggaaaggataaaataaataagattgataaggagcgagctggtgtactagtaggcagtggaatgggtgggctaaaagttttttctgatggagtacaggctcttatagacaaaggatacaggaaaataacacccttttttataccatatgcaattaccaacatgggctctgcattgcttggcattgaagtaggattcatgggtccaaattattctatatcaacagcatgtgctacgtccaactattgcttctatgcagctgcaaatcatattcgcagaggtgaggcagatatcatgctagctggtggtactgaagcagcaattattcccattggtttgggtgggtttgttgcatgccgagccttatctcagagaaatgatgatcctcagtctgcctcaaggccctgggacaaagaccgagatggctttgtcatgggtgaaggtgcaggcgtgttggttatggagagcttggaacatgcaaagaagagaggtgctccaattcttgctgaatatcttggtggagctattaactgtgatgcttatcacatgacagacccaagggctgatggccttggtgtctcatcatgtattgagaggagtcttattgatgcaggggtgtcaccagaagaggtgaattatataaatgcccatgccacatcaactcttgcaggtgacttggctgaggttaatgccatcaagagtgtgttcaaaaacacatctgagataaaaataaatgcaactaagtctatgatagggcactgtctaggtgcagctggtgggctagaagccattgccactgtcaaagccatcaatactggttggctgcatccatcgataaatcaatttaacccagaacctgcggtggaatttgatactgttagtaacgtaaagaagcagcacgaagtaaatgttgctatttcaaactcgtttggttttggggggcataattcagttgtagtgttcgcagcctatcgaccgtgagaacacatagctttgtttattgtttgaaaatagtccatgtagcagatgcaatctttaaaaaatgagagagcatttcctttgattcttttaggctactactgaaactgcaagaggttcccattattaattggaaacctctgttgtgaaataaattttaattgacataaaaagttcagattgggagcagaaatattggtgtcagagtagcagttggattcattcttcaatcaagagagaatatgttattctcttcattttatctttagtataacgtcttcatcctatcattatgacatttaggatcagcaagggttcaaatcttcctcaaattttgaccatcatatttttcatatttcacatgcaagaaaagggtttcctagtaaccttatttcacctgcaagaaaatggtttactagtaaccatactttactagtaagaatatttcaaatggtgtgtatgctttactagtaagagtgatcgaatagagaatccaatgtgtgactt

SEQ ID NO: 766 - DNA, 1692 bp, Manihot esculenta
agccatcgttgttatcgccatcttcattgctccctcctcttcttccttcaccaccaccgcagcttccaccgccatgcaatccctgcaatccccatctctccgaccaccccttcttaatcctttccacaagaactctcataatgcaaaaaaaaccccaactagaaagctatcttttatctctgcttcatctacaaataactctaccatttcggctcccaagcgcgagaaagaccccaagaaaagagtcgtgattacgggtatggggttggtttctgtttttgggaatgatgtggatgtttactatgacaagttgcttgatggagagagtggaatcggactcattgacaggttcgatgcctccaagtttcccaccaggttcgggggacagatccggggatttacttcagaaggttatatcgatgggaagaatgatagaaggcttgatgattgtttgaggtattgcattgttgcgggcaagaagtcgctggaacatgcggatcttggaggggataaactctctaagattgataaagagcgggctggtgtgcttgttggaacagggatgggtggccttacagttttttcagatggtgttcaggctctaattgaaagaggatataggaaaattaccccattttttattccttacgctattacaaacatgggctcggccttgcttgctatggacattggtttcatggggccgaactattcaatttcaactgcttgtgctacctccaattattgtttctacgctgctgctaatcacattcgccgtggtgaggctgatttgatgattgctggcggaactgaagctgccatcattcccattggattgggaggttttgtagcatgtagggccttatctcagaggaacgatgatccacaaactgcttcaaggccatgggataaaggtcgagatggctttgttatgggtgaaggtgcaggagtgttggttatggagagcttggaacatgcaatgaaacggggtgcacctattattgcagaatacttggggggtgctgttaactgcgatgcttatcacatgactgatccaagagctgatggacttggggtctcttcatgtatagagagaagtcttgaagatgctggtgtgtcacctgaggaggttaactacataaatgcgcatgcaacttctacccttgctggtgatcttgctgaaataaatgccatcaaaaaagtattcacgaatacttctgagatcaaaatcaatgcaaccaagtctatgatagggcattgccttggtgctgctggaggtttagaagcaattgcctgtgtgaaggccataaccacaggatggttgcatcctagcattaaccaatttgatccagagccttcagttgaatttgacactgttgccaataagaagcagcagcacgaagtgaatgttgccatttcaaattcctttggatttggtggacacaactccgttgtggccttttctgcttttaagccctgaatgtctggcttgtcagcgaatctgtttctgcaattcaaggctggccattttccttgcctgtattttttgcaggaactagtctccgcctaattgtgagttgcttgtaacctagacattgaggcggctgatagtcactcttcaaaacatttgtagtttttgcccccagtaatttgagtatggcccatagctcaaggacattttctttttgaagt

SEQ ID NO: 767 - DNA, 2033 bp, Citrus sinensis
cgtggattacgtaatatatcgtatgtgctacagtccacaggagctcaccatttgctcaaccaccagcagccaaacccagcttagcacgggggctgtggcttctgctttcaagcgtttcatttttaattcaatttcccactcactagttaacaactactaacaggactctcatcgtttgcatcgcccaccttcttcttcattcattcattgttggctcactgaggcataacctcaaacagaaaacatgcaatctcttcaatcctcttctctccacgcgtctccactaaacccacttcgcagcaaatccaacttcaatctccccaacaatgcgagaccgaccgcaaggagagtctccttcatcactgcttcttcaaccaaatccgctcccaagcgggagaaggaccccaagaagcgcgtggtcatcacgggaatgggcttggtctccgtgtttggcaatgatgtcgatgcgtattataacaagttgttggatggtgaaagtggaatcactatgattgaccggttcgatgctagtaagttcccgacccggttcggcggccagatccggggatttagtgccgagggttatattgatggcaagaatgatcgcagacttgatgattgtttgaggtactgcattgttgctggcaagaaggctctcgaagatgcggatcttggtgccgatatttctaagaagattgataaggaacgggctggggttcttgtgggaacaggaatgggtggtcttacagtcttttctgatggagtccaggctctaatagaaaaaggtcatagaaaaataaccccgttcttcattccgtatgctataacaaacatgggttctgctttgcttgcaattgaccttggcttcatgggtccaaattattcaatttcaactgcctgtgcgacctccaattattgcttttatgctgccgccaatcacatccgtcgaggagaggctgatttgatgcttgctggtggaactgaagcagccattattcctattggattgggtggttttgttgcatgtagagcattgtctcagagaaatgatgacccacaaactgcttctaggccatgggacaaagatcgggatggctttgtcatgggagaaggtgctggagtattggtgatggagagcttggaacatgcaatgaaacgaggtgcaccgatcatagcagagtacttagggggtgctgttaattgtgatgcttatcatatgactgaccccagagctgatggacttggagtgtcttcatgcattgagagcagccttgaagatgctggtgtgtcacctgaggaggtcaactacataaatgctcacgcaacttccactttagctggtgacctggctgagataaatgctattaaaaaggtgttcaagaacaccacagggatcaaaatcaatgccacgaagtctatgatagggcactgccttggtgcagctgggggtttggaagcaattgccactgtcaaggcaataaccacgggatggctgcatccttccattaatcaatttaaccctgaaccttcagttgagttcgacactgtcgccaacaaaaaacagcagcatgaagtgaatgttgccatctctaattcatttggatttggagggcacaactctgtcgttgcattttctgcattcaaaccatgaatcatccagcctgttcataagtctagaagatctggtcattaattggtcaaggagccgcatcatcctgtctattgagttgctgcatatttattttgaggcttttgtaacagttatgtaataattgtaagttggactttagttcaggataatgagccattttctcctttcaaccattggatttatgaggctagttgagagggcatgaaattttgtcagatttttaattatgctgtggacagaagaatgagccgccgaggtctagcattaatatcactcgtggctctgttcttcattgtttgttatgtgggaatttcagatcttagctgatgggctatggtttatttaagttaacccgcatatttggattgcggacacggatatc

SEQ ID NO: 768 - DNA, 1701 bp, Helianthus annuus
ggcggggggccacccttgacaaacatagcatttggtaagatctgccactaaaacacacaccagtgacagttgtatctctctctctcttatctaccccctcccccctcacaacacatccattcaacaatcaaatctattcaatttcaagcaccatgcaagctcaagctcttcttcaatcaaccccacttcgggtctccccactcgacccgattcacaaacccatcaatctcaaaccaccctcactctcttccacgcgccgccgcgccgttatctccgccgtctccgccgcccccaagcgggaaaaggatccgaagaaacgggtcgtcattacgggtatgggtttggtgtctgttttcgggaatgatgtggatacgtactatgagaagctgttggctggtgagagtggaatcgggttgattgaccggttcgatgcgtccaagtttccgacccggtttggtgggcagattcgtgggtttaaagctgatgggtatattgatgggaagaatgaccggagacttgatgattgtttgagatattgcattgttgctggtaaaaaggcccttgaacatgctgatcttgctgctgataatcgctccaagattgataaagagcgtgccggtgtgcttgttggaacaggaatgggaggtctaacggtattttccgatggagttaagtctctaatagaaaaaggttacagaaaaatcacacctttctttatcccgtacgcaataacaaacatggcgtctgcattattagctattgatttgggctttatgggccctaactactcaatttcaaccgcttgtgctacctcaaactactgctttcatgctgctgcaaatcacatccgtagaggcgaagctgatatgatgattgctggcggtacggaagctgccattattccaatcggattgggtggttttgttgcgtgtagagcgttgtctcagagaaacgatgatccgcaaactgcttcaaggccttgggaccaagatagagacgggttcgtcatgggtgaaggtgctggtgttttggtgatggagagcttggaacatgcaatgaaaagagatgcacccatacttgctgaatacttaggtggtgctattaattgtgatgcgtatcacatgacggacccgcgttcagatggacttggtgtttcttcttgtattcaaagctgtctagatgatgctggcgtgtcagcagaggaggttaactacatcaacgcacacgcaacttcaacattggttggtgatctagctgaagtaaatgcggtgaagaaggtattcaagaacaccgcaggaatcaaaatgaatgcaaccaagtcgatgatagggcactgtttaggtgcagctggaggtctggaagccattgctacagttaaagccatccaaacagggtggctacatccctccataaatcaatttaacccggagcctgcagttgaattcgacactgttgctaatgtaaagcagcagcatgaaattaacgtcgggatttcaaattcatttggttttggtggacacaactctgttgtagcattctctgctttcaagccttgatttgatggaaggaaatgctgcatcatgggcatatttaggcttatgacactgttgttttaatgtttgttggccaatttagacattttagaagtgagttgagttcattttgtgatttagaggatagcaaccaatgctccaaaatctt

SEQ ID NO: 769 - DNA, 1757 bp, Triphysaria pusilla
aattagaccacatcgagttcatcgaaacacttcgactcgcccatccgccgtcatgcaatcccttcactacgccgccctccgcccctcccccatcgaccccctcaaaactccgcgctcaaccgcctttcccggctgcaatgccaaaccgccgtctaagaggcttcccttcacaatctccgcatccaccccgaccatttcggcccccaagcgggagacggacccgaagaagcgcgtcgtgatcacgggtatgggccttgtctccgtgttcggaaatgatgtggatgcatactacgagaagctgctctccggcgagagcggcatcactcctatagaccggtttgatgcgtcgaaattccccacgcgcttcggcggccagattaggggattcaaatctgagggatacattgatggtaaaaatgatcggcgattagacgattgcttgaggtactgcattgttgctgggaaaaaggcgctcgagggcgcagatctcggtggcgataatctcaacaagattgacaaaattcgatctggtgttctcgttggaacaggaatgggcggtctcaccgccttttccgatggtgttcagaacctaatcgagaaaggtcacaggaaaatctctccgtttttcataccttacgccataacaaacatgggatctgccttgctggggattgacctcggcttcatgggccccaactattcgatttcaaccgcttgtgcaacctcaaattattgcttctacgcggctgcaaatcacattcgccgtggcgaagctgatttgatgctcgctggtgggaccgaagctgccattattccgatcggattgggaggtttcgttgcgtgcagagctttgtctcagagaaatgacgacccaaaaaccgcttcgagaccttgggataaagatcgagatggatttgttatgggtgaaggtgctggagtattggttatggaaagtttggaacatgcaatgaaacgaggtgcgcctataattgcagagtatttgggaggtgcagtaaattgtgatgcttaccacatgactgatcctagagctgatgggcttggtgtctcttcgtgtattcatagtgctcttgaagatgctggtgtttcccctgaggaggttaactacattaacgcccacgcaacttcaaccatagtgggtgacttagctgaggtgaatgctatcaagaaggtattcaagaacacctcagagattaagatcaacgcaactaagtcgatgattggacactgcctcggtgctgccggtggtttggaagctattgcaacagtgaaagcaatcacgacaggctggcttcatccctcgataaatcaattcaacccggagtcttctgttgagtttgacaccgttgcaaacaaaaagcagcagcacgaagtcaatgttgccatatcgaattcatttggattcggtggacacaactcggtcgttgcattttctgcattcaaaccctgatctcgtgttcggtatctttagtagaatgagcaatcttgcttatcgggactttgtattaattgttcatttagcattttcagacaaaggcgcattcatttgtcaagtgtaataacgtcgagtgtagttttttgttcgactatttctatttattgggactcgtaaacatgcgtctttactaggtgtgatttgcatcagttttgcttcattctgtcttttgctcatgtgacatgtacaatgctataattcatggttgaggccatgatgtcaagatttgatatttgctaaaaaa

SEQ ID NO: 770 - DNA, 2088 bp, Fagus grandifolia
cttttaatcccaaatccaactccactctctttcattttttttttcccttcacaaaacaacgcaacattgttatcatcgtcaccaccaacaccaacaccatgcaattgcaagcgcttcaatccccaactctccgtccctctccgttaacctcactccgcaataaacactctcattcccattcccatttccacttccaaacttctagacgccgcgcctccgtcattgttaacgtcgctaccgctccgaaacgcgagaatgacccgaagaagcgggtcgtgatcacgggtatgggtttggtatcggttttcggaaacgaagtcgatgagtactacaataggttgctatcgggcgagagcgggatcggaccgatcgaccggttcgatgcttccaagtttccgacccggttcgctggtcagatccatggatttagctccgagggttacattgacgggaagaatgaccgtcgactcgacgattgccttcgttactgcattgtcgccggaaagaaggctctcgtggacgccgatctcggcggcgataagctatccaagattgataaggaacgagctggtgtgcttgtgggaacagggatgggtggtcttacagtcttttctgatggtgttcaggctttaatagagaaaggtcataggaaaataaccccttttttcattccctacgctataaccaacatggggtctgcgttgctaggaattgatcttggcttcatgggtccaaactattcaatttcaacggcttgtgccacctccaattattgcttctatgctgctgcaaatcacatccgccggggtgaggctgatctgatgattgcaggtgggactgaagctgctgttattcccattggattgggaggttttgttgcatgcagggccttatctcagaggaatgatgatccgaaaactgcttcaaggccatgggatagagatagagatggatttgttatgggtgaaggtgctggagtattgataatggagagcttggagcatgcaatgaaacgaggtgcacctatcgttgctgagtatttaggaggtgctgttaactgtgatgcccatcatatgactgatccaagagccgatggacttggtgtgtcttcatgcattcaaagcagccttgaagatgctggtgtgtcacctgaggaggttaactacataaatgcccatgcaacttccactcttgctggtgacctggctgagataaatgccataaaaaaggtttcaaggactcttcagagatcaaaattaatgcaactaagtcaatgattgggcattgccttggtgctgctgggggtttggaagccatcgcaactgtgaaagccataaatacaggatggctgcatccttctataaatcaatttaatccagagccttcagttgactttgacaccgttgcaaataaaaagcagcagcatgaagtgaatgttgctatttcaaattcatttggattcggtggacacaactctgtcgtggccttttctgcattcaaaccttgatcatccaatcattctgggtttctataggagatcagtcatgcttattcaagattttggttaaactttgttatcgaggctgctttattttctagctttctggagtcactgcatacttgtcaatccatttgtagttttttaattttgtgataatttttagttgaattcaagcttgaggacttccagtcatctttactaaagaacttttcattctattgggctagtagtgtcagtgtataaggttctatttaattttaaattgcgtagtggataagaaaaagtgccaaaggccttttgcttttatatcattgtttcgacctttctcagttattgattggaaagtagatcgctacaggttcataaaataggctgaggggagtttagttctgctctaattctgtggataatggtccagaacagcttccaagttccaaccaggcggcccaaagtttctaatattcaaagcccaactttagtgttctctctttggatacagctacaagggctgatgttgctcctaaagcttcacaaccatttattttaatggtctgtattctgtaaacttaggtgttcaacttttccct

SEQ ID NO: 771 - DNA, 1722 bp, Catharanthus roseus
actccctccaatcccctcctctccggccatctccactcgaccctctccgaaaacccacttcacatttcctctctattaacaccagacctccaactcccctatccaagaagctccctttcatctctgcttctgctactaccaattctactgtttcagctcccaagcgcgagaaagatcccaagaaacgtgttgttattactggtatgggcctcgtttctgtctttggcaatgatgttgatgcctattacgagaaattactcgctggagagagtggaatcacgcccattgatcgcttcgatgcctctaagttccccacccgttttggtggtcagattcggggtttcaaatctgaaggttacattgatggcaagaatgataggagacttgacgattgcttgaggtattgcattgttgctggcaagaaagccctggagaatgccgatcttggcggagatagaattgggacgattgataaggagcgagctggtgtgctggttggaacagggatgggtggtcttacagttttctcagatggtgttcaggctctaatagagaaaggttatagaaaaatcacacctttcttcataccttacgctataacgaacatgggatccgctttgcttgccattgatctgggttttatggggccaaactactcaatttcaactgcttgtgctacctctaattattgcttctatgctgctgctaatcacatccgaagaggtgaggctgacatgatgattgccggcggaacagaagcagccattattcccattggcttaggaggttttgttgcttgtagagctttgtctcagagaaatgatgatccgcaaacagcctctagaccatgggacaaagaccgggatggttttgtcatgggtgagggtgctggtgtcttggttatggaaagcttggagcatgcaatgaaacgcggtgcaccaattattgccgaatacttgggaggtgcagtaaactgtgatgcttatcatatgactgatccaagagctgatggacttggtgtttcttcctgcatccaaagcagccttgaagatgctggtgtttcacctgaggaggttaactacataaatgctcatgcaacttcaaccattgttggtgacctggctgaagtgaatgctatcaagaaggtattcaagaacacttcagggattaaaatgaatgcaacaaagtctatgatagggcattgccttggtgctgctggtggtcttgaagctattgctacagttaaagccattacaacgggctggctgcatccaacaataaatcaatttaatccagaaccttctgttgagtttgacactgttgccaataagaagcagcagcatgaaatcaatgttggaatttcaaactcttttggatttggagggcataactctgtggtggctttttctgcattcaaggcttaaactaaacttttatccatattccttgtagcgcaaagcaatagtaatagagagttgaattgcagaagctttttgaattcacaggtcgctgctgcattcgtatgtttccagtccatgtgaggattttcaacaaagtaattttctgagagatgggatttttatgttttgttttttagattaacctgttgtgactgaaaatgtaggaggtatcagcagtaatcattcttgaaatcatttttgagttgtgatagttctagaggggttgtgtgttttttgagaataataaataaaaaattttttt

SEQ ID NO: 772 - DNA, 1785 bp, Cichorium intybus
gtgtatccatccattatatacccctgttcaagtcatccttcaaatcgatccaacatcaccatctccacaaaatctcatcctttctttctctatctctacaaccatgcaagctcaagctcttcttcaatcaaccccacttcgggtatccccacttgacccgcttcagaaacactccttactcaccaatgtcaaatcgacttcattcgccacacgccgccgcgcagtgatttcggctgtcgccgccgcccccaagcgggagaaggatccgaaaaaacgagttgtcattacgggtatgggtttggtgtcggtgttcgggaacgacgtcgatacttactatgagaagttgttggcgggggagagcggaatcggattgatagaccggttcgatgcgtccaagtttccgactcggtttggaggtcagattcgggggtttaaggcggatgggtatattgatgggaagaatgaccggaggcttgatgattgtctacggtattgcattgttgctggtaaaaaggctcttgaagatgctgatcttggtggtgataaacgctctaagatcgataaagaacgtgcgggtgtgcttgtggggacaggaatgggcggtcttacagtgttttccgatggggtccagtctctaatagaaagaggctacagaaaaatcactccttttttcatcccatatgcaataacaaacatggggtccgccttgttggctatcgatttggggtttatggggcccaactactcaatctcaaccgcgtgtgccacctccaattactgcttccacgcggcggcaaatcatatccggcgaggggaggcggatatgatgattgctggcggcaccgaggcggcaattatttcgattggattgggcggttttgtcgcgtgtagagctttgtctcaaagaaacgatgatccccaaactgcttccaggccatgggaccaagatagagacggctttgtcatgggtgaaggtgctggtgttttggtgatggaaagcttagaacatgcaatgaaaagagacgcaccaattcttgcagaatatttgggaggtgcgataaattgtgatgcgtatcatatgactgatccacgttcagatggactcggtgtttcttcttgtattcaaagtagtcttcaagatgctggtgtatctgcagaggaggttaattacatcaatgcacatgcaacttcaacattggttggtgatcttgctgaagtaaatgctgtaaaaaaagtattcaagaacactgatggcatcaaaatgaatgcaaccaagtcaatgataggacactgcttaggtgcagcgggcggtctggaagccattgctacggttaaagccattcagacagggtggctacatccctccataaatcaatttaacccggaacccgcagtcgaatttgacactgttgcgaatgtaaaacagcagcacgaaatcaacgttgcgatttcaaattcgttcggatttggtggacacaactctgttgtagcattctctgctttcaagccttgatatgatttgtggaaatttagggtttataaaaagactgttgttttaatgtttgtttggccaatttagacatgttagaggtgagtgatgagtacattttgagatttagaggcattagctttgcgttcaagaacatgtctgtattatttattaaatcacatctttctctctctctctctcacacacacacacacagtaccaacaatatttttgggccagctatgttatgatgtttaaaagagtatgtatgtgtgaatacattttaaaaataaaaa

SEQ ID NO: 773 - DNA, 1508 bp, Chrysanthemum coronarium
catttccagtccttttccagcaaactcaatctcaagcactactccaacaacctcatttccatgtcaccaccagtcccaacccatttcgccgtcaggccatcaccttcaagcccaccacactccgccgcaaacccatctcagcagcagccgccatttcatccgccccacaaagagaaactgacccaaaaaagagagtggtcataactggcatgggtttagtttcagtatttggaaatgatgtggatacgtattacgagaagctgttagctggtgaaagtgggattggtttgattgatagatttgatgcttccaagtttcctacgagatttggtgggcagatacgtgggtttcaaagtgaagggtatattgatgggaagaatgataggaggttggatgattgtttgaggtattgtattgttgctgggaagaaagctttggagagtgctggtcttggtgctgatcaacgtcatcagattgataaagagcgtgccggagtgctcgttggaacaggaatgggaggtcttactgtattttctgatggtgtccaaaatcttattgaaaagggttacaggaaaatcacgcctttttttattccatatgccataacaaacatgggttcagccttgctcgctattgatctcggatttatgggaccaaattactccatttcaactgcatgtgctacttcaaaccattgcttttatgctgctgcaaatcatattcgtagaggtgaagctgatttgatgatagctggtgggactgaagccgccattattcctattgggctgggtgggtttgtggcttgtagagcactttctcaaagaaacgatgatccgaagacagcttctaggccatgggataaaaatagagatgggtttgttatgggtgaaggtgctggtgttctggtaatggagagcttggaacatgcaatgaaaaggggtgcaccgatcattgctgaatacttgggtggggctgtaaattgtgatgctcatcatatgaccgatccacgagctgacgggcttggtgtttcttcttgcattaaaaatggtcttgaagacgctggtgtgtcagccgaggaggtcaactatatcaacgcacatgcaacttcaactcctgttggtgatctggccgaggtaaatgctataaagaaggtatttaaaagtacagaagggatcaaaatgaacgcaaccaagtccatgattggacactgcttaggtgcagctggaggtctagaagccattgctacattgaaagccattcaaacaggatggttgcatcccaccataaatcaaattgatccagaacctgcagttgaatttaacacagttgcaaatcagaagcaacaacacgaaatcaatgttgggatatcaaattcatttggttttggtggacacaactccgttgttgtattttctccattcaaaccttgatatgattgagacgtgaactatcatcgcatggagcagcagtcatttcagaggcttcattaattcttcaaatcccacgag

SEQ ID NO: 774 - DNA, 1818 bp, Cichorium intybus
cctcatcgtccaccccctccacatcgtttgtatcgatggaacactgaagtaactattagtacttccaccattcatcatcatcgccttctctccatcaacaaccatgcaagctcaagctctcctccaatcaacccaactcagggcctcccctctcgacccgctccgccaccattctttcggcatcaatgttaaacccctcccagtcccccgcagaaccaccatagtaatgtccgcctccgcacctaaacgcgaaacagaccccaaaaaacgtgtagtcatcaccggtatgggtctcgtctccgtatttggaaacgacgttgacacctactacgagaaattgttagccggagagagcggaatcgggttgatcgacaggttcgacgcgtccaaatttccgacccgattcggtggccagattcgtgggtttaaatccgatgggtatatcgatgggaaaaacgatcggagacttgacgattgcctccggtattgcattgttgctggtaaaaaagctcttgaagatgctgatcttggtggcgataaacgctccaagattgataaggagcgtgccggtgtccttgttggtacaggaatgggaggtcttactgtattttccgatggagtccagtctctaatcgaaagaggttacagaaaaatcaccccatttttcattccttatgcaataacaaacatgggttcagcgttacttgccattgatgtcggatttatgggaccaaactactcaatttcaactgcatgtgctacttccaattattgcttttatgctgctgcaaatcatattcgcagaggtgaagccgatatgatgattgctggtggcactgaagctgccattattccaatcggcttgggaggttttgtggcatgtagagcactttctcagagaaatgatgatccacaaactgcttctaggccatgggacaaagatagagacgggtttgtcatgggtgaaggtgccggtgttctggtgatggagagcttggaacatgcaatgaaaagggatgcaccgatacttgctgaatatttgggaggggcagtaaactgtgatgcttatcatatgactgatccacgatctgatggacttggtgtttcttcttgcattaagactagtcttatagatgcgggtgtgtcagcagaggaggttaactacataaatgcacatgcaacttcgacattggttggtgatttggccgaagtaaatgctgtaaagaaggtattcaaaagcacggacgggatcaaaatgaactcaaccaagtctatgattggacactgcttgggtgcagcaggaggtcttgaagccattgctacaattaaagctattcaaacggggtggttacatccaaccataaaccaatttaatccagaacctgccgttgaatttgatacagttgcaaatcaaaagcaacagcatgaaatcaacgttgcaatttcaaattcgtttggatttggtggacataactctgttgtggcgttttctgcattcaaaccatgatatatgatcacgacttctgtctttccatggaggaactccaagtcattttaataattgttgatttatgtgataattctggccaaaatgaccttaagaacatgctataaacggtctcttggttgatataacgatttaggcaaaacattttgagtcgggacaagattttgaggtttgcatcgggttaaaggatttcagagagttcgtagcttttgcaaaatatgtaatttggtttgttgttttaagttaaacaatgtttattttttcaaaaatgtattttgttgcttcatctgatatgggcttggattatgttt

SEQ ID NO: 775 - DNA, 1771 bp, Artemisia annua
gaacatcgtttgtatcgactcaaacacacattaaaaaacacaaacacacaaacactaaaacacacacaacaaaacacaaaaacacaccattttccacacacaaacacacacacaaaaccatgcaaactcaatctcaagcactactccaacaaccccatttccgggtcaccaccagccccgacccatttcgccgccagcccatcaccttcaagcccaccactctccgccgcaaacccatcacagcagccatctcatccgccccacaaagagaaactgacccaaagaaaagggtagtcataactggcatgggcttagtgtcagtctttggaaatgatgttgatacgtattatgagaagcttttagctggtgaaagtgggattggtttgattgatagatttgatgcttccaagtttcctacgagatttggtgggcagatacgtgggtttaaaagtgatgggtatattgatggtaagaatgataggaggttggatgattgtttgaggtattgtattgttgctggtaagaaagctttggagagtgctggtcttggtgctgatcagcgtgatcagattgataaagagcgtgctggagttctcgttggaacaggaatgggaggtcttactgtattttctgatggtgtccaaaatcttatcgagaagggttacaggaaaatcactccttttttcattccatatgccataacaaacatgggttcggccttgcttgctattgatcttggatttatgggaccaaattactccatttcaactgcatgtgctacttcaaaccattgcttttatgctgctgcaaatcatattcgtagaggtgaagctgatttgatgattgctggtgggaccgaagccgccattattcctattgggctgggtgggtttgtggcttgtagagcactttctcaaagaaacgatgatcccaaaacagcttctaggccatgggataaaaatagggatgggtttgttatgggtgaaggtgctggtgttctggtaatggagagcttggaacatgcaatgaaaaggggtgcaccaattattgctgaatacttgggtggggctgtaaattgcgatgctcatcatatgaccgatccacgagctgatgggcttggtgtttcttcttgcattaaaagtggccttgaagacgctggtgtgtcagccgaggaggtcaactacatcaatgcacacgcaacttcaactccggttggtgatctggccgaggtaaatgctataaagaaggtattcaagagtacagaagggatcaaaatgaacgcaaccaagtccatgattggacactgcttaggtgcagctggaggtctagaagccattgctacattgaaagccattcaaaccggatggttgcatcccaccataaatcaaattgacccagaacctgcagttgaatttaacacagttgcaaatcagaagcaacaacacgaagtcaatgttgcaatatcaaattcatttggatttggtggacacaattcagttgttgtattttctccattcaaaccttaatgtgatctggactttcttcccatggagcagcatagtcattttagaggcttcattaatttgtcaaatcactgcttcttgttattcttgtatgtcatcatcagcacatttagtactcataatcgttgttttttgtattatttctctttaaaaaatgactgcgggaacatgttagaaatggtcttatggccaatgtaccgatttaagcacaaagttttgagttggaacaaagaggctgtggctttgga

SEQ ID NO: 776 - DNA, 1639 bp, Brassica napus
tccccaccgaacccactcctcaaaccttcgaatcgtcaatctcaccaaatcaccaatgcgagacaacccaccaggagacgcacattcatctccgcctcagccgccgtctccgctcccaaacgcgaaacggatccgaagaaacgcgtcgtgatcaccggaatgggactcgtctccgtcttcgggaacgacgtcgacgcttactacgagaaactgctctccggcgagagtgggatcagcttgattgatcgattcgatgcttccaagttcccgactcgattcggtggccagatccgtgggtttagctctgagggttacatcgatgggaagaacgagcggaggcttgatgattgtctgaagtattgcattgtggctgggaagaaggctcttgaaagtgctaatcttggtggtgataagcttaacacgattgataagcagagagctggagtactagtggggactggtatgggtggtttgactgtgttttcagacggagttcaagctcttattgagaaaggtcacaggaggatatctccgttttttattccttatgcaatcacaaacatgggttctgctttgctggcgattgatcttggtctcatgggtcctaactactcgatctctaccgcttgtgccacctctaactactgcttttacgccgctgccaaccacattcgccgtggggaagctgatatgatgattgctggtggaaccgaggctgccattattcctattgggttgggaggttttgttgcttgcagggcgctttcgcagaggaatgatgaccctaaaaccgcttcgaggccatgggataaacagagagatggctttgtaatgggtgaaggagctggtgttctggtgatggaaagcttggaacatgcgatgaaacgtggtgctccaatagtagcagaatatcttggaggtgctgtaaactgtgatgctcatcatatgactgatccaagagctgatgggcttggtgtctcttcatgcattgagagctgccttgaagatgctggtgtttcacccgaggaggtaaattacatcaatgcgcatgcaacttccacacttgctggtgatcttgctgagattaatgccattaaaaaggtattcaagagcactgctgggatcaaaatcaatgccaccaagtctatgataggtcactgcctcggtgcagctggaggtcttgaagccattgcgaccgtgaaggctatcaacactggatggcttcatccctcaatcaaccaatttaacccagaaccagccgtggactttgacacggtcgcaaacgagaagaagccgcacgaggtgaacgttgccatatcaaattcgtttgggttcggtggacataactcagttgtcgccttctctgccttcaaaccctgattccttcaagacccttttgtattttcttctccaactgttacatcaccaccatcatccatcaggcatcatcttccttgagcttcttggttccacgagtttgagctctttcgttggcgttttacgttccgttcaacattgttcattgagatttcaaattttgcttctcaatcgtaagaaatgtttgtatctgtatctgagttcgtttcatatttgtctaatttataaacagaaccaataatcttgtagcaatgatgttatt

SEQ ID NO: 777 - DNA, 1860 bp, Gossypium hirsutum
aaggtgagtcataagtgcagttggaggcagccctctaagtagatccacaatccagatttgaggttctgactatatatacagtaaagctttcgtttttattggttgctcagtgtcactttgttattatcgccctaagcactttccccagttcccacgagtcatggaagctcttcaagcctcatctcttcgagcttcccctctaaaacctctccaaaaacccaaactcaatatccatttccccaatgcatcgagactcgttcccaggccaaccaagaaattctcttccatcaccgcttcatcccccaccgtatctgctcccaagcgcgagaaggaccccaaaaaacgggtcgttattacgggtatgggattggtttccgtttttgggaatgatgtcgatgcttattacgataagttgctggctggggaaagcgggatcggactcatcgaccggttcgatgcttccaagtttcctacccggttcgccggtcagatccggggtttctcttctcagggttacattgacggaaagaacgataggcgacttgacgattgcttgaggtactgcattgttgcaggaaagaaggctttggaagatgctgatctcgggggcgataagttatccaagatcgataaagagcgagctggagtgctagttggaactggtatgggtggtctaacggtgttctctgatggcgtccaaaatctgatagagaaaggctatagaaaaataacaccattcttcattccctatgctataacaaacatgtcatctgccttgctagccattgatcttggtctcatgggtccaaattattcaatttcaactgcttgtgctacctccaattattgcttctatgctgctgccaaccacatccgtcgaggtgaggctgaaatgatgattgctggtggaactgaggctgcaattattcctattgggctggggggctttgttgcctgcagggcattgtctcaaagaaatgatgaccctcaaactgcttcaagaccatgggacgaagaccgagatggctttgttatgggtgagggtgctggagtattggtaatggaaagcttggaacatgccatgaaaagaggtgcaccaattattgctgagtacttaggtggagctgttaattgtgatgcttatcatatgactgatccaagatctgatggtcttggggtgtcctcatgcattgagagaagccttgaagatgctggtgtgtctcctgaagaggtaaactacataaatgcacatgcaacttctactcttgctggtgatctggctgagataaacgctattaaaaaggtattcaagaatacatctggcatcaaaatcaatgcaacaaagtcgatgatagggcactgtctgggtgcagcaggcggtttagaagccattgccactgtgaaagccattaccacgggatggctgcatccctccataaaccaatttaatccagagccatcagttgagtttgacactgttgccaacaaaaagcagcagcacgaggttaatgttgcaatctcaaattcatttggatttggaggacacaactcggtggtggcattttcagccttcaagccatgaaagtctgttacttacgtgttctgcatttgttaggaaagatgatgatagagaatattgatcgttaaaagagcgagtcaggtatttgtttgtggatgtggaggctgcttcaatccttgtgtaacttttcgtgagagccaatttgtgattttgtcagtttcggaatgattttgagttgaattctagctttagcctaggaattggtgaactcgtatattttcaacaccaacacgacaatatttgatgaggcaattaatgaaggagagattttgttctgtttt

SEQ ID NO: 778 - DNA, 1942 bp, Gossypium raimondii
ggtaaggtgagtcataagtgcagttggaggcagccctcaaagtagttccacaatccagatttgaggctctgactatatatacagtaaagttttcgtttttattggttgctcagtcttactttgttattatcgccctaagcactttccccagttcccacgagtcatggaagctcttcaagcctcatctcttcgagcttcccctctaaaacctctccaaaaacccaaactcaatatccatttccccaatgcatcgagactcgttcccaggccaaccaagaaattctcttccatcaccgcttcatcccccaccgtatctgctcccaagcgcgagaaggaccccaaaaaacgggtcgttattacgggtatgggattggtttccgtttttgggaatgatgtcgatgcttattacgataagttgctggctggggaaagcgggatcggactcatcgaccggttcgatgcttccaagtttcctacccggttcgccggtcagatccggggtttctcttctcagggttacattgacggaaagaacgataggcgacttgacgattgcttgaggtactgcattgttgcaggaaagaaggctttggaagatgctgatctcgggggcgataagttatccaagatcgataaggagcgagctggagtgctagttggaactggtatgggtggtctaacagtgttctctgatggcgtccaaaatctgatagagaaaggctatagaaaaataacaccattcttcattccctatgctataacaaacatgtcatctgccttgctagccattgatcttggtctcatgggtccaaattattcaatttcaactgcttgtgctacctccaattattgcttctatgctgctgccaaccacatccgtcgaggtgaggctgaaatgatgattgctggtggaactgaggctgcaattattcctattgggctggggggctttgttgcctgcagggcattgtctcaaagaaatgatgaccctcaaactgcttcaagaccatgggacaaagaccgagatggctttgttatgggtgagggtgctggagtattggtaatggaaagcttggaacatgccatgaaaagaggtgcaccaattattgctgagtacttaggtggagctgttaattgtgatgcttatcatatgactgatccaagatctgatggtcttggggtgtcctcatgcattgagagaagccttgaagatgctggtgtgtctcctgaagaggtaaactacataaatgcacatgcaacttctactcttgctggtgatctggctgagataaacgctattaaaaaggtattcaagaatacatctggcatcaaaatcaatgcaacaaagtcgatgatagggcactgtctgggtgcagcaggcggtttagaagccattgccactgtgaaagccattaccacgggatggctgcatccctccataaaccaatttaatccagagccatcagttgagtttgacactgttgccaacaaaaagcagcagcacgaggttaatgttgcaatctcaaattcatttggatttggaggacacaactcggttgtggcattttcagccttcaagccatgaaagtctgttacttacatgttctgcatttgttaggaaagatgatgatagagaatattgatccttaaaagagcgagtcaggcatttgtttgtggatgtggaggctgcttcaatccttgtgtaacttttcgtgagagccaatttgtgattttgtcattgttggaatgattttgagttgaattctagctttagcctaggaattggtgaactcgtatattttcaacaccaacacgactatatttgatgaggcaattaatgaaggagagattttgttctgttttaaatacgtatcatgtgaactgggttgctcttcattactactttgattggatttataaactattgggtaaattcccgcct

SEQ ID NO: 779 - DNA, 2006 bp, Mimulus guttatus
gaaagaacacacacagtcacactctcccctaaacacaatcccgagtcatctcagcacaaccacatcgttgtcatcgaaaactccgattcaccaccaccagccaccatgcaagctctgaaccccaccaccttccgcccctctcccctcgagcccctccgcaagccgcaaatctccaccgggaacaatgccaaaacccccgctaagaggctccccttcaaggtctccgcatccgccgtcacggcggcgccgcccaagcgcgagacggacccgaagaaacgcgtcgtgatcaccggcatgggcctggtctcggttttcggcaacgatgtggacgcctactacgagaagctgctgagtggtgtgagcggcatcacccccattgacagattcgatgtgtccaagttccccacgcgcttcggtggccagattcgtgggttcaaatctgagggttacattgatggcaaaaatgaccggagattggatgattgcttgaggtactgcattgttgccggcaaaaaagcgatcgaggatgcagatctcggcggcgacaagcttaatacgattgacaagacccgagctggtgttctggtcggtacaggaatgggcggtctaacggttttctccgacggtgttcaggctctaatagagaaaggccacagaaaaataactccgtttttcataccttatgctataacaaacatggggtccgccttgcttgcgattgatctcggattaatgggccccaactattcgatttcaaccgcttgtgctacctcaaactattgtttctatgctgctgccaatcatatccgtagaggtgaagctgatcttatggttgccggtggaactgaagccgccattattccgattggtttgggtggttttgttgcgtgcagagctttgtctcaaagaaacgacgacccacaaactgcttctaggccatgggacaaagagagagatggttttgttatgggtgaaggtgctggagtcttggtgatggaaagtttggaacatgcaatgaagcgaggggcaccgataattgcagagtatttgggaggtgctataaattgcgatgcttatcatatgacagatccgagagctgatgggcttggtgtttcttcgtgtatccatgctgcacttgaagatgctggtgtttcgcccgaggaggtgaactacataaatgcccatgcaacttccaccatagtaggtgacttagcagagctaaatgctattaagaaggtattcaagagcccgaaagagatcaaaataaacgcaactaagtcaatgatagggcactgtcttggtgcggctggtggtttagaagccattgcaacggtgaaagcaatcacaacgggctggcttcatcctaccattaatcaattcaatccagagccctctgtggagtttgacaccgttgcaaacacaaaacagcagcatgaaatcaacgttggcatctcaaattcctttggatttggcggtcacaactctgttgtcgcgttttctgcattcaagccttgatcatgttcgtaacgagtggtttatagcaagagcaatcttgctaattagagtgcttaaagaagcagatctttattagtgttttttccttttctttttttaatatcattgacttcttaagcattttcgatatcgagttaagttgtttagagtgttaaattttgagtaagcttttagtacattttattcgaactactgctgcttgttttggagtgcgcgaaagcgtacgtttttgcttcattcttgctcgcagcagttttactagtattcgagtatgtagtttcggcttcatacccgtttattgtttttttttttttttttttttttggcttataatttgttgttggttgtttcaaaaaataggttcgtactttcactttctgtaaaataaagttgtttttacttttatttctcccaaacttagttttatttttatttatcagtcattagtttcacaaaaacaataatatctattaattttctttatttctaaa

SEQ ID NO: 780 - DNA, 1796 bp, Solanum phureja
tagctttaagcctttcccctgcatccacattgttgtcatcgaaactccactaactacatctttccttctccggcggtaaccatgcaagctatccaatcttcatctctccggccatctccggtcgacccatttctcaaaaccataccccaattcaccaatgtaaagccattgagacccaaaagaaccccttttatctcagcttcatccactacagtttcagctccgacaagggaaaaagaccccaaaaagcgtgttgttataactgggatgggtcttgtttctgtgtttgggaatgatgttgatgcttattatgataagttattagctggtgaaagtggggttactctaattgatcgatttgatgcttcgaaatttcctactagatttggtggacaaattagaggctttaaagctgatggttatattgatggtaagaatgatagaaggcttgatgattgtctcaggtattgcattgttgctgggaaaaaagcactggaaaatgcggatcttggtatcgacagagataaaaagattgataaggagcgagctggtgttttggtagggacaggaatgggtggtcttacagttttttcagatggcgtccaagccttaatcgaaaagggtcacaggaaaattactccatttttcataccatatgccataacaaatatgggttcggccttgcttgcaattgatgttggtttcatgggaccgaactactcgatttcaactgcttgtgctacctccaactattgtttctatgctgctgcaaatcacatccgtcgaggtgaagctgatttgatgatagctggtggaactgaagctgccataattcctattgggttgggaggttttgtggcatgcagagctttgtctcaaagaaatgatgatcctcaaactgcttctagaccgtgggacaaagatagagacggctttgttatgggagagggagctggagtgttggtgatggaaagtttggagcatgcaatgaaacgaggagcaccaataattgcagaatatttgggtggtgcagtaaattgtgatgcacatcacatgactgaccctagagctgatggacttggtgtttcttcatgtatccttagtagccttgaagatgctggagtgtcaccagaagaggttaattacataaatgctcatgcaacttccacaatagttggtgatctagctgaggtaaatgctattaagaaggtattcaagaacacttcagagatcaaaatgaatgcaaccaagtccatgataggccactgcctgggtgctgctggtggcctggaagccattgcaacagttaaagccattaaaactggctggctgcatccttccataaaccaattcaatactgagccttcagttgagtttgataccgttccaaacaagaaacagcagcacgagatcaatgttgcaatctcaaattcatttggttttggtggtcacaactctgttgtcgtgttttctgacttcaagccctaagtcagcttagtatagcaagagcaaccttctgcttctgaggcttaatttagtgtggtatagagaggctgcttcatctcaacatagcaattgcgaattttggttgtttttgttctttgcaacgacaatcttaactttttctggtatttttccacctttagataattggatgttttcaggcttggttaggcagcaaccagttttgaaatatgtaaaagatagaaaatacactatggtattttgaggttgagagcattgttaacactttgattatttgatcttccagatctcaatagttattcttggttgtt

SEQ ID NO: 781 - DNA, 1580 bp, Echinacea purpurea
ctccttccccaccaatgtcaaacccacacgcagacccaccgtcgtaatgtccgccgccgcccctaagcgcgaaaaagaccccaaaaaacgggtcgtcattacgggtatgggtctcgtatccgtattcggaaatgatgttgatacgtactatgagaaattgttggcaggggagagtgggatcgggttgattgatagattcgatgcgtccaagtttccgacccgatttggtgggcagattcgtgggtttagttctgatgggtatattgatgggaagaatgaccgcagacttgatgattgtttgcgttattgcattgttgctggtaaaaaggcccttgaagatgctcatcttggtggtgataatcgctcaaagattgataaggagcgtgcgggtgtgcttgttggaacaggaatgggaggtctaacagttttttctgatggagttaagtctctaatagaaaaaggttacagaaagatcacacctttcttcattccttatgcaataacaaacatggcatctgcactattagctattgatttgggctttatgggcccaaactactcgatttcaaccgcttgtgctacctcaaactactgcttccatgctgctgcaaatcatatccgtagaggtgaagctgatatgatggttgctggtggtacggaagccgctattattccaattggattgggaggttttgttgcgtgtagagcgttgtctcagagaaatgatgatccacaaactgcttcaaggccttgggaccaagatagagatgggttcgtgatgggtgaaggtgctggtgttttggtgatggagagcttggaacatgcaatgaaaagagatgcacccatacttgctgaatacttgggtggtgctattaattgtgatgcttatcatatgactgacccgcgttcagatggactcggtgtttcttcttgtattcaaagcagtctagtggatgctggtgtgtcagcagaggaggttaactacatcaatgcacacgcgacttcaacattggttggtgatctagctgaagtaaatgcgataaagaaggtgttcaagaacactgcaggaatcaaaatgaatgcaaccaagtctatgatagggcactgcttaggtgcagctggaggtctggaagccatcgctaccgtaaaagccattcaaacaggatggctacatccctccataaatcaatttaacccggagcctgcagttgaattcgacacagttgctaatgtaaagcagcagcatgaaatcaacgttgcgatttcaaattcatttggttttggtggacacaactctgttgtagcattctctgctttcaagccttgattcatgggcatattttgggcttataaagctgttgttttaatgtttgttggccaatttagacatgttagaagtgagtagagttcattttgtgatttagaggatagaaatgggtccaaaatcttgctatcattttcatatattttgtttaatcacatatttcttttctttttctccgcgtgtacaacaaagagattaattcagaacactatatattgtgaaaacaagcataacaaacacaagtcattcattttcc

SEQ ID NO: 782 - DNA, 2095 bp, Citrus clementina
cgtggattacgtaatatatcgtatgtgctacagtccacaggagctcaccatttgctcaaccaccagcagccaaccccagcttagcacggaggctgtggcttctgctttcaagcgtttcatttttaattcaatttcccactcactagttaacaacagctaacaggactctcatcgtttgcatcgcccaccttcttcttcattcattcattgttggctcactgaggcataacctcaaacagaaaacatgcaatctcttcaatcctcttctctccacgcatctccactaaatccacttcgcagcaaatccaacttcaatctccccaacaatgcgagacccaccgcaaggagagtctccttcatcactgcttcttcaaccaaatccgctcccaagcgggagaaggaccccaagaagcgcgtggtgatcacgggaatgggcttggtctccgtgtttggcaatgatgtcgatgcgtattataacaagttgttggatggtgaaagtggaatcactatgattgaccggttcgatgctagtaagttcccgacccggttcggcggccagatccggggatttagtgccgagggttatattgatggcaagaatgatcgcagacttgatgattgtttgaggtacagcattgttgctggcaagaaggctctcgaagatgcggatcttggtgccgatatttctaagaagattgataaggaacgggctggggttcttgtgggaacaggaatgggtggtcttacagtcttttctgatggagtccaggctctaatagaaaaaggtcatagaaaaataaccccgttcttcattccgtatgctataacaaacatgggttctgctttgcttgcaattgaccttggcttcatgggtccaaattattcaatttcaactgcctgtgcgacctccaattattgcttttatgctgccgccaatcacatccgtcgaggagaggctgatttgatgcttgctggtggaactgaagcagccattattcctattggattgggtggttttgttgcatgtagagcattgtctcagagaaatgatgacccacaaactgcttctaggccatgggacaaagatcgggatggctttgtcatgggagaaggtgctggagtattggtgatggagagcttggaacatgcaatgaaacgaggtgcaccgatcatagcagagtacttagggggtgctgttaattgtgatgcttatcatatgactgaccccagagctgatggacttggagtgtcttcatgcattgagagcagccttgaagatgctggtgtgtcgcctgaggaggtcaactacataaatgctcacgcaacttccactttagctggtgacctggctgagataaatgctattaaaaaggtgttcaagagcaccgcagggatcaaaatcaatgccacgaagtctatgatagggcactgccttggtgcagctgggggtttggaagcaattgccactgtcaaggcaataaccacgggatggctgcatccttccattaatcaatttaaccctgaaccttcagttgagttcgacactgtcgccaacaaaaaacagcagcatgaagtgaatgttgccatctctaattcatttggatttggagggcacaactctgtcgttgcattttctgcattcaaaccatgaatcattcagcctgctcataagtcaagaagatctggacattaattggtcaaggagccgcatcatcctgtctattgagttgctgcatatttattttgaggcatttgtaactgtcatgtaataattgtaagttggattttagttcaggataatgagccattttctcctttcaaccattggatttatgcggctagttgagagggcatgaaattttgtcagatttttaattatgctgtggacagaagaatgagctgccgaggtctagcattaatatcactcgtggctctgttcttcattgtttgttatgtaggattttcaggtcttacaaagctgatgggctatggtttatttaaggagtaatgatacagccacaaactcttgtacaaacttattttgtacaaactgatgtggcatgataagattggttgaattaaatattacttggcc

SEQ ID NO: 783 - DNA, 1893 bp, Medicago truncatula
cctcatcacaccatttagcttcgttctctccgtcatttcaacaaacacaatgcaatcacttcagcatcaactacccttcactcttcgcccttcaccactcgaaccacttcgcaaaaaaccctccaatgcggccaccaccgccgccagaaccccaaagagactctccgtcgtctcttcctccgtcaccaccgccgctcctcaaagagagaaggatcccaagaagcgtgtcgtgatcactggcatgggtggcgtcactgtacatggcaacgatgtcgacattttctacgaaaagcttctcgccggtgatagtgggatcacattgattgataggtttgatgcttccaaattccctactcggttcgctggtcagatccgtgggtttagctccgagggttacatcgacgggaagaatgaccggaggcaggatgattgtctccggtactgcaatgtcgccgggaagaaagcacttgaagatgctggtctcggtgccgaaaatcttgataagattgataaagaacgtgctggtgttttggttgggtcaggaatgggtggtttaacggtgttttctgatggagttaagaatctgattgaaaagggacatagaaagatatcacctttttttattccctatgctattaccaatatggcttcagctttacttgggattgatttaggtttcagaggtccaaattattctatttcaactgcttgtgctacttcaaattattgctttgttgctgctgccaatcacattcgtaggggtgaagctgatttgatgattgcgggtggtactgaagctgctattattcctattggtttggggggttttgttgcttgcagggcactttctcagagaaatgatgaccctaaaacggcttctaggccttgggataaagaccgtgatggatttgttatgggtgaaggtgctggagttttggtgatggaaagcctggaacatgccatgaagcgaggtgcgcctatcattgctgaatacttgggaggtgctgtaaactgtgatgcttatcatatgactgatccaagatctgatgggcttggcgtgtcttcatgcatccagagcagtcttgtagatgccggtgtgtcacccgaggaggtcaattacataaatgcacatgcaacttccactcttgttggtgacttggcagagatcaatgctatcaaaaaggttttcaagaacccatctggcatcaaaattaatgccaccaagtctatgatagggcactgccttggcgcagctgggggtttggaagctattgccacaataaaagccataacaacaggatggctgcatccatcaatcaatcaattcaatccagaacctgcagttgattttgatacggtggcaaatgtcaagcagcagcatgaaatcaatgttggcatttcaaattcatttggatttggtggacacaactctgtcgtggctttttccgctttcagaccctgattgccaagcttgcctgctcttcttcatgtagaacaactacaacccatgtcatagagattcgacaacgttttacgttggctattgaggcctaacacaagcctcttctttcatttgggcttggaaccggctatgcatagcaaggctcttcatgtagaacatggaatctaaattaattaaaattttgttctctgtgcatcgttgagtctatttattgagtccatccataatatttaaaagctgtagtcctgtaattgttcattttatgctaattttgaacagatagttagctccaaagattgttttgctgtagaactttttaaatgtagcacggagatttcattgtttggtagggagacttgcggatagaaaatgccaaaagagcttatttgagcattcttccttattgttaagtaaagatatttaataacaag

SEQ ID NO: 784 - DNA, 1837 bp, Orobanche aegyptiaca
tctccactccaatacaatttcttttctcccacccatcacaaaacatctctacatcgtgttcatcgaaaaactccggctcaccctccgccaccatgcaagcccttcaatcctccgccctcctccactctcctctcgaccccctccgccgatcgacccactcggccgctttgcccagcaacaatgccaaaccaccggctaagaggcttcccttcacgatctccgcatccgcctcaaccgtttcggcccccaagcgcgagaccgacccgaagaagcgggtcgtcataaccggcatgggactcgtatccgtatttggaaatgacgtggacgcttactacgagaagcttctcgccggtgagagcggcatcgctcccatagaccggttcgatgcgtcgaaattccccacgcggttcggcggtcagatcaggggattcaaatctgagggttacatcgatggtaaaaatgatcggagattagacgattgtttgagatactgccttgtcgcagggaaaaaggccctcgagggtgcggatctcgggggcgatagactgaacaagattgacaaaattcgaggtggtgttctggttggaacaggaatgggtggtcttacagtattttcagacggtgtccaggctttaatcgagaagggtcacaggaaaattactccattcttcataccttatgctataacaaacatgggatcagccttgctcgcgattgatcttggcttgatgggtccaaattactcgatttcaactgcttgtgcaacctcgaattattgcttctatgcggctgcgaatcacattcgtcggggtgaagctgatttgatgcttgctggtggaaccgaagccgccattataccaattggattgggaggttttgttgcatgcagagctctgtctcaaagaaatgatgacccaaaaactgcttctagaccttgggacaaggatcgagatggctttgttatgggtgaaggtgctggagttttggttatggagagtctggagcatgcaatgaagcgaggtgcgccaataatcgcagagtatttgggaggtgcagtaaattgtgatgcttatcacatgactgatcccagagctgatggacttggtgtatcttcatgtatcaagagtgcccttgaagatgccggtgtttcccctgaggaggttaactacattaatgcccatgcaacttccaccatagtgggtgacttggccgagttaaatgctattaagaaggttttcaaaaatacttccgggataaaaatcaacgcgactaagtcaatgataggacactgcctcggtgctgctggtggtttggaagctattgcgacagtgaaagccattagaacaggctggcttcatcccacaataaatcaatttaacccggagccttctgttgggtttgacaccgttgcaaacgaaaagcagcagcatgaagtcgatgttgccatttcgaattcgtttggattcggtggacacaactctgtcgtagcattttctgcattcaagccctgatcccgtttgaaatctgttgcccgttgcgagaatgatctttgcttgtttcggagaatatttcatttctctctcattgtactagttgttcctttgttggtattttcagacaagccatatattcatttgttagtgtaataatctcaagtctagcttttattttgagaactgttgtctgcggctgctttaggcataaaatgcattagttttgctccatttttctttgttccagtcggattttagtagtcttttggcctctgttcagtgttccaattatatttagcattcaatcatagttaaaaatgatagggaatcataagcatcacttt

SEQ ID NO: 785 - DNA, 1891 bp, Populus trichocarpa
aattagcaagcaaatttgcaactcccctcattcactccttccccgctacgaacaaacaccatcgttatcatcgctctctcaaaaactccacacacagccatgcaagccttgcaatccactcctctgcgttcttctcccttaaacccacttcacaaaaaaccccacaatgcaactaaatccccaactcaaagactctcatttatcaaagcatcctcctcttcatcaactagtaattccaccgtttcggctcctaaacgagagaaagaccctaagaagaggattgttataaccggaatgggattggtctctgtctttggtaatgaagtcgatgcttattatgataaattgcttgcaggtgaaagtgggattgggaccattgaccgctttgatgcttctaagtttccaacccggttcggtgggcagatccgggggtttagtgcacaaggttatattgatggaaagaatgataggaggcttgatgattgtttgaggtattgcattgtcgctggcaagaaggctctcgaagatgcggatcttggaggggataatctatctaagattgacaaggagaaagctggggtgcttgttggtacaggaatgggtggtcttacagtcttttctgatggtgttcaatctttaattgagaaggggcacagaaaaattaccccattttttattccttatgctataacaaacatgggttctgccttgcttgcaattgaacttggtttcatgggtccaaattactcgatttcaactgcttgtgctacttctaactattgcttctatgctgctgccaatcacattcgccgaggtgaggcagatatgatgattgctggtggaacagaagctgctatcatccctattggtttgggaggttttgttgcatgcagggccttatcacaaagaaatgatgatccaaaaaccgcatctagaccatgggacaaggatcgagatggttttgttatgggtgaaggtgcaggagtgttggtaatggagagcttggaacatgcaatgagacgaggtgcaccaatcattgctgagtacttgggaggtgctgttaactgtgatgcttatcacatgactgatccaagagctgatggtcttggggtatcttcatgcattgagagaagtcttgaagatgccggtgtgtcgcctgaggaggttaactacataaatgcacatgcaacttccactattgctggtgaccttgctgagataaatgctataaagaaggtattcaagaacacttcagggatcaaaatcaatgcaacgaagtctatgattggacattgccttggtgctgctggaggtttggaagcaattgcttctgtgaaggccataacaacgggatggttgcatcctagcattaaccaatttaatccagagccctcagttgagtttgatactgttgccaacaaaaagcaacaacatgaagtgaatgtggctatttcgaattcttttggatttggtggacacaactctgtcgtggtcttttctgcattcaagccttgagcatctggcctctgtacatttctttccatgcattcaagccccgagcatacagcttgtctgcatttctcggaggggatcagtcttgcttagttgagatatgctcaagtgtctagtcaaagaggcttctccatcatttaattcgagcattccaggcgattgtagttgtgttgtaataattttgagttgaacaacagctttaaggtttatggatcgttgatcttatatgattaattttcgtttttcttttccttttccgttgttggaacttttataatttatctttattataaaaactaagcgagtctggacccgagtctaggtgcaactggacaaggcctaagtgtgcctgggctcatcttcaacccctggttccctt

SEQ ID NO: 786 - DNA, 2159 bp, Prunus mume
ggcttttttgtcaacagatcatttaaaaggggagaagaaagaaaaagaaaaaaggaattttgtatttaaaattgtgcaaatcaagggtcaaatatctttgttgaagacttgaagctgcagcagctattcatttcccacccacagtgacgtggccccgaggcagctgaaaccaaaacgcccacttcacacacaccgcacttcacccccaaactctcctcattcctacaaataaaaaccaatccaacaacacaacgcacagcacgcaagcccgatatcactctctctctctctctctcactaacatcgttggcgtcgtcacctctctctctcctcccattatctcagtcaattagtcgagcaccatgcaggccctccaatcctcttccctcagacccgctccgctggacccgattcggaaacggaccccccattttcccattgtcagtcccagacccaccagctccaggcgcgtttcattcatctccgcctcctcggccccggccgtgtccgccccgaagcgcgagaaggaccccaagaagcgggtagtcatcaccggcatgggcctcgtgtccgtcttcggcaacgacgtcaatgcttactacgacaagctactcgccggagagagtggcgtgggtcccatcgaccggttcgatgcgtctaagttcccgacccggttcgggggccagatccatgggttctcgtcagaggggtacattgatggcaagaacgatcgacgactggacgattgccttcggtactccattgttgctgggaagaaagctctagaggatgctgatcttggtggcgataagcgctcaacgcttgataaatcacgggctggggtgcttgttggatcaggaatgggtggtcttactgtcttttctgatggtgtccatgcactgatagagaaaggtcacagaaaaataaccccatttttcattccttatgctattacaaacatggggtctgcgttgcttggtattgatctgggttttatgggaccaaattattcgatttcgactgcttgtgctacttcaaattactgtttctacgctgctgcgaatcacattcgtcgaggtgaggctgatttgatgattgctggcggaaccgaagctgccttaattcctgttggtcttggaggttttgttgcgtgcagggccttatctcagagaaatgatgatccaaaaactgcttcaaggccatgggacaaagatagagatggatttgttatgggtgaaggtgccggagtattggtaatggagagcttggaacatgcaacaaaacgaggtgcacaaattattgctgagtacttgggaggggctataaactgtgatgcttatcatatgactgatccaagagctgatgggcttggtgtatctacatgcatagagagaagccttgaagatgctggtgtgtcaccggaggaggttaactacatcaatgcgcatgccacttccactcttgccggtgacttggccgagataaatgctataaagaaggtgttcaagaacactagagatattaaaatcaatgcaactaagtctatgatagggcactgtcttggtgcttctgggggtttggaagctattgctacagttaaagccataacaacgggatggctgcatccttccataaatcaatttaatccagagccttcagtggagtttgacactgttgccaatgtaaagaagcagcatgaagtaaatgttgccatatcaaactcatttggatttggtggacataactctgtcgtcgccttttctgcattcaagccctgatcatcccagcttgtgttcaagttttgtactacatcaaatgttgcttagaggagatcttaaattgtttctgaggcagagcttcatccttttacttttgaggccaattgtagttttgtaataattcaaagttactctctattttaaagacgcaagtcagttttagttacaaggttccgtgagtctagtaggataatgtttttttcgtttcacttttgaatgatgtggtggttagtgtgaaattgttgtatgtaatggaaggctattttgatacattctttgaatactgagtctggcaagccatttggcaaaaccatcatggtaagtaattcatcaatttcaaatggtgtagctgttcaagaggtacctgttataaagtgtgac

SEQ ID NO: 787 - DNA, 1878 bp, Phalaenopsis aphrodite
attattcggcagtggccgattcggactcgacagttctccctcggtttcgccgccgcctacatcgtccatatcgccaaatcgttccgtaaaatcttcttctcggcctctttcatcttgtctgtcaggagggtttcttcgcctctacaaaatgcatagccttctctcccctctggccctccaaatcccagcatcggaggggctccgcagctgcccgtccatccctacgattgctcatcggcgatgcagatatgggaggttcgcggtgcggtcgtcaagggtgagggccgccgtggcttctgttccggcggcggctccccggagggagacggatccgaagaagagggttgtgatcacggggatgggacttgtctcggtgttcggaaatgacgtggacaagtactatgagcgtctgctcgagggggaaagcgggatcggacagatagatcggttcgacgcctcggtgttcccgacgaaattcgccggccagattaggaatttctcgtcggagggctacatcgacgggaagaacgaccgcaggctcgatgattgcatgagatattgtctcgtgagtgggaagaaggcactagaaaacgctgatctgcctcctggaagcgccgctctcaaaaagattgacaaagtgcgagctggtgttctagtgggaacaggcatgggtgggcttactgtgttttctgatggtgttcaagctctgattgacaaaggctatagaaaaataacgcccttctttattccctatgccataaccaacatgagttctgctttgcttgccatggacatcggtttcatgggtgcaaattattcaatttctaccgcttgtgctacttccaattattgcttctacgctgctgcgaaccatattcgtcgaggagatgctgatgtaatgatagctggaggaactgaagctgcgatcattcccatcggtcttggtggttttgttgcttgtagagctctatctcaaaggaatgatgaaccccgtactgcatcaaggccatgggacaaaggtcgtgatggatttgttatgggtgaaggctctggcgtactggtcttggagagtcttgaacatgcaatgaaacgtgatgcgccaattattgcagagtatttgggaggtgctgtcaactgtgatgcttatcacatgactgatcccagagctgatggtcttggcgtctctacttgtatacagaaaagtcttgaagatgctggtgttgcaccagaagaggttaattatattaatgctcatgctacatctacacctgctggtgaccttgctgaggtgaatgccataaaaaaggtgttcaagaacccaaaggatatcaagatgaatgcaactaagtccatgataggccattgccttggtgcttctgggggtttggaagccattgcttgtgcaaaggctattactactgggtggctgcaccctaccataaaccaatttgatcccgagcctgctgtcgactttgatacagtggctaataagaagcagcaacatgaggtcaatgttgctatttctaattcctttggatttggaggacacaactctgtggtggtctttgcgccatttaagccatgaggtgatttcaattccatttattcttcttctccaactcaattttccagttccagttgagcttaattccatgtttgagggaatctgatggctttctcattaatttatctctccaagttcgattctgcttctagttaaattctttgataagaaccattttttttaggaatcggacgtttaatattgaattttatatttaattcatgtgatatctttggcataattttgttttacatgatctttgaaagggacttttgtaacagatcatcttccttgttgtattcctcattaaaaac

SEQ ID NO: 788 - DNA, 1729 bp, Trifolium pratense
gccgccaccgccgccaaaaccaaatcctctaaaagattcacccgtgtctccgcctcagtcaccaccactgctcctcaaagacagaaggatcctaagaaacgtgttgtgattaccggaatgggtcttgcttctgtatttggtaacgatgttgatggttactatgagaagcttcttgctggtgagagtgggatcacatcaattgatagatttgatgcttcaaaatttcccactcggtttgctggtccgatccgtgggtttagctctgagggttacatagatgggaaaaatgaccggagacttgatgattgtctccggtactgcattgtcgccgggaagaaagcacttgaacatgctaacctcggcggtgaaaatctctctaagattgataaggagcgtgctggtgttttggttgggtctggaatgggtggtttaacagtgttttctgagggagttaagaatttgattgagaaaggacatagaaagataacaccattttttattccttatgcaattacgaatatgggttcggcattgcttgggattgatttgggtttcatgggtccaaattattcgatttcaactgcttgtgctacttcgaattattgtttttatgctgctgccaatcacattcgtaggggggaggcggatttgatgatagcaggtgggactgaagctgctattattcctattggtttggggtgttttgttgcttgcagggcactttctcagagaaatgatgaccctagaactgcttcgaggccttgggacaaagaccgtgatggttttgttatgggtgaaggttctggtgttctggtgttggaaagcttggaacatgctatgaaacgaggtgcacctatcattgctgaatacttgggaggtgctgttaactgtgatgcctatcacatgactgatccaagatctgatggacttggtgtgtctacatgcatccagagcagccttgtagatgccggtgtgtcacctgaggaggtcaactacataaatgcacatgcaacttccactcttgctggtgacttggcagagattaatgctatcaaaaaggttttcaagaacacttctggcatcaaaattaatgccaccaagtctatgatagggcactgccttggtgcagctgggggtttggaagctattgccacagtgaaagccataacaacaggatgggtgcatccatcaatcaatcaattcaatccagaacctgcagttgattttgatacagtgccaaatgtcaagcagcagcatgaaattaacgttggcatttcaaattcttttggatttggtggacacaactctgtcgtagccttttccgcattcaggccctgatttccaagcttgtcttaaggcaccgatttccaagcttttctccacttcatgtagaacatggaatctaaattaattgaaattttgttctctctacatcattgaggctatttattttatgagttcttaatatataaaagctgtagtcctgtaattgttaatttatgctaattgttaacagacagttagcttgaagactatttgctgtaaaactttttaaatgtagcgggaaggtttcattggttcggagttatacagcggatagaaagtgttgaaagagcttatttaaacattcttccttgttaagtaaagatatttattagcatgtattcatcacacttcttgttattgaatctttattggttatatttgaatcagttcatagcctttttgg

SEQ ID NO: 789 - DNA, 1662 bp, Ambrosia trifida
gtacacaatcacaatcaccatctagaagcacaaacaaacacatagtttatatcgactgtccacactcacacactacaccttaaaccacactccattccacccacaacccaccatcttcaccaccacaatgcaagctcaagctctcctccattcaacccatctcgggttctccaaacccaacccattccaaacccgacccaccaccaccacaaccaaaatcaacccaccaactcgcagaccaccatcgtcatgtcagcaacagcccccaaacgagaaaaagatccgaaaaaacgggtcgtgataacgggtatgggtctggtatccgtgtttgggaatgacgtggatacttattatgagaagttgttgtcaggagagagtgggattggtttgattgatagatttgatgcgtcgaagtttcctactcgatttggtgggcagattcgtgggtttaagtcagatgggtatattgatgggaagaatgatcggaggcttgatgattgtttgaggtattgtattgttgctggtaagaaagctttggaagatgctgatcttggtggtgataaactatctaagattgataaggagcgtgccggtgtgcttgttgggacaggaatgggaggtcttactgtgttctctgatggagtccagaatttaatcgaaaagggttatagaaaaatcacaccttttttcattccttacgccataacaaacatgggttctgctttgcttgctattgatcttggattcatgggtccaaattactcgatttcaactgcatgtgctacttcaaattactgcttttatgccgctgcaaatcatatccggagaggggaagctgatatgatgattgctggcggcactgaagctgccattattcctattgggttgggcggttttgtcgcgtgtagggctctctctcagagaaatgatgacccacaaacggcttctagaccatgggacaaagatagagacggttttgtcatgggtgaaggtgctggtgtgttggtgatggagagcttagagcatgcaatgaaaaggggtgcgccaataattgccgaatacttgggcggggcagtaaattgtgatgcttatcatatgactgatccacgatccgacggtcttggtgtttcttcttgtcattcaaagcagccttgaagatgctggcgtgtcaccagaggaggttaactacataaatgcacacgcaacttcaacgttggttggtgatctggcggaggtaaatgctgtaaagaaggtgttcaaaagcactgacgggataaagatgaattcaaccaagtctatgattggacactgcctaggtgcagccggaggtctggaagccattgctacggtcaaagccattcaaacaggatggttgcatcccaccataaatcaatttaacccagagcccgcagttgaattcgacactgtcgccaatcaaaagcaacaacacgaaatcaacgttgccatttcaaattcatttggttttggtggacacaactccgttgtagcgttctctgcattcaaaccttgatatgatctcgtccaagtcatttttgaggcttcgtcagtgcgtctagacagtgtgttcttgttctttattgtattgttttaatgtgattctggtttaaaagcatctgacaacatatgcataccgatttaggc

SEQ ID NO: 790 - DNA, 1717 bp, Flaveria ramosissima
aaacaaaccaccaccaccactcaccatgcaagactccaacgactcccctcccaactccaaacccacccttcgccacctcccaactcgacccctccgccgccacaaccaccgccaatttccgaccaatgtcaaaccccacgcagacccaccgtcgtaatgtccgccgccgcccccaaacgcgaaaaagaccccaagaaacgggtcgttatcacgggtatgggtcttgtatccgtattcgggaacgatgttgacacttactatgagaagttgttagccggggagagtgggatcgggttgattgatagattcgatgcgtctaagtttccgacccgatttgggggtcagattcgtgggtttaaatctgatgggtatattgatgggaagaatgatcggaggcttgatgattgtttgcggtattgcattgttgcggggaagaaagctcttgaagatgctgatcttggtggggataaacgatctaagattgataaggagcgcgctggtgtgcttgttggaacaggaatgggaggtctcactgtattttctgatggagtccagaatctaatcgaaaagggttacagaaaaatcacacctttttcattccttatgccataacaaacatgggttctgctttgcttgctattgatcttggatttatgggcccaaattactcaatttcaactgcgtgtgctacttcaaattattgcttttatgctgctgcaaatcatattcgaagaggtgaagctgatatgatgattgctggtggcacggaagccgctattattcctattgggttgggtggttttgtggcgtgtagggccctctctcaaaggaatgatgacccacaaacagcttctagaccatgggacaaagatagagatggctttgtcatgggtgaaggtgctggtgtattggtgatggagagcttagaacatgcaatgaaaagggatgcaccaataattgccgaatacttgggtggggcggtaaattgtgatgcttatcatatgactgatccacgatccgacggtcttggtgtttcttcttgcattcaaagcagccttgaagatgctggtgtgtcaccagaggaggttaactacataaatgcgcacgcaacttccacattggtaggtgatctggcggaggtaaatgctgtaaagaaggtatttaaaagcactgcagggatcaaaatgaacgcaaccaagtctatgattggacactgcctaggtgcagccggaggtctagaagccattgctacagtcaaagccattcaaacaggatggctgcatcccaccataaatcaatttaatccagaacccgcagttgaatttgacaccgttgcaaatcaaaagcaacaacatgaaatcaacgttgccatttcaaattcatttggttttggtgggcacaactccgttgtggcgttctctgcattcaaaccttgatatgatcgcttgcaagtcatttttgaggcttcgtcagtttgtctaatccacttgttcttgttctttattgtatgtcattataagcacgttttgatcttatcctcgttgtttcatgtgattctggttgaagacgacctccataacatttgctattaatggtcttgtggccattgtataccgatttaggcattgaatattgagctgaaacaagattcggagactagcatttgtttacaggatttcagacagtttgtagcttttcctatgtattattcagtatg

SEQ ID NO: 791 - DNA, 1789 bp, Amaranthus tuberculatus
tgtgtgccttgcctcccacgactgaaacagagtctccttcttcacgcctcgagcgtctgtttctccgtctcaagtagcacctaaaagagaacagacctaaaagagggttgtaattacagggatgggtcttgtttctgtgtttgggaatgacccagatgttttttatgaaaagcttcttgatggggttagtgggattgcccccattgatcgttttgatgcttctaagttccctactcgatttgctggacagatccgtaattttcttctgaagggtatattgatggaaagaatgatcgtcgtcttgatgattgtcttcgttattgcattgttgctggaaagaaagctcttgaatctgctgatcttggtggtgataatctctctaagattgacaaagtgcgagcaggtgtgcttgtgggaactggtatgggtgggttaacagttttttctgatggtgttcaagcattgattgagaaaggtcacaggaaaataactccatttttcattccttacgccataactaatatggcttcggcattgcttgccattgatcttggtttaatgggacctaattattcgatatcaactgcctgtgctacttcaaactattgcttttacgctgctgccaaccatatccgtcgtggagaagctgatgtgatggttgccggtggaaccgaagctgcaattcttccgattggtctgggaggttttgttgcttgtagagctttgtcgcagaggaatgatgatcctcagacagcttctagaccgtgggacaaagaaagggatggctttgtgatgggtgaaggagctggcgttctggtaatggagagtttggagcacgcaatgaagagagatgccccaatcatagctgagtacttgggaggtgcagtaaattgtgatgcttatcacatgactgatccacgatctgatggacttggcgtttcgtcttgcattgaaagaagccttgaagatgcgggtgtgtcacctgaagaggtcaattacataaatgctcacgccacctccacgattgttggagacttggctgaggtgaatgccgtaaagaaagtctttaagagtacatccgagattaaaatgaatgcgactaagtctatgataggacattgtcttggtgctgctgggggtctggaagctattgccacagttaaagcttgtacaactgggtggttgcatcctaccataaatcagtttaatccagagccatcggttgagttcgatacagttccaaataaaaagcaacagcacgaagtgaatgttgctatttcgaattcttttggatttggtggtcacaattcggttgtagtcttctcggccttcaagccttgatcacttgcttgtgaagattttatggtcgtcaagttagcttcttcgaatttatatactttgtaagttttggacaaaattgtattcttccgattcttattaatccgtcatgcgttgtagtaggaagctggggatcgcagcgatcctaagtttccggaacgaatgatagtgagtttaagttgtagcgaagagaagtagacgaacatcatcattttccctctattatcacttgattaagtggagcaagttgtttgtggctttaatagtccattcgttgcgaaaaagatgtggtttgcagaatacttcgatcttttcaatgggttgtttggcagaatagtttgttagactattttagtttatataggtacaaataaatggttgagtgataaaatcatctaatgccagtgcttagtaaattggttaaaataactcgttatgaatcaactatttt

SEQ ID NO: 792 - DNA, 1977 bp, Castanea mollissima
cttctccaaaaccaatccaaatccaaatcccatttccatttccgcccctctcgcagcagcttccgccgccgcagcagcagcggcgcttccgtcattgtcaacgtctccgccccgaagcgcgagcacgacccgaagaagcgggtcgtgattacgggcatgggtctggtctcggttttcgggaacgaggtcgatgagtactacaacaggttgctctctggcgagagtgggatcggcccgattgatcggttcgatgcttccaagtttccgacccggttcgccggtcagatccacgggttcaactccgagggttacattgacggcaagaacgaccgccgcctcgacgattgcctccggtactgcattgtcgccggcaaaaaggccctcgtcgacgccgatctcggcggcgataagctctccaagattgataaggaacgggctggtgtgctagtgggaacagggatgggtggtcttacagtcttttcagacggtgttcaggctttaatagagaaaggtcacaggaaaataaccccttttttcattccctatgctataacaaatatggggtctgcattgctaggaattgatcttggcttcatgggtccaaattattcaatttcaacggcttgtgctacctctaattattgcttctacgctgctgcaaatcacattcgccggggtgaggctgatctgatggttgcaggtgggactgaagctgctgttattcccattggattggggggttttgttgcatgcagggccttatctcagaggaacgatgatccaaaaactgcttcaaggccatgggataaaggtagagatggatttgttatgggtgaaggtgctggagtattgataatggagagcttggagcatgcgatgaaacgaggggcacctatcattgctgagtatttaggaggtgctgttaactgtgatgcttatcatatgactgatccaagagcagatggacttggtgtgtcttcatgcattcaaagcagccttgaagatgctggtgtgtcacctgaggaggttaactacataaatgcgcatgcaacttctactcttgctggtgacctggcagagataaatgccataaaaaaggttttcaaggacacttcagggatcaaaattaatgcaactaagtcaatgattgggcattgccttggtgctgctgggggtttggaagccattgccactgtgaaagctataaatacaggatggctgcatcctagtataaatcaatttaatccagagccttcagttgactttgacacggttgcaaatacaaagcagcagcatgaagtgaatgttgctatttcgaattcatttggattcggtggacacaactctgttgtggccttttctgcattcaaaccttgatcatccagtcattttggatttcttttgggaaatgagctgtggttattcgagattttgtttaaactttgatattgcggctgcttcattttctaaatttctggagttgctgcatacttgtcaagccacatttagtttgttaatttctgtgatgatttagatttgaatttaagctcgaggatttccagacatctttactaaagaactatccgatctattgggctagtggtgtataagaatttattcaattttaatttatttagtggatagaaaagtgccaaaggcgttttccttttatatcactatctttctcagtcatttgattggaatgtagattgatacagattcataaaaatcaggctgaggggggtttagttctgctctaattctgtggattagtccagaatagcttccaagttcgaacaaggtggcacaaacacaaagtttcttatattcaaaccccaacttagggttctctctctgtggatgaatacaagaggcttatagtgctcatgaagctgtaaaatgatctgtaaacttgatggttcagctttgccttaatgtggacaagtattttgctataattatttttaattttgtctt

SEQ ID NO: 793 - DNA, 1686 bp, Cichorium intybus
agaactgataggtgtatccatccattatatacccctgttcaagtcatccttcaaatcgatccaacatcaccatctccacaaaatctcatcctttctttctctatctctacaaccatgcaagctcaagctcttcttcaatcaaccccacttcgggtatccccacttgacccgcttcagaaacactccttactcaccaatgtcaaatcgacttcattcgccacacgccgccgcgcagtgatttcggctgtcgccgccgcccccaagcgggagaaggatccgaaaaaacgcgttgtcattacgggtatgggtttggtgtcggtgttcgggaacgacgtcgatacttactatgagaagttgttggcgggggagagcggaatcggattgatagaccggttcgatgcgtccaagtttccgacgcggtttggaggtcagattcgggggtttaaggcggatgggtatattgatgggaagaatgaccggaggcttgatgattgtctacggtattgcattgttgctggtaaaaaggctcttgaagatgctgatcttggtggtgataaacgctctaagatcgataaagaacgtgcgggtgtgcttgtggggacaggaatgggcggtcttacggtgttttccgatggggtccagtctctaatagaaagaggctacagaaaaatcactccttttttcatcccatatgcaataacaaacatggggtccgccttgttggctatcgatttagggtttatggggcccaactactcaatctcaaccgcgtgtgccacctccaattactgcttccacgcggcggcaaatcatatccggcgaggggaggcggatatgatgattgctggcggcaccgaggcggcaattattccgattggattgggcggttttgtcgcgtgtagagctttgtctcaaagaaacgatgatcctcaaactgcttccaggccatgggaccaagatagagacggctttgtcatgggtgaaggtgctggtgttttggtgatggaaagcttagaacatgcaatgaaaagagacgcaccaattcttgcagaatatttgggaggtgcaataaattgtgatgcgtatcatatgaccgatccacgttcagatggactcggtgtttcttcttgtattcaaagtagtcttcaagatgctggtgtatctgcagaggaggttaattacatcaatgcacatgcaacttcaacattggttggtgatcttgctgaagtaaatgctgtaaaaaaagtattcaagaacactgacggcatcaaaatgaatgcaaccaagtcaatgataggacactgcttaggtgcagcgggcggtctggaagccattgctacggttaaagccattcagacagggtggctacatccctccataaatcaatttaacccggaacccgcagtcgaatttgacactgttgcgaatgtaaaacagcagcacgaaatcaacgttgcgatttcaaattcgttcggatttggtggacacaactctgttgtagcattctctgctttcaagccttgatatgatttgtggaaatttagggtttataaaaagactgttgttttaatgtttgtttggccaatttagacatgttagaggtgagtgatgagtacattttgagatttagaggcattagctttgcgttcaacatgtctgtattatttattaaatcacatctttctc

SEQ ID NO: 794 - DNA, 1995 bp, Petroselinum crispum
tgtaatttcacttataccaccgcacacacttgtctgtcctgtccatcctatacatacacacatacatatatatctcattttcaatcccaatccaataacatatctatctttcaccatgcaagctctacaatcatcacctctacgagtatccccacttgacccacttcgcaaagccacctccggcgccgccgcagtcacaaatgtccggccaccccacaagaaatcattcatctcggcggcaacaagcaccagttcagccccaaaaagagagacagatccaagcaaaagagtggtgattacaggaatgggattggtgtctgtgtttgggaatgatgttgatacttattatgataagcttcttgctggtgaatctggtattggcttgattgatagatttgatgcttccaagtttcctacaagatttggtggtcagattcgtgggttttcttcagaagggtatattgatggtaagaatgataggaggcttgatgattgtctcagatatgccattgttgctggtaaaaaggctcttgagaatgcagatcttggtggtgataacagattcaaggttgacaaggagcgtgctggtgtacttgttggaacagggatgggtggtcttacagtattttctgacggtgttcaggctttaatagaaagaggtcacaggaaaattaccccgtttttcattccgtatgccattacaaacatggggtctgcattgcttgcaattgatctcggcttcatgggaccaaattattcaatttctactgcttgtgctacatctaattattgtttctacgctgctgcaaatcacattcggcgaggtgaggctgatttgatgattgctggcggaactgaagctgctattatacctattgggctgggaggatttgttgcatgcagagcattgtctcagagaaacgatgatccaaaaactgcttctaggccatgggacaaagacagagatggctttgttatgggagaaggagctggtgttttggtaatggagagtttggaacatgctatgaaacgaggtgcaccaataattgccgaatatctgggaggtgctataaattgtgatgcttatcatatgaccgatccaagatctgacggacttggtgtttcttcatgcattcagagcagccttcttgatgctggagtgtcgccggaggaggttaactacataaatgcacatgcaacttccaccatagtcggtgaccttgctgaggtgaatgctgttaagaaagtattcaagaacacttcagggattaagatgaatgcaaccaagtctatgataggccactgtttgggtgctgctggaggtttggaggccatcgctgtgattaaagccattactaccgggtggttgcatcctacgattaatcaatttaactccgagccttcagtggagtttgacaccgttgctaatcataaacaacaacatgaagtaaatgttggcatctcaaactcgttcgggtttggcggacacaactcagttgtggcattctctgctttcaagccatgacttggtacaaccttcagtatatgtaccgtatgtagccatatcaattgattgttatccttagttttgtcaatttcttgcggaggctgcagacatatagttatcctttttgtatcttttctctttttgtttttctgagtcaactcttgctgttctctccgttctaaaaacagtgaggctgaataggcatgaaaaagtaattccttttttgaattatgggcccgtttggggttttttaaaaaatgtgacttataacgttaaaaagtgtataagtgttatgtacaaattatttgtgaatgacttttgcttagcccaacttttcaagttcacaaccttttgtctttccaagctttagatcttccaaacctttggcttttcatcatcctgtaacctatgattagatagcctatataaaggcttggtttgtacattgtttatacacatgaataagatgaagattatcctctccaaag

SEQ ID NO: 795 - DNA, 2226 bp, Petroselinum crispum
gaaggatttggtaaatcgctgatcacggtcccccgtatccagctctgtacattagatccccaaatacttttgtatatatacctgtcacatgttatatcactcacacttcctctgcttgttgtctttacatcccctctacatacacacaaatccacttcattttcagtcccaatccaataacacatctatctttcaccatgcaagctctacaatcatcacctctacgagtatccccacttgacccacttcgcaaagccacctccggcgccgccgcagtcacaaatgtccggccaccccacaagaaatcattcatctcggcggcaacaagcaccagttcagccccaaaaagagagacagatccaagcaaaagagtggtgattacaggaatgggattggtgtctgtgtttgggaatgatgttgatacttattatgataagcttcttgctggtgaatctggtattggcttgattgatagatttgatgcttccaagtttcctacaagatttggtggtcagattcgtgggttttcttcagaagggtatattgatggtaagaatgataggaggcttgatgattgtctcagatatgccattgttgctggtaaaaaggctcttgagaatgcagatcttggtggtgataacagattcaaggttgacaaggagcgtgctggtgtacttgttggaacagggatgggtggtcttacagtattttctgacggtgttcaggctttaatagaaagaggtcacaggaaaattaccccgtttttcattccgtatgccattacaaacatggggtctgcattgcttgcaattgatctcggcttcatgggaccaaattattcaatttctactgcttgtgctacatcaaattattgtttctatgctgctgccaatcacatccggagaggtgaggctgatttgatgattgccggtggaactgaagctgctattatacctattggactgggaggatttgttgcatgtagagcattgtctcagagaaacgatgatccaaagactgcttctaggccttgggacaaagatagagatggctttgttatgggcgaaggagctggtgttctggtaatggagagtttggaacacgccatgaaacgaggtgcaccaataattgccgagtacctgggaggtgcagttaattgtgatgcctatcatatgactgatccaagatctgatgggcttggtgtttcttcatgcattcaaaactgccttcgggatgctggagtgtcgccggaggaggttaactacataaatgcacatgcaacttccactatagttggtgaccttgctgaggtaaatgctgttaagaaagtattcaaaaacacttcagggattaaaatgaatgcaaccaagtctatgataggccactgcttgggggctgctgggggtttggaggccatcgctgtaattaaagccattactacagggtggttacatccctcaattaatcaatttaactctgagccttcagtggagttcgacaccgttgcaaatcagaaacaacaacatgcagtaaatgttggcatctcaaattcgtttggatttggcggacacaactcagttgtggcattttctgcattcaagccataaattagcacatctttcgttgtatgtagcatatgtagccatagcaattggttcttacctttagttttatcatttcttgtggaggctgcagacataggtatcctattgtatcttttatctgagtcaaggtttcttggttgttctgttttttaaaaaatgaggcagactaggcatgaaaagtcatccagttttgattattattttttgccaacttgtagttttgaattgtctaatggatagtcagaatgttctgtccttttttcacttgttctggtatgtgtcatatgatatatagttattccgtttgtactgaggaatcggtaatatgttctgaagatttgttgaaaactcgagagttgagagttttagtccagagagaagaaagaatgatgaaataaataaatttaattgagaggaaatattgggaaaacactatatgataaatagtgatattgccccgatcggccaaactaaacccagaaaaccctatttggccattctagacggactttatgagtctgaaccattgatcattctagatttacctggcctctactacggtggctgcctgggaggtggcacgtgtacctgacaagatgcaaataaataatatactacacaa

SEQ ID NO: 796 - DNA, 2223 bp, Petroselinum crispum
gaaggatttggtaaatcgctgatcacggtcccccgtatccagctctgtacattagatccccaaatacttttgtatatatacctgtcacatgttatatcactcacacttcctctgcttgttgtctttacatcccctctacatacacacaaatccacttcattttcagtcccaatccaataacacatctatctttcaccatgcaagctctacaatcatcacctctacgagtatccccacttgacccacttcgcaaagccacctccggcgccgccgcagtcacaaatgtccggccaccccacaagaaatcattcatctcggcggcaacaagcaccagttcagccccaaaaagagagacagatccaagcaaaagagtggtgattacaggaatgggattggtgtctgtgtttgggaatgatgttgatacttattatgataagcttcttgctggtgaatctggtattggcttgattgatagatttgatgcttccaagtttcctacaagatttggtggtcagattcgtgggttttcttcagaagggtatattgatggtaagaatgataggaggcttgatgattgtctcagatatgccattgttgctggtaaaaaggctcttgagaatgcagatcttggtggtgataacagattcaaggttgacaaggagcgtgctggtgtacttgttggaacagggatgggtggtctcacagtattttctgacggtgttcaggctttaatagaaagaggtcacaggaaaattaccccgtttttcattccgtatgccattacaaacatggggtctgcattgcttgcaattgatctcggcttcatgggaccaaattattcaatttctactgcttgtgctacatcaaattattgtttctatgctgctgccaatcacatccggagaggtgaggctgatttgatgattgccggtggaactgaagctgctattatacctattggactgggaggatttgttgcatgtagagcattgtctcagagaaacgatgatccaaagactgcttctaggccttgggacaaagatagagatggctttgttatgggcgaaggagctggtgttctggtaatggagagtttggaacacgccatgaaacgaggtgcaccaataattgccgagtacctgggaggtgcagttaattgtgatgcctatcatatgactgatccaagatctgatgggcttggtgtttcttcatgcattcaaaactgccttcgggatgctggagtgtcgccggaggaggttaactacataaatgcacatgcaacttccactatagttggtgaccttgctgaggtaaatgctgttaagaaagtattcaaaaacacttcagggattaaaatgaatgcaaccaagtctatgataggccactgcttgggggctgctgggggtttggaggccatcgctgtaattaaagccattactacagggtggttacatccctcaattaatcaatttaactctgagccttcagtggagtttgacaccgttgcaaatcagaaacaacaacatgcagtaaatgttggcatctcaaattcgtttggatttggcggacacaactcagttgtggcattttctgcattcaagccataaattagcacatctttcgttgtatgtagcatatgtagccatagcaattggttcttacctttagttttatcatttcttgtggaggctgcagacataggtatcctattgtatcttttatctgagtcaaggtttcttggttgttctgttttttaaaaaatgaggcagactaggcatgaaaagtcatccagttttgattattattttttgccaacttgtagttttgaattgtctaatggatagtcagaatgttctgtccttttttcacttgttctggtgatatatagttattccgtttgtactgaggaatcggtaatatgttctgaagatttgttgaaaactcgagagttgagagttttagtccagagagaagaaagaatgatgaaataaataaatttaattgagaggaaatattgggaaaacactatatgataaatagtgatattgccccgatcggccaaactaaacccagaaaaccctatttggccattctagacggactttatgagtctgaaccattgatcattctagatttacctggcctctactacggtggctgcctgggaggtggcacgtgtacctgacaagatgcaaataaataatatactacacaacagaggca

SEQ ID NO: 797 - DNA, 2122 bp, Petroselinum crispum
ggtaaatcgctgatcacggtcccccgtatccagctctgtacattagatccccaaatacttttgtatatatacctgtcacatgttatatcactcacacttcctctgcttgttgtctttacatcccctctacatacacacaaatccacttcattttcagtcccaatccaataacacatctatctttcaccatgcaagctctacaatcatcacctctacgagtatccccacttgacccacttcgcaaagccacctccggcgccgccgcagtcacaaatgtccggccaccccacaagaaatcattcatctcggcggcaacaagcaccagttcagccccaaaaagagagacagatccaagcaaaagagtggtgattacaggaatgggattggtgtctgtgtttgggaatgatgttgatacttattatgataagcttcttgctggtgaatctggtattggcttgattgatagatttgatgcttccaagtttcctacaagatttggtggtcagattcgtgggttttcttcagaagggtatattgatggtaagaatgataggaggcttgatgattgtctcagatatgccattgttgctggtaaaaaggctcttgagaatgcagatcttggtggtgataacagattcaaggttgacaaggagcgtgctggtgtacttgttggaacagggatgggtggtcttacagtattttctgacggtgttcaggctttaatagaaagaggtcacaggaaaattaccccgtttttcattccgtatgccattacaaacatggggtctgcattgcttgcaattgatctcggcttcatgggaccaaattattcaatttctactgcttgtgctacatctaattattgtttctacgctgctgcaaatcacattcggcgaggtgaggctgatttgatgattgctggcggaactgaagctgctattatacctattgggctgggaggatttgttgcatgcagagcattgtctcagagaaacgatgatccaaaaactgcttctaggccatgggacaaagacagagatggctttgttatgggagaaggagctggtgttttggtaatggagagtttggaacatgctatgaaacgaggtgcaccaataattgccgaatatctgggaggtgctataaattgtgatgcttatcatatgaccgatccaagatctgacggacttggtgtttcttcatgcattcagagcagccttcttgatgctggagtgtcgccggaggaggttaactacataaatgcacatgcaacttccaccatagtcggtgaccttgctgaggtgaatgctgttaagaaagtattcaagaacacttcagggattaagatgaatgcaaccaagtctatgataggccactgtttgggtgctgctggaggtttggaggccatcgctgtgattaaagccattactaccgggtggttgcatcctacgattaatcaatttaactccgagccttcagtggagtttgacaccgttgctaatcataaacaacaacatgaagtaaatgttggcatctcaaactcgttcgggtttggcggacacaactcagttgtggcattctctgctttcaagccatgacttggtacaaccttcagtatatgtaccgtatgtagccatatcaattgattgttatccttagttttgtcaatttcttgcggaggctgcagacatatagttatcctttttgtatcttttctctttggggggggggggggggggggggggggggggggggggggggggggggggggggatcttttctctttttgtttttctgagtcaactcttgctgttctctccgttctaaaaacagtgaggctgaataggcatgaaaaagtaattccttttttgaattatgggcccgtttggggttttttaaaaaatgtgacttataacgttaaaaagtgtataagtgttatgtacaaattatttgtgaatgacttttgcttagcccaacttttcaagttcacaaccttttgtctttccaagctttagatcttccaaacctttggcttttcatcatcctgtaacctatgattagatagcctatataaaggcttggtttgtacattgtttatacacatgaataagatgaagattat

SEQ ID NO: 798 - DNA, 2229 bp, Cannabis sativa
acataagtaaaaaggaaataaactagcatttgcctatttggtgtttggtttggctttggcggagaactccaagcaagcccccttctcctctctccctattttcttctttaaaaccccccaaaatcaccacttctctttctctctcttcttccttgttatcatcgtccccaactctctctctctctctctctcttctctctccaccatgcagtcactccaagcttccactctcagaccatctccaccactcgacccacatcgccaccgtggaacccaattcctccgcaatgccaccaccaaggcttggcccagacccaccagacccaccaaagtctctttcatctcagcatcttcgtcttctgtggctcctaagcgagagaaggacccgaagaaacgagttgtaattactggcatgggacttgtctctgtatttggtaacgatgttgatgcttattatgataagcttctttccggtgagagtgggattggtcttattgatcgttttgatgcttctaagtttcctactagatttggtggtcagatccgtggatttaattctgaagggtatattgatgggaagaatgaccgaaggcttgatgattgtcttcgttattgcattgttgctgggaagaaagctcttgaggatgctgatcttggtggtgaaaagctctccaagattgataaggaacgagcaggtgtgcttgttgggaccggtatgggtggtcttactgttttctctgatggtgtcaaggcactgatagagaaaggtcacaggaaaattacacctttttttattccttatgctattacaaacatgggatctgcattgttggcaatcgatcttggtttcatgggtccaaactattcgatttccactgcttgtgctacctcgaattattgtttttatgctgctgcgaatcacattcgccggggcgaggctgatatgatgattgctggtggaactgaggctgccattatacctattgggcttggaggctttgttgcttgtagagctctttctcagagaaatgatgatcccaaaacggcttctcgcccatgggacagggaccgtgatggctttgtcatgggcgagggcgctggagtgttggtaatggagagcttggagcacgcaatgaaacgaggtgcaccaattattgcagagtacttgggaggtgccgttaactgtgatgcttatcatatgactgacccaagagctgatgggttgggtgtgtcttcatgtatattgagtagcctagaagatgctggtgtgtcacctgaagaggttaactacatcaatgcacatgctacttctactcttgctggtgacttggctgagataaatgctatcaagaaggttttcaaggatacttcaggaatcaaaatcaatgcaactaaggcaatctctcttgctcgttcttctatgataggacactgtcttggtgctgctggaggtttggaagctatcgctaccgtgaaagccattaacagcggatggttgcatcccagtataaaccaatttaacccggagccctcggtcgattttgacaccgttgcaaacacaaagcaacaacacgaggttaatgttgccatctcaaattcattcgggttcgggggccacaactctgtggtggctttctctgccttcaagccttgatgatcaattcaagtttattggaaatttttgtagatcaatcaaccatgctcacttgagaataggttttgttaatttattgttgaggctggctttttatattgtcaatttctcaggaagtttatgcaattgataatttaatttcaagccatttgttatatttacttgtgttgtaatagtttcaagtttcaagtttcaactgtcaaattaaaaagctctatggtcccattccaagggctctttctttagcacacattttaggttgaactaccaaaacttgtggtgttattgtgactagtctagcattatgggccttttttttttatttgtggtgcatggaaattgtcattaaaagcataatgaaatggtcaaaaataaatggagaaattgtattaagaaagaactttgaggcatttcctttcaacaattgtttttagtttaaagcatagtgcaaaacttatggtgtaaaatgtaaatgtaattttatgtttttagcattttacacaaaagtgcttatccaacaatatgtgaagtatatttcatttggctcaataatatgttttattataataatgtca

SEQ ID NO: 799 - DNA, 1553 bp, Cirsium arvense
agataggtgcatccatccatacctaccattttcctcgaacacatcgattccaaatatcactcacctcaccaccatcttcacaaatctccccccattacagccagccatgcaagctcaagctcttcttcaatcaaccccacttcgtgtttccccactcgatccccttcacaaacgctctttacccatcaatgtcaattcaccttcactcgccgccacacgccgccgtgcagtaatttcagccgttgccgcccccaaacgcgagaaggatccgaagaaacgggtcgtcattacgggtatgggtttagtgtccgtattcggaaacgatgtcgatacttactatgagaagctattggccggtgagagtggaatcgggttgatagaccgattcgatgcgtcgaagtttccgacgagatttggtggtcagattcgtgggtttaaagctgacggttatatcgatgggaagaatgatcgaaggcttgatgattgccttcgttattgcattgttgctggtaagaaagctcttgaagatgccgatctaggtggtgataaacgctctaagattgataaggaacgtgccggtgtgcttgttggaacgggaatgggaggtctaacagtattttcagatggagtgcaatctctcatagagagaggttacagaaaaataacgccatttttcattccgtatgctataacaaacatgggttcagctttgcttgctattgatttgggatttatgggaccaaattactcgatttcaacggcttgtgctacctccaattactgctttcatgcagccgctaatcatatccgccgaggggaagcggatatgatgattgctggtggcacagaagccgccattattcccattggtttgggaggttttgttgcgtgtagagcattgtctcaaagaaacgatgatccacagaccgcttcgaggccgtgggaccaagatagagatgggttcgtaatgggtgaaggtgctggtgttttggtgatggagagtttggaacatgcgatgaaaagagatgcaccaatacttgctgaatatttgggaggtgcaataaattgcgatgcttatcatatgactgatccacgttcagatggactcggtgtttcttcttgtattcatagcagtttggaggatgctggtgtgtcaccagaggaggtgaactacatcaatgcacatgcaacttcaacattggttggtgatttggctgaggtaaatgctgtaaagaaggtatttaagaagactgaagggattaagatgaatgcaaccaagtctatgataggacattgcttaggtgcggctggaggtctggaagccattgctacggttaaagccattcaaacaggatggcttcatccatccataaatcaatttaacccagagcctgcgatggaattcgacactgttgcaaatgtaaagcagcaacatgaaatcaacgttgcgatttcaaattcgtttggttttgggggacacaactcagttgtagcattctctgcattcaagccttagagatgagatggtgggtggtttttgatgataatgaaga

SEQ ID NO: 800 - DNA, 1795 bp, Eschscholzia californica
ataaaaactcatctcatcctcctcctcctccaaatcacacacacacaaccaccaccaccaccatctctttctcttctttctctctctagaatttgcagacacaatgcaaactcttcaatcttcatcttctctccgagtttcaccattagaatctcttcgtaagcaatctcctcttctcaataccaacaacaatgtcatcaccaccaccaacaacaacaacagatctaagaagaagaatccatcatctcttgtgatatctgcttcatcttcaccaacaacaaataatgtaacaacatcaacacctaagagagagaaagatcctaagaaacgagttgtcattactggaatgggacttgtttctgtctttggaaatgatgttgatacttattatgaacgtcttctctctggtgaaagtggaatttctcttattgatcgttttgatgcttctaaatttcctactcgatttggtggtcagatccgtggatttgaatctcaaggttatattgatggtaaaaatgatcgtcgtcttgatgattgtcttcgttattgtcttgtagctggtaaaaaagcacttgaagatgctggacttggtggcgaaactctctctaagatcaacaaagagcgaggtggtgtccttgttgggacaggcatgggtggtcttacagtgttttcgaatggtgttgaatctcttatagagaaaggtcacaggaaaataactccctttttcattccatactccattacaaacatgggttccgctttactgggaattgaacttggtttaatgggaccaaactattcaatttccactgcatgtgctacctccaattattgcttctatgctgctgctaaccacatccgacgaggtgaggctgattttatgcttgctggtggaacggaagctgcaattattcccatcggcttaggggggtttgttgcatgtagagctttatcacaaagaaatgatgacccaaaaactgcctctaggccatgggacaaagatagagatggttttgttatgggtgaaggtgctggggttttggtaatggagagcttggagcatgcaatgaagcggaatgcaccaattattggtgagtacttgggaggagcagttaactgtgatgcttaccatatgactgatcctagagctgatggacttggtgtatcaacatgtatccagaaaagtcttgaagatgctggtgtgtcatcagaagaggttaactacataaatgcacatgcaacttccacccttgctggagatttggctgaggtgaatgctataaagaaggtgttcaaggactcttcaaacatcaaaatcaatgccaccaagtctatgattggacactgcctcggtgcagctggaggccttgaagccattgcaacaatgaaagccataactactgggtggttgcatcctactattaaccaatttaacccagagcctgctgttgaattcgatacagttgcaaacgttaagaaacagcatgaagtgaacgttgcaatttcgaattcatttggtttcggaggacacaactcagtcgtggtgttttcaggattcaagccttgatattcttgttatgattttcttgatcttccttgagttttttcatgtctggtatgctttttcttctagttggtgagactcaaagaactcaattgtcatctttccttttaggaaaacttcatgaaattgttaagaaattgtagttcatgtgattttgttcagttttgtcggtggtttatttatccaatatgcatcatcgttcgtaataatgttattcctagtaaaaaaaaa

SEQ ID NO: 801 - DNA, 1710 bp, Euphorbia peplus
catctctccgggcatcccctctaaaccctcttcatgaaaaaacccgcaatgccatcaaaaccccacccaaaagggtctcctttatcaccgcatcctcctccgctggcactacaacccctcctaaacgcgagaaagaccccaagaaacgtgtcgtcattaccggtatgggattggtttctgtgtttggtaatgatgttgatgtttactatgatactttgctgtctgggaagagtgggatcggtcccattgaccggtttgatgcatctaagtttcctacccggttcggggggcagatccgggggtttgattctcaagggtatattgatgggaagaatgataggcggcttgatgattgcttgaggtattgcattgttgctggcaagaaggctttcgaaaatgctggtcttggaggggatggttcatacaagattgataaagagcgggctggtgtgcttgttggaactgggatgggtggtcttactgtcttttcagatggtgttcaggctctaattgagagaggacataggaaaattaccccattctttattccttatgctataacgaatatggggtctgccttgcttggtattgaacttggtctcatgggtccaaattattcaatttcaactgcatgtgctacctccaattattgcttctatgctgctgcaaatcacatacgccgaggtgaggctgaaatgatgattgctggtggaactgaggctgccatcattcccattggtttgggaggttttgtagcatgtagggccttatcccagaggaatgacgatccacaaactgcttcaagaccatgggataaagatcgagatggctttgttatgggtgaaggtgcaggagtgttggtaatggagagcttggaacatgcaatgaaacgaggtgcacctattcttgccgagtacttgggaggtgctgttaactgtgatgcttatcacatgactgatccaagagctgatggacttggggtctcttcctgcattgagagaagtcttgaagatgctggtgtgtcacctgaagaggttaactacataaatgcgcatgcaacttccactcttgctggtgaccttgctgagataaatgctataaagaaagtattcaagaatacttctgaaatcaaaatcaatgcaaccaagtctatgataggacattgccttggtgccgctggagggcttgaagcaattgcttgtgttaaggccataaacacgggatggttgcatcccagtatcaaccaatttaaccctgagccttcagttgaatttgacactgtagctaacacgaaaaagcaacatgaagtcaatgttgccatttcaaattcgtttggatttggtggacacaactcggttgtggtgttctcatcattcaagccctgagaaattcacctgtgtttcctcttcagcattgaggtccagggcaggaacctttgtgcatttcttgtaggaatcagtcttgtttatgagagagttgcttatggagcatagatattgaggctgcttgttcattttaagttgagctgcaaatagtgtcattctcttccagacatttgtagtttttttaccccgaataatgttagcttaaagtccctgaatgatttcttttccttttataagttaaatttcttatacttcagttttcttggaactttagttaagtatgacctgtggcaagtgagtatgatcagttttaaattttatgtag

SEQ ID NO: 802 - DNA, 1994 bp, Cucumis melo
atctcttatacaacatcgattcttctctcccaattcctccattgttattatcgtcatccttcttctatacattcttctccctcacattccccaaatctccattcttcttccaccatgcaggccgccgttcattcctccactctcaagccctctcccttggactcatttcgccgtcgcaaatgctcccccttccttgtttctgctcctaaatcacgtccacgagtttcttttgtttctgcatctgcagcttccactgtctctgcacctaagcgggagaaagatcctaagaaacgtgtggtgattactggaatgggacttgtttctgtctttggtaatgatgttgatacttactatgataagttgctttctggtgagagtggtgttactcttattgatcgttttgatgcttccaagtttcctactcgtttcggtggccagatccggggatttgcttctcagggatacattgatggtaagaatgatcgtcggcttgatgattgtcttcgttattgtattgtagctggaaagaaggctcttgaggatgctgaccttggtggagataagcgctctaagatcgataaggagcgtgctggtgtgcttgttggaacaggaatgggtggtcttacagtcttttctgatggtgttcaggctttgatagagaaaggtcacagaaagataaccccttttttcattccttatgccattacgaatatggggtctgccttacttgccatcgatattggtttcatgggtcccaattactctatatccactgcttgtgccacctctaattattgcttctatgctgctgcaaaccacattcgtcgaggagaggctgatatgatgcttgctggtggaactgaagctgctatcatacctattggccttgggggttttgttgcttgtagggctctatctcagagaaatgatgatcctaagactgcttcgaggccatgggacaaagaccgtgatggctttgtcatgggagaaggtgctggcatactggtaatggagagtttggagcatgcaatgaaacgaggtgcaccaattattgctgaatacttgggaggggctgttaactgtgatgcttatcacatgacggatcctagagcagatggacttggtgtctcttcatgcatcttgagcagtcttgaagatgcaggtgtttcgcctgaggaggtaaattacataaatgcacatgcaacttccacccttgccggtgacatagctgaaatcaatgccatcaagaaggtgttcaagaatacatcagagatcaaaatcaatgcgactaagtctatgataggccactgccttggcgctgctggtggtctggaagccattgccactgtgaaagcaattgaaacaggatggttgcatccttccataaatcaatttaacccggagccttcagttgattttgacaccgttgcaaacgtaaagcaacaacacgaagtgaatgttgctatctcaaattcattcggatttggtggacacaactcggttgtggcattctcggcattcaaaccttgagcaggataatgttacacactacggcgttttgtaggagaatcaagtgttagccttgagaatagttagtaattttatttatcaatgaggttgctttgcttgctgcgggcgtcttatctggtcctttaaacattttggtcttttatgcaatttcatcatcaccatcaccattccatttgttgctgttttctaatccaataaatgggtttacttgaacttgtgtgagtttattgggtgaggttgatattagattcgagttcaaaattttctcaagaattccatcaaaatggttgtaatgaatgaagctttttctttcagcccgccctcccccacttccccactccattctgtgatgtctaaagagatgaactaactgttttcattttcttgacaagtcaatgttttgtctcgtattaaaacaattataagacacggttgtaaaacatgtcgacaatgtttttaaaacg

SEQ ID NO: 803 - DNA, 1875 bp, Fragaria vesca
gagattcagagagagctgcatctctgttccagtgggaactgctgcagagtgacgtggcgtggatatagcagcgcagctgaaaacaacgaggtgtctctcctcctacaaaaaccaatcccaaacctccattctctctctctcttctctccgattcaaactctcacctcgttggcgtcgccaccactcttcactactctcactctccaccaccaccaccaccatgcaagccattcaatcctccacgctccgacccgccccgctcgacccgctccgcaaacggacccacttccccaacctcactcccagacccgcccctagacgcgtctccttcatctccgcctcatccgccacaactgtctcggcccccacgcgcgagaaggaccccaagaagcgcgtggtcatcaccggcctcggctgcgtctccgtcttcggcaacgacgttaacgcctactacgacaagctcctcgccggcgagagcggcgtcggtcccatcgaccggttcgatgcgtccaagttccccacccgcttcggcggccagatccgcggcttcacctccgagggctacattgacggcaagaacgatcgccgcctcgacgattgcctccgctacgccattgtcgccggcaagaaagctctcgaagatgctgatctcggcgccgataaccgccccaagcttgataagtcgagggccggtgtgctagttggatcagggatgggtggtcttactgtgttttctgacggtgttcatgcactgatagataagggtcacaggaagattaccccgtttttcattccttatgctattacaaacatgggatccgctttgcttgggattgatctgggttttatggggccgaattactcaatctcgactgcttgtgctacttcaaattactgtttctatgctgccgcgaatcacattcgtcggggcgaggctgatttgatgattgctggtgggactgaggcggccttgattcccattgggcttggggggtttgttgcatgcagggcgttgtctcagagaaatgatgatccgaaaactgcttctaggccgtgggacaaagatagggatggctttgttatgggtgaaggtgctggaatattggtaatggagagcttggaacatgcgatgaaacgaggtgcacctattattgccgagtacttgggaggtgctattaactgtgatgcatatcatatgactgatccaagagctgatggacttggtgtatccacatgcatagagagaagccttgaagattctggtgtatcgcctgaagaggtcaactacatcaatgcacatgcaacttccacccttgcgggtgatctagctgaggttaatgctataaagaaagtgttcaagaacactaaagagattaaaatcaatgctactaagtctatgatcggtcactgcctcggtgcctctgggggtttggaagctattgctacagtgaaagccatacaaacaggatggctccatccttctataaaccaatttaatccagaaccttcagttgagtttgacactgttgcaaatgtaaagcagcagcacgaagtgaatgttgccatatcaaattcgttcggatttggaggacacaactctgtggttgcgttttctgcgttcaagccttgatcagccaagcttgtctgcaagttttgtactacatcagtcttgcttagaggagatcttaactgtatctgaggctgctttcattcttattattggtgccagttgtagcgaaataatcaagggttactctatttcaaggacagtagtcagttagataccaggttctatgtgtcattagcgggtccttatatgtctgaattgttgtattaaatggaaagccttttctgattttattgtttgaaccaata

SEQ ID NO: 804 - DNA, 1822 bp, Eutrema parvulum
atctgacgaactctaaactcttttcgcaaacacaccattttcacaacatcgtacttatcgccttcctctcgctctctctctctcccctttggatccgccatgcaatctcttcaatcctcttctctccgtgcttctccgccgaatccacttctaagaccttcgaatcgacagtcgcatcagattaccaatgcgagacccacgaggagacgttcgttcatctccgcgtcagccgctgtttccgctcctaaacgcgagacggatccgaagaaacgggttgtgattaccggtatgggtctcgtctctgtctttgggaatgacgtcgatgcttactacgagaaattgctttccggtgagagtggaattagcttgattgatcgattcgatgcgtcaaaattcccgactcgtttcggtggccagatccgtgggtttagctcagaaggttacatcgatgggaagaatgagcgtaggcttgacgattgcttgaagtactgcattgtcgctgggaagaaggctcttgagagtgcgaatcttgggggtgataagcttaacacgattgataagcagaaagctggagtactagttgggactggtatgggtggtttgactgtattttcagacggtgttcaagctctaattgagaaaggtcacaggagaatatctcccttcttcattccttatgccataacaaacatggggtctgctttattggcgatcgatcttggtcttatgggtccaaactactcaatctcaaccgcttgtgccacctctaactactgcttttacgctgctgcgaaccacattcgccgtggtgaagctgatatgatgattgctggtggaaccgaggctgccattattcctattgggttgggaggttttgttgcttgcagggcactatcacagagaaatgatgaccctcaaacggcttcaaggccatgggataaacaaagagatggcttcgtcatgggtgaaggagctggtgttttggtgatggaaagcttggaacatgcgatgaaacgtggtgctccaattgtagcagaatatcttggaggtgctgttaattgtgatgctcatcacatgactgatccaagagctgatgggcttggtgtctcttcatgcattgagagctgccttgaagatgctggtgtatcacccgaggaggtaaattacatcaacgcccatgcgacttccactcttgctggtgatcttgctgagattaatgccattaaaaaggtattcaagagcacttcagggatcaaaatcaatgccaccaagtctatgataggtcactgcctcggtgcagctggaggtcttgaagccatcgccaccgtgaaggctatcaacactggatggcttcatccctcaatcaaccaatttaacccagaaccggccgtggactttgacacggttgcaaacgagaagaagcagcatgaggtgaatgttgccatatcaaactcgtttgggttcggtggacataactcagtcgtcgccttctctgccttcaaaccctgatttcttcggaccctttagattctctgctccatctattacatcgccaccatcatccatcaccatcatcttccttgcagcttcttggttcacaagtttgagctctttctctggcgttttacgttccattcagcttttttccttattgttcattgagctgttgagatttcagattttgcttctctatcttgtgtacggagtgtttgtatcttagttcgtttcatattttcctaatttataaacaaaaccaagaatctttgtagcaattgtgttagtgtcggaataaacccaattaggggattttcatcctttcttt

SEQ ID NO: 805 - DNA, 1878 bp, Solanum lycopersicum
ttttggttgtgacttggtttctctctttctgtacaagcacaaaacacacactccctttctctctctaaaaatagtagtaatacactcgcatcgttaacatcgaaaagctttttgcttcttcttcttcttcttgttgctccgccacctcaaatctgaaaacccatttcagttaacaatggaagcaatccaatctctatcatttcgtccgtctccactcgaacctctacgaaaaaacatcccccagttcaccaatgtgaggtcattgggtgctaaaagagtgcctttaactataacagcttctgcatctactgtttctgctccaaaaagagagaaagacccaaagaaaagggtggttataactgggacgggtcttgtttctgtgtttgggaatgatgtcgatacttactatgacagacttttggctggtgaaagtgggatttcgcttattgatcgttttgatgcttctaaatttcctacgagatttgggggacaaattcgtgggtttacatctgaagggtatattgatgggaagaatgataggaggcttgatgattgtttaaggtatgccattgttgctggcaagaaagctttggaaaatgcagatcttggtggtgatagattagaaaagattgataaggagagagcaggtgttcttgtaggaacaggaatgggtggtcttacagttttctcagatggtgtacaaaacctaattgaaaagggtcacaggaaaattactccattttttgtaccatatgccattacaaacatgggttctgctttgcttggtattgatcttggttttatgggaccaaactactcaatctcaactgcttgtgctacctccaattactgtttttatgctgccgcaaatcacatccgtagaggtgaagcggatttgatgcttgctggtggaactgaagctgccataatacctattggtttaggaggttttgtggcatgcagagctttgtctcaaagaaatgatgatccacaaactgcttccaggccgtgggacaaagaaagagatggatttgttatgggagagggggctggaatcttggtgatggaaagtttggagcatgcaatgaaacgaggagcgccaataattgcagagtatttgggtggtgcagttaattgtgatgcttatcacatgactgatccccgagctgatggtcttggagtttcttcatgtattcttagcagccttgaagatgctggagtgtcaccagaagaggttaactacattaatgctcatgcaacttctaccattgttggtgatctagccgaaataaatgctgttaagaaggttttcaagaccacgacaggaatcaaaatgaatgcaaccaagtctatgatagggcattgcctcggtgctgctggtggtctggaagctattgcaacaattaaagctattacaaccggctgggtgcatccttcaattaaccaattcaatcctgagccttcagtggaatttgatactgttccaaacaaaaaacagcagcatgaagtgaatgttgctatctccaattcctttggttttggtggtcacaactctgtcgttgccttttctgcattcaagccttaattcagctcagtttaggtagagcaatcttctggagtaatataggggattaatgtgatacacagtggctgtttcatctccgtgtgggcaacttgctgggcgcagcgagagaggaacaattgtcaattctttttatgtactaataatctttagcttgtagttttatagcaatgaacattttcacttttcattccttaaattagcttggaccttcatagtttggttaaacaacaatgccatcagttttgaattatgcaagagatttgaaagatgatatgatcttttgagattaacaa

SEQ ID NO: 806 - DNA, 3678 bp, Brachypodium distachyon
ccagcttcaaaacaaacaaaacgcactgccgttgcaaacccccaacggctacaatccccgttccattcgaatcctctcttccctattgcccttccttcccatcaccagagctcgcactgccctctccctagtctcctctcccacgcaaatccatacatcgcatacttttgccagccctcgtttccagatccggcggtccagcccgaatcccggcttctcgaaaccctaatctagctcccggacaccggtcgatggcgccgctgccaacgccctctccccggccagggccgccgccgacggggatgacgaccccgctcaggacgcccacctccaagcaccgcctccacttcaccccgcggagcgcacaccacggcggcggcggggccgcgggcgccgccacggagcacccggtcgaggtcatcggccgcgtccggaacctcacggcggccgcggccggcgcgtcggcgctggaggtcgcgggcggcgggacggccgtgcgcgtgcgcggggacgccggcggctgccgcgacttcaccctcgacggcgtgtcggtctcggaggaggaggacctggaggggttctaccgccggttcgtgcgctccaggatcgagggggtgcgggtcggcgccaagtgcaccgtcatggtctacgggcccacgggctccgggaagagccacaccatgttcggctgcgccaagcagcccgggatcgtgtaccgggcgctcagggacatactggaaggaggaggcggtggtagtagcagtagtgaaggtgagagccgcggcgaggaggatgctgggttcggcatggggttgtttgtgcaggtcgccgtgcttgagatctataacgaggagatctacgatttgctagtagggagcggcgcaaatgctaaagggaacgcccccaaggtgaggctagaagtaatggggaagaaagccaagaatgcaacctacatatctggaaatgaagccggaaagatatcaagggaagttgccaaagtggagaagcgccgtactgtcaagagcacactttgtaatgagagaagttcgcgaagtcactgcatgataatattggatgtcccgtcggtgggaggaaggctgatgctggtcgatatggctggttctgagaacattgaagccgcaggccaaactggatttgaagccaaaatgcagacagcaaagatcaaccaagggaacacagccttgaaacgagttgttgagtctatagccaatggtgattctcacgtcccatttcgagacagcaagctcacaatgctgttacaggattcatttgaggatgacaaatcaaagattctgatgattctgtgtgcgagtcctgacccaaaggaattgcacaagacagtttctaccttggaatacggcgctaaagcaaaatgcattatccgtgctgctcatgcgtcaacaccaagggacaaaatgagctctgaggagtcatcttcaatgctcaattcaaggattgttgcaatgaatcagttcatatacaagctccagaaggagaataagcaaagagagaaagagcgtaacgaggcccagaatattcttcggctaaaggaggaggagctagcacaagcgagggcgaagctcaggctgatagaagggcagggtgcagctgcaaaggaggaagagatcaactcaaaggtcattgagaagacccagatcctgaagagtgaactccggatgatggaagagaaaatgcttaggcagcagcaagagctccttgctttgaagcaacggctacaggaggtagaacgagaaaaggtggacgctcgtcagcctgtacaacaggatatcattggaggcagattgttggcacgattatcagagatgtctgcaggagtagatccatccatgtcgatggcgatgtctatgtccatggatttggacacgggagatcagccgactgttttagatgtgaaggtgataaaggaggatactcgccagcagggccaggtatggaatcactcatccacagcaggctcttgcaccactgccctggagcaagaagatattgtcagactgtccggatttccagaaaaggcagtcctgagcactgttttcgaggagggagatgaagaaggtgaagagaaggacaacggtgctgaagcagaagtgtgcaaggaagttgtggaagaggagagctataaagtggacagaatggagcaaccgctcgcggaaccagataggactaatcgtattcagaacatctttaggctctgtgggaactaccgtgaactggtcaagaagcctaatgtcgagtcgccagcaaatcagcaagtgtttggagatgagaacaagcagctgggaaagcaattcctgggcgatgaaaacaatcagccagaaaagcaattgttcgccgacgagaacaaagacccgtcagcatgggcagccatagaaacccccatgtgcgacgtcaaagtgacagatagcccagtttcatcacaactctccccgattgtttgccaagtcgtggatgaggccaagttgacagtaccggaggagctcaaatcatgcaccacacctgaagcaactgaccagggcaagccaaaggagcaagagggcttgctggaagtctatatcaaatgggagtccgggaatttgatcaaagggctgaaactactgcagaatgcttgcctttcagatctgaggaagctcatagaggctcacttcgaagaagccggcagcaagctgcaaccccaccaattcacattccttctcctcggggatccttctggtgctccagtgtcgagagagaaggaggcgacgatacagataagcaagctgcccaactggaacaaccagcccagcagctaccttgcctgcctgcgcgccgtgaagaagccagcgacagatcagctccatcagataccgttcagcccactggagagcaagctgaactcgaccttgaatgccaccggtgccctctcaccgaaggtggtcgcccagatgagccccaactacatccgggagctcagagcttgagcagattgcttgccacattcttttgttggttggttgtcgtcagtcatctcatccatgacaacgatgtatcgatctcctatctgttctatggtctatgtaaaattactagctggtccagtgtgcgactcgtgatgtaaccatgttacatcagagggcacacgctgtcgtgtatctgtgcttggctgagcaagattattatgatgcatcaccgtctagtggaagtgtatgctatattcattatgattattatgatgcttcatcatcgcatgcacaattctgagcaatttttattttgcaccagagattgcaggatgctgctaaggtgatttctttcgttagttctagtaatacaatttgaataaatatgaaaatgtatccaaggcaacctctcggtaaagaacagtcttgtaactcttggaatttggaactctcacatagggggggatatgtatgttttccccctttgctgcccatagtggcatttttccccctttgaagctagctgctgctcatagtgactgagttatttttcttcccttttgaaggcagttcaaagttgccaaagtggataccagcaaccgcaagcccatcacccagggcaacgaaccaaagaaagaacttgagcatgatctatcttgctctttcctggaagaacctaagcatgataagtactggaagg

SEQ ID NO: 807 - DNA, 3371 bp, Brachypodium distachyon
ttcaaaacaaacaaaacgcactgccgttgcaaacccccaacggctacaatccccgttccattcgaatcctctcttccctattgcccttccttcccatcaccagagctcgcactgccctctccctagtctcctctcccacgcaaatccatacatcgcatacttttgccagccctcgtttccagatccggcggtccagcccgaatcccggcttctcgaaaccctaatctagctcccggacaccggtcgatggcgccgctgccaacgccctctccccggccagggccgccgccgacggggatgacgaccccgctcaggacgcccacctccaagcaccgcctccacttcaccccgcggagcgcacaccacggcggcggcggggccgcgggcgccgccacggagcacccggtcgaggtcatcggccgcgtccggaacctcacggcggccgcggccggcgcgtcggcgctggaggtcgcgggcggcgggacggccgtgcgcgtgcgcggggacgccggcggctgccgcgacttcaccctcgacggcgtgtcggtctcggaggaggaggacctggaggggttctaccgccggttcgtgcgctccaggatcgagggggtgcgggtcggcgccaagtgcaccgtcatggtctacgggcccacgggctccgggaagagccacaccatgttcggctgcgccaagcagcccgggatcgtgtaccgggcgctcagggacatactggaaggaggaggcggtggtagtagcagtagtgaaggtgagagccgcggcgaggaggatgctgggttcggcatggggttgtttgtgcaggtcgccgtgcttgagatctataacgaggagatctacgatttgctagtagggagcggcgcaaatgctaaagggaacgcccccaaggtgaggctagaagtaatggggaagaaagccaagaatgcaacctacatatctggaaatgaagccggaaagatatcaagggaagttgccaaagtggagaagcgccgtactgtcaagagcacactttgtaatgagagaagttcgcgaagtcactgcatgataatattggatgtcccgtcggtgggaggaaggctgatgctggtcgatatggctggttctgagaacattgaagccgcaggccaaactggatttgaagccaaaatgcagacagcaaagatcaaccaagggaacacagccttgaaacgagttgttgagtctatagccaatggtgattctcacgtcccatttcgagacagcaagctcacaatgctgttacaggattcatttgaggatgacaaatcaaagattctgatgattctgtgtgcgagtcctgacccaaaggaattgcacaagacagtttctaccttggaatacggcgctaaagcaaaatgcattatccgtgctgctcatgcgtcaacaccaagggacaaaatgagctctgaggagtcatcttcaatgctcaattcaaggattgttgcaatgaatcagttcatatacaagctccagaaggagaataagcaaagagagaaagagcgtaacgaggcccagaatattcttcggctaaaggaggaggagctagcacaagcgagggcgaagctcaggctgatagaagggcagggtgcagctgcaaaggaggaagagatcaactcaaaggtcattgagaagacccagatcctgaagagtgaactccggatgatggaagagaaaatgcttaggcagcagcaagagctccttgctttgaagcaacggctacaggaggtagaacgagaaaaggtggacgctcgtcagcctgtacaacaggatatcattggaggcagattgttggcacgattatcagagatgtctgcaggagtagatccatccatgtcgatggcgatgtctatgtccatggatttggacacgggagatcagccgactgttttagatgtgaaggtgataaaggaggatactcgccagcagggccaggtatggaatcactcatccacagcaggctcttgcaccactgccctggagcaagaagatattgtcagactgtccggatttccagaaaaggcagtcctgagcactgttttcgaggagggagatgaagaaggtgaagagaaggacaacggtgctgaagcagaagtgtgcaaggaagttgtggaagaggagagctataaagtggacagaatggagcaaccgctcgcggaaccagataggactaatcgtattcagaacatctttaggctctgtgggaactaccgtgaactggtcaagaagcctaatgtcgagtcgccagcaaatcagcaagtgtttggagatgagaacaagcagctgggaaagcaattcctgggcgatgaaaacaatcagccagaaaagcaattgttcgccgacgagaacaaagacccgtcagcatgggcagccatagaaacccccatgtgcgacgtcaaagtgacagatagcccagtttcatcacaactctccccgattgtttgccaagtcgtggatgaggccaagttgacagtaccggaggagctcaaatcatgcaccacacctgaagcaactgaccagggcaagccaaaggagcaagagggcttgctggaagtctatatcaaatgggagtccgggaatttgatcaaagggctgaaactactgcagaatgcttgcctttcagatctgaggaagctcatagaggctcacttcgaagaagccggcagcaagctgcaaccccaccaattcacattccttctcctcggggatccttctggtgctccagtgtcgagagagaaggaggcgacgatacagataagcaagctgcccaactggaacaaccagcccagcagctaccttgcctgcctgcgcgccgtgaagaagccagcgacagatcagctccatcagataccgttcagcccactggagagcaagctgaactcgaccttgaatgccaccggtgccctctcaccgaaggtggtcgcccagatgagccccaactacatccgggagctcagagcttgagcagattgcttgccacattcttttgttggttggttgtcgtcagtcatctcatccatgacaacgatgtatcgatctcctatctgttctatggtctatgtaaaattactagctggtccagtgtgcgactcgtgatgtaaccatgttacatcagagggcacacgctgtcgtgtatctgtgcttggctgagcaagattattatgatgcatcaccgtctagtggaagtgtatgctatattcattatgattattatgatgcttcatcatcgcatgcacaattctgagcaatttttattttgcaccagagattgcaggatgctgctaaggtgatttctttcgttagttctagtaatacaatttgaataaatatgaaaatgtatc

SEQ ID NO: 808 - DNA, 3547 bp, Setaria italica
gagaaataaaaacagcaagccagctgaaattgatttcagattacagatagatggatcggatacattgcgaaatgcagcatcaaaacgctaatcactccttgatccgcgtcgcaattatagaacgaccgcttgcaccgcagatctcgtgatccccaccgcttcgcactagacgggagctccgtctccatcaccgccgcggccctatccccttttcccctccctctcctcctgcttcgaaacaaaacaaccaggctgccgttacagctcccaacggctacttccgatttcaaatcccttccccttctcctccgccctccactccacacctctcgccccatctccctttcttctccacggatttccgcgaaccttgaactcgttcgtctccggatccaccagcccgacccccaaatctcacctcccgaaaccctaaccggccgatcccccccaccgatggcgccgcccacaccctctccccggccggggctgacgccgacgccgcaggggggcggcctggcgacgcccctcaggacgccgacctccaagcaccgcctccacttccccgccgccaccccgaagaacgcccaccacggcggcggcggcgccgccacggagcacccggtcgaggtgatcggccgcatccggaacctcgcctcgggcggcgcgtcggcgctggagatcgcgggcggcggcacggccgtgcgcgtgcgcggcgacgcgggagggtgccgcgacttcaccctcgacggcgtctccgtctccgaggaggaggacctcgagggattctaccgccgcttcgtgcgctcccggatcgagggcgtccgggtcggggccaagtgcaccgtcatggtctacgggcccacgggctccgggaagagccacaccatgttcgggtgcgccaagcagcccgggatcgtgtaccgcgcgctcagggacatcctcgagggaggaggaggaggaagagggggtgacggcgatggttccggcggtggcagcgaggatgatgccgggtttggggccgggctcttcgtgcaggtcgcagtgcttgagatctacaacgaggagatctacgatctacttgtaggaagcggtgcgaatgctcgaggaaacgcccccaaggcgaggcttgaagttatggggaagaaagccaagaatgctacatacatatgtggaaatgaagctgggaagatatcgagagaagttgccaaggtggagaagcgtcgaactgtcaaaagcacgctttgtaacgagagaagttcgcggagccactgcatgattatcctggacatcccttctgttggaggaaggttaatgcttgtagacatggctggatctgagaacatcgaggctgcaggacagaccgggtttgaagccaaaattcagacagcaaaaattaatcaaggaaacactgctttaaagcgagtggttgagtccattgctaatggtgattcccatgttcccttcagagacagcaagctcacgatgctactacaggattcatttgaggatgataaatcaaaaatcctgatgattctgtgcgctagtcctgatccaaaggaactgcacaagacagtttctacgttggagtatggtgctaaggccaaatgtattatccgttctgctcatgccgcaacacctagggagaaaatgagctccgaagagtcatcagcaatgcttaattcaagaattgttgcgatgaatcagttcatttacaagcttcaaaaggagaacagattgagggagaaagagcgcaatgaggcccagaatgtgctaaggctgaaggaagaggagctatcacaactgaaagcaaagctcaagctgatggaagggcaggaaaaagctgctaaggaggagacggagaagacccaggcattgaggagtgaactaatgaagatggaagagaagatgcttaggcagcaggaagagcttgctgcactaaaacagcgactacaggaggttgagcgtgaaaagacagatgcttgtcagccagtgcagcaggatctcattggaagtagattgttggcaaggctttcagagatgcctgcagggtttgatcaatcaatgtcaatggtcatgtctatggagttagatatgggagatcagccacaagatgtcaaggtaataaaggaggatactcgccaccagggccacatatggaatcacacagcgacagcaggtgtttgcaccggtgctgtggtccaagaagatgatgttaggctatctgggtatccggaaaaggttgtcctaagcactgtattcgaggagggagatgatgaggatgcagaagggggaaatggtcttgaagaggaggtgtgcaaggaggttgtagaggagagcttcaaggttgacataacacaagatgcgctggctgacccagatgatcctgcaacaaggaagcatcggattgagaacatattcaggctctgcgggaaccatcgggaactagctaagaaaccaaaggttcagtcaccagcaaaggaagtgtttggagatcagaacaagtcaccagcaaagaaagtttttggagatgtgaagaagtcaccggcaaagcaagtttttggagatgaaaacaaggagccatcagcatggggaaccatggacacccctatgtgcgacgtcaaagtaactgacagcccagtatcttcacagctttcaccaattgtatgccaagttgtggatgaaccattgtcagagcagctaaaattatgcagtacggtgcaagaaagtgatcagaacaaggagaacagtgttgcaggacagaaggagcaggatggcctgttggaagtatacatcaagtgggagtccggaaatctgatcaaagggctaaagttactgccgaactcgtgcctttcagaattgaggaagctcatagaggctcactttgaagaagcaggcagcaaacagcagcagcagttcactttcctcctcctcggggatccttctggtggaccggtgtcaagggagaaggaagcttcggtgcagattagcaagttgcctcactggaacaaccagccaaacagctacctggcctgcctgcgggcagccaagaagccgacggtggatcacatgccgttcagcccgctggaaagcaagctgaactcggtcgtaaaggacgcacacctcgccggcatgttgtcgcccaaagccgccaaccagatgagccctaactacatccgggagctgagagcttgagctccggtagagtagtagaaagctggtcacatttgttacccgtcgctcgcggcgacctggttggtgtatcgtctatgtatgatcggtcgcttagtttctgtaagattagattactagtctggtttcgcagccggaactgtccacccgtgatgtaatcatgttattcttgcatgaccggcaggaggagcagcttgcagagctgttccggaacgctgggcgtcgttggacctgtggccatacatccgtggccagcgtgattcgtttgaatagatcaatttattcatgcctgttttgccttgtcgcttgtctgaacttctgataagcccattgcatagctaacgattgtatattgact

SEQ ID NO: 809 - DNA, 3245 bp, Setaria italica
gttacagctcccaacggctacttccgatttcaaatcccttccccttctcctccgccctccactccacacctctcgccccatctccctttcttctccacggatttccgcgaaccttgaactcgttcgtctccggatccaccagcccgacccccaaatctcacctcccgaaaccctaaccggccgatcccccccaccgatggcgccgcccacaccctctccccggccggggctgacgccgacgccgcaggggggcggcctggcgacgcccctcaggacgccgacctccaagcaccgcctccacttccccgccgccaccccgaagaacgcccaccacggcggcggcggcgccgccacggagcacccggtcgaggtgatcggccgcatccggaacctcgcctcgggcggcgcgtcggcgctggagatcgcgggcggcggcacggccgtgcgcgtgcgcggcgacgcgggagggtgccgcgacttcaccctcgacggcgtctccgtctccgaggaggaggacctcgagggattctaccgccgcttcgtgcgctcccggatcgagggcgtccgggtcggggccaagtgcaccgtcatggtctacgggcccacgggctccgggaagagccacaccatgttcgggtgcgccaagcagcccgggatcgtgtaccgcgcgctcagggacatcctcgagggaggaggaggaggaagagggggtgacggcgatggttccggcggtggcagcgaggatgatgccgggtttggggccgggctcttcgtgcaggtcgcagtgcttgagatctacaacgaggagatctacgatctacttgtaggaagcggtgcgaatgctcgaggaaacgcccccaaggcgaggcttgaagttatggggaagaaagccaagaatgctacatacatatgtggaaatgaagctgggaagatatcgagagaagttgccaaggtggagaagcgtcgaactgtcaaaagcacgctttgtaacgagagaagttcgcggagccactgcatgattatcctggacatcccttctgttggaggaaggttaatgcttgtagacatggctggatctgagaacatcgaggctgcaggacagaccgggtttgaagccaaaattcagacagcaaaaattaatcaaggaaacactgctttaaagcgagtggttgagtccattgctaatggtgattcccatgttcccttcagagacagcaagctcacgatgctactacaggattcatttgaggatgataaatcaaaaatcctgatgattctgtgcgctagtcctgatccaaaggaactgcacaagacagtttctacgttggagtatggtgctaaggccaaatgtattatccgttctgctcatgccgcaacacctagggagaaaatgagctccgaagagtcatcagcaatgcttaattcaagaattgttgcgatgaatcagttcatttacaagcttcaaaaggagaacagattgagggagaaagagcgcaatgaggcccagaatgtgctaaggctgaaggaagaggagctatcacaactgaaagcaaagctcaagctgatggaagggcaggaaaaagctgctaaggaggagacggagaagacccaggcattgaggagtgaactaatgaagatggaagagaagatgcttaggcagcaggaagagcttgctgcactaaaacagcgactacaggaggttgagcgtgaaaagacagatgcttgtcagccagtgcagcaggatctcattggaagtagattgttggcaaggctttcagagatgcctgcagggtttgatcaatcaatgtcaatggtcatgtctatggagttagatatgggagatcagccacaagatgtcaaggtaataaaggaggatactcgccaccagggccacatatggaatcacacagcgacagcaggtgtttgcaccggtgctgtggtccaagaagatgatgttaggctatctgggtatccggaaaaggttgtcctaagcactgtattcgaggagggagatgatgaggatgcagaagggggaaatggtcttgaagaggaggtgtgcaaggaggttgtagaggagagcttcaaggttgacataacacaagatgcgctggctgacccagatgatcctgcaacaaggaagcatcggattgagaacatattcaggctctgcgggaaccatcgggaactagctaagaaaccaaaggttcagtcaccagcaaaggaagtgtttggagatcagaacaagtcaccagcaaagaaagtttttggagatgtgaagaagtcaccggcaaagcaagtttttggagatgaaaacaaggagccatcagcatggggaaccatggacacccctatgtgcgacgtcaaagtaactgacagcccagtatcttcacagctttcaccaattgtatgccaagttgtggatgaaccattgtcagagcagctaaaattatgcagtacggtgcaagaaagtgatcagaacaaggagaacagtgttgcaggacagaaggagcaggatggcctgttggaagtatacatcaagtgggagtccggaaatctgatcaaagggctaaagttactgccgaactcgtgcctttcagaattgaggaagctcatagaggctcactttgaagaagcaggcagcaaacagcagcagcagttcactttcctcctcctcggggatccttctggtggaccggtgtcaagggagaaggaagcttcggtgcagattagcaagttgcctcactggaacaaccagccaaacagctacctggcctgcctgcgggcagccaagaagccgacggtggatcacatgccgttcagcccgctggaaagcaagctgaactcggtcgtaaaggacgcacacctcgccggcatgttgtcgcccaaagccgccaaccagatgagccctaactacatccgggagctgagagcttgagctccggtagagtagtagaaagctggtcacatttgttacccgtcgctcgcggcgacctggttggtgtatcgtctatgtatgatcggtcgcttagtttctgtaagattagattactagtctggtttcgcagccggaactgtccacccgtgatgtaatcatgttattcttgcatgaccggcaggaggagcagcttgcagagctgttccggaacgctgggcgtcgttggacctgtggccatacatccgtggccagcgtgattcgtttgaatagatcaatttattcatgcctgttttgccttgtcgcttgtctg

SEQ ID NO: 810 - DNA, 3257 bp, Panicum virgatum
tgcttcgaaacaaaaacaaccaggctaccgttacagctgcgcccagctcccaacggctacttcccagttcaaatcccttcccctccgttctccatttcacacctccctcctccgtcttctcctcctccttccccacggatttccgcgaaccccgaactcgtttgcctccggatccaccagccgaaaccctaaccggctaatcccccaccgatggcgccccccaccccgtctccccggccgggcccgccgcaggggggcgccctgccgacgcccctcaggacgcccgcctccaagcaccgcctccacttccccgccaccaccccgaagaacgcccaccacggcgtcggcgtcggcgccgccacggagcacccggtcgaggtgatcggccgcatccggaacctctcctcggccggcgcgtcggctctggagatcgcgggcggcgggacggccgtccgcgtgcgcggcgacgcgggcgggtgccgcgacttcaccctcgacggcgtctccgtctccgaggaggaggacctcgaggggttctaccgccggttcgtgcgctcccggatcgagggcgtccgggtcggggccaagtgcaccgtcatggtctacgggcccaccgggtccgggaagagccacactatgttcggatgcgccaagcagcccggcatcgtgtaccgcgcgctcagggacatcctcgagggaggaggaggtggagaaggcgatggtccggccggtggcggcgacgatgatgcagggtttggggctgggctcttcgttcaagtagcggtgctagagatctacaacgaggagatctacgatctactcgtaggaagcggggctaatgctaaaggaaacgcccccaaggcgaggctagaagtaatggggaagaaagccaagaatgctacttacctctctggaaatgaagctgggaagatatcaagagaagttgccaaggtggagaaacgtcgaactgtcaaaagcacgctttgtaatgacaggagttcgcggagtcattgcatgattatcctggatgtcccatcggtgggcggaaggttaatgcttgtggacatggctgggtctgaaaacattgaagctgcaggacaaactggttttgaagccaagatgcagacagcaaagattaatcaaggaaacactgctttaaagcgagtggtcgaatctattgctaacggcgattcccatgttccatttagagacagcaagctcacaatgctactgcaggattcatttgaggatgataaatcaaaaatcctgatgattctgtgtgctagtcctgatcccaaggaactgcacaagacagtttctacattggagtacggtgctaaggcaaagtgtattatccgtgctgctcatgccgcaacaccgagggacaaaataagctctgaggagtcatctacaatgcttaactctagaattgttgcgatgaaccagttcatctacaagcttcaaaaggaaaacaaactgagagagaaagagcataacgaggccaagaacttgctaaggctgaaggaagaggagctgacacaactgagagcaaagctcaagctgatagaagggcaggaaaaagctgttaaggaggaggagattaactccaaagtcatggagaagacccagaccttgaggaatgagctaatgaagatggaagaagcgatgcttaggcagcaagaagagctaactgcactaaaacagcgactacaggaggttgagcatgaaaaggcagatgcttgtcagccagtgcaacaagatttcattggaggtagactgttggcacggctgtcggagatgcctgcaggacttgatcaatcaatgtcaatggtcatgtctatggagttagatacaggagatcagccacaggatgtcaaggtaataaaggaggatacacgccagcagggccacatatggaatcacacagcaacagcaggtgtttgcactggtgctgtggcgcaagacgatgatgtcaggctgtcgggttatccagaaaaggttgtcctaagcactgtattcgaggaggcagatgaagaggatgcagagagggacagcggtcttgaggaggtgtgcaaggaggttgtacaggagagctttaaggcggacacaatacaaaatgcactgactgagccagatgatccggcaacaaggaagcatctgatcgagaacattttcaggctctgcgggaatcatcgtgaactagctaaaaaaccaaaggttcagtcaccaacaaaggaagtgtttgcagatgagaacagatcaccatcaaagcatgtgtttggagaggagagcaggtcagcagcaaaacaagcttatggaaatgaaaacagggagccattagcatggggagctctagagaccccgatgtgcgatgtcaaagtggctgagagcccagtatcttcacaactttctccaattgtatgccaagttgtggatgaacctatggtggagcagctaaaatcatgcagtacaatggaagatagtgatcagaacaaggagaatagttttgctggacagaaggagcaggacggcctgttggaagtctacatcaaatgggagtctggaaatctgattaaagggctgaagttactgcagaactcgtgcctttcagatttgaggaagctcatagaggcgcacttcgaagaagcaggtggcaaagagcagcatcaattcactttcctgctcctcggggatccttctggtgctccggtgtcaagggagaaggaagcgtcagtgcagataaggaagttgccgcactggaacaaccatccagacagctacctggcctgcctgcgggcggccaagaagccggcggtggatcacatgccgttcagcccgctggacagcaagctgaactcggtcgtaaaggacacgcacctcgccggcgtgctgtcgcccaaggttaaccagatgagccccaactacattcgggagctgagagcttgagctaccgtagagtagtagaagggtcggatttgttgcccgtcgctcgcggcgacatgaccgatgaatcgatcgcttatgatcgatcgcttaggttctgtaagattattaatttggacgtttgatgcaaatcatgtaattcttgcacgaccggcaggaggagcaccttgcggagctgctcctgacgctggacgcctggacctgtggccatgtatctgtggccaacgagatgcgtttgagtagatcaattttattcatgaatgtgtttgccttgcgtgtcctgatatgataagcccagtgcatagcgattgagt

SEQ ID NO: 811 - DNA, 3206 bp, Panicum virgatum
taatcactccttgatcccatcgcaatcatacatcggccgctcgcaccgcagatctcgtgatccccaccgccacgtctccatccttcctcggctcctctccctcctccgtcctgcttcgaaacaaaacaatcaggctaccgttacagctgcgcgcagctcccaacggctacttcctatttcaaatcccttcccctcctccccctccgttctccatttcacgcctccctcctccgcctctccttcttccccacggatttccgcgaaccctgaactcgttcgcctgcggatcccaccagccccgccttcccaaatcgcacctcccgaaaccctaaccggctaatcccccgccgatggcgccgcccacaccctctccccgcccgggcccgccgccgacgccgcatgggggcgccctggcgacgcccctcaggacgcccgcctccaagcaccgcctccactttccggccaccaccccgaagaacgcccacctcggcgccgccacggagcacccggtcgaggtgatcggccgcatacggaacctctccccgggcggcgcgtcggcgctggagatcgcgggcggcgggacggccgtccgcgtgcgcggcgacgcgggcgggtgccgcgacttcaccctcgacggcgtctccgtctccgaggaggaggacctcgaggggttctaccgccggtttgtgcgctcccggatcgagggcgtccgggtcggggccaagtgcaccgtcatggtctacgggcccacggggtccgggaagagccacaccatgttcggatgcgccaagcagcccgggatcgtgtaccgcgcgctcagggacatactcgaggggggagcaggtggagaaggcgatggtcccgccggtcgaggcgaggatgatgccgggtttggggccgggctcttcgtgcaagtcgcggtgctagagatctacaatgaggagatctacgatctactcgtaggaagcggggcgaatgctagaggaaacgcccccaaggcgaggctagaagtaatgggaaagaaagccaagaatgctacatacctctctggaaatgaagctgcgaagatatcgagagaagttgccaaggttgagaagcgtcggattgtcaaaagcacactttgtaatgaccgaagttcacggagtcattgcatgattatcctggatgtcccatcggtgggaggaaggttaatgcttgtagacatggccggatctgagaacattgaagctgcaggacaaactggatttgaagccaaaatgcagacggcaaagattaatcaaggaaacactgctttaaagcgagtggtcgagtctattgctaatggtgattcccatgttccatttagagacagcaagctcacaatgctactacaggattcatttgaggatgataaatcaaaaatcctgatgattctgtgtgctagtcctgatccaaaggaactgcacaagactgtttctacattagagtatggtgctaaggcaaagtgtatcatccgcgctgctcatgctgcaacaccgagggacaaaataagctctgaggagtcatctacaatgcttaactcaagaattgttgcgatgaaccagttcatctacaagcttcaaaaggagaacaaactgagggagaaagagcgtaacgaggcccagaacttgctaaggctgaaggaagaggagctgacacagctgagatcaaagctcaagctgatagaagggcaggaaaaagctgctaaggaggaggagattaactccaaagtcatggagaagacccggaccttgaggagtgagctaacgaagatggaagaagccatgcttaggcagcaggaagagctcgccgcactaaaacagcgactacaggaggttgagcatgtaaaggcagatgcttgtcagccagtgcaacaggatttcattggaggtagattgttggcacggctgtcggagatgcctgcaggacttgatcaatcaatgtcaatggtcatgtctatggagttagatatgggagatcagcaacaagacgtcaaggtaataaaggaggatacacgccagcagggccacatatggaatcacacaacgacagcaggtgtttgcaccggtgctgtggtgcaggaagatgatgtcaggctatctgggtatccggaaaaggttgtcctaagcactgtgtttgaggagggagatgaagaggatgcggagagggacagtggtcttgaagaggtgtgcaaggaggtcgtacaggagagctttaaggtggacacaacacaacatgcactggctgagaaagatgatccggcaacaaggaagcatcggattgagaacattttcaggctctgcgggaatcatcgtgaactagctaagaaaccaaaggttcagtcaccaacaaaggaagtgtttgcagacgagaacagatcaccagcaaagtatgtgtttggagaggagagcacgtcagcagcaaagcaagcttatggaaatgaagacagggagccattagcacggggagcactagagaccccaatgtgcgatgtcaaagtggccgagagcccagtatcttcgcaactttcaccaattgtatgccaagttgtggatcaacctttgtcggagcagctaaagtcatgcagtacagtggaagatagtgaccagaacaaagagcatagttttgctggacagaaggagcaggacggcctgttggaagtctacatcaaatgggagtctggaaatctgatcaaagggctgaagttactgcggaactcgtgcctttcagatttgaggaagctcatagaggcgcacttcgaagaacaaagcggcaaagaccaattcattttcctgctccttggggatccttctggtggtccggtgtcaagggagaaggaagcgtcggtgcagatcagcaagttgccgcactggaacaaccagccagacagctacctggcctgcctgcgggcggccaagaagccggtggcggtgatggatcacatgccattcagcccgctggacagcaagctgaactcggtcgcaaaggacacgcagctcgccggcgtgctgtcgcccaaggtcaaccagatgagccccaactacatccgggagctgagagcttgagccctagtagagtagtaaaagggtcggattgttgttgcccgttgctcgcggcgacatgacagatgtatcttgcatgtatcgatcgcttaggttctgtaagattattagtgtgagaaccgccca

SEQ ID NO: 812 - DNA, 4220 bp, Oryza sativa
accccgagatctcaaaaacaccttcgtcctctccacccaacgccataccaccccccctcccccctctctctcctccgcgcgcctcagcggcgaggggtttcgccgccgccgccgccgtcgcgccggggggacggctagagaagatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacgcagccgctcttcgtctccggaggtgatgattacaagattaaggtgtggaattacaagacacaccgctgcctcttcacacttcacgggcaccttgactatattcgcaccgtgcaattccaccacgaatacccatggatagtaagtgctagtgatgaccagacaatccggatctggaactggcagtcacgcacatgtgtagctgtgctgactggacataaccactatgtcatgtgcgcatcattccatcccaaggaggacctggttgtgtcagcatcactggatcagactgtccgtgtttgggatattggtgctttgaggaagaagacggtgtcacctgcagatgacatcctgcgtctcacccagatgaacacagatctgtttggaggtgttgatgcagttgtaaaatatgtgttggaagggcatgaccgtggggtgaactgggcatcatttcaccccacattgccactcattgtttccggggcagatgaccgacaagtgaagctatggagaatgaatgacacgaaggcttgggaagttgatactttgcggggacacatgaataatgtgtcatgcgtgatgttccatgctaagcaagacatcattgtgtccaactcagaggacaaaagcattcgcatctgggatgccacaaagcgaaccggtattcaaacgttcaggcgggaacatgatcgtttctggattctttctgctcaccctgagatgaatcttcttgccgctggtcatgacagtggtatgattgtgtttaaattggagagggaacgtccagctttctctgtgagtggagatactgttttctatgtgaaggaccgttttcttcgtttttttgaattcaccacacagaaggaagttcagcttgctccaataagaagacctggatcagtgagcttgaaccagtcacccaagacactatcttacagtccaactgaaaatgctgtcctgatttgctctgatgtggatggaggctcatacgaactctacattgttcccaaggattctgctggcagggctgactatttgcaggatgcaaagaagggagctggtgggtcagctgttttcgtggcacgcaacaggtttgcagtccttgagaagagtagcaatcaagttttggtgaagaatcttaagaatgaaatcgtaaagaaaagccctcttcctattgccacggatgcaatttattatgctgggactggtaacttgctgtgcaaagccgaagaccgagtgaccatctttgatctgcagcaaaggttaattcttggtgagctccaggcaccttctgttaaatatgttgtttggtctagtgatatggaatctgtcgcactgctgagcaagcatgcagtggttatagcaaacaagaagctcgtccatcgctgtacactgcacgaaaccattcgtgtgaaaagtggtgcctgggatgagaatggtgtgtttatttacactaccctgaatcatatcaagtattgccttcccaatggagatagtgggattattaaaaccctcgatgttcctatatacataacaagggttattgggaacaatatattctgtctagatcgtgatggtaagaacaagctggtcacagttgatgcatctgagtacattttcaagctggcccttctacgcaaacggtatgatcatgtgatgagtatgatcaagaattcccagctgtgtgggcaagctgtgatttcttatttacaacagaaaggctttccagaagttgccctccactttgtgaaagatgagaagacaagatttaaccttgctcttgagagtggtaacatccaaatcgcagttgcttctgcaaaagagattgatgacaaggatcactggtacaggttgggaattgaggccctgaggcagggaaatgttggtattgtggaatatgcataccaacgtacgaagaattttgagaggcttgctttcctatatcttattactggttacatggacaaggtgggtttcatgtgcaaaattgctggacagaacaataacctgatgggtcaattccacaatgctctgtatcttggtgatgcgttgaagagagttgagatcctagagaatgctggacagctacctcttgcttatattactgctaccacccatgggctcacagaaattgctgataggcttgccgctgagctgggtgaaaatattccttctcttcctgaaggaaaagctcgctctcttttgatcccccctgctcctcttacagccagtggtgattggccattgcttagggtgatgcatggtatctttgagggtggactggatgctactgggaaggctgaacttgaggaagacgatgaagctgctggtgctgactggggtgatgaggacctggatatggttgatgcaagcgaagcgatggcaaatggtggtgacggttttgatgctgaggagggtgaagcaaatgaggaggatggcgaggaaggtggttgggacctagaagatctggaacttccgcctgaagcagagacccctaaaaatgctggcaatgcacgctcagcggtcttcgttgctcctccaccaggcatgcctgtcagcctgatttggactcagaaatcttctcttgctggggagcatgccgcagcagggaactttgacactgcaatgaggttgcttagccgccagttgggcataaaaaactttgctcccctcaagcccctgtttgttgatctgcacatgggcagccactcatatcttcgtgcacttgcaactgcccccataataccaatcgctgttgagaaaggttggagcgagtctgcaagtcctaacgtgagaggccctcctgcacttgttttcaccttcccacaaatggaagacagactcaaggctgcctataaggccaccacagatggtaagttcccagaagccctgaggcagttccttagcatcttgcataccatccctcttatcgtggtagactcgaggagggaagtggatgaagtgaaagagttgatcgagattgtgagggagtatgttcttggcctgaggatggaacttaagaggaaggagctgagagatgatgtcaaccgccaacaagaattggcggcttacttcactaactgcaagcttcagagagttcatatgaggcttgtgcttggaagcgctatgggtctgtgctacaagcaaaagaacttcgctactgcagagcactttgcaaggatgcttctggagaacaaccctaatgaggcccaagcaaggagggctcgacaggtgcagcagcagtgcagtggcaagaaggatagctctgagctgaactatgactacagaaatccatttgttgtctgtggcgccacgtatgttccaatctaccgtggccagaaggatgtttcctgcccgtactgtggctcccggtttgttccttcgatcgaagggcagctttgtaccatatgtgagcttgccgtggttggtgcagatgcttcaggcctcctctgctcccctacgcagtcgagataagcgtcggtagatatgctcccttatattctttctagtctctcttaagacttcgctatgatatattttaccaggatgtttactgattgtaaggaataagtagtgttatacatggttgagtttttgtttcactttttctccatttcccttgatttttgtttgcctcgaggctgttgttacacttgatacatgcttgaggacttctgatcagctcatgcaaatgctatgctcggacgttatgtaccaatgtttgtttcactcatgtaaacattcggcgtcgtgttagttacattcattagtaactatgaatgtaacagttgccaatgaccaagttaacaaattacgcttagtgttgtaaatttcaatccagacgtgtgtggattgtgctcgggcaagaacagtttatagattagtgaattttgc

SEQ ID NO: 813 - DNA, 4109 bp, Oryza sativa
tctctctcctccctccaccccgccccagatccagcgcctcccctctcctccgctcgtctccgcctccggggctaggggttcgcctccgccgccgcgcccgccgtcgccggagacgacgatcaggggcgggagggccaagcgaagatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacgcagccgctcttcgtctccggaggtgatgattacaagattaaggtatggaattacaagacacaccgttgcctcttcacgcttcatggccaccttgactacattcgcacggtgcaattccaccacgagtgcccgtggatcgtaagtgccagtgatgaccagacaatccggatctggaactggcagtcacgcacatgtgtggctgtgctcactgggcataaccattatgtcatgtgtgcatctttccaccctaaggaggatctggttgtttcagcatctcttgatcagactgtccgtgtctgggatattagtgctttgaggaagaagtcagtgtcacctgcggatgacatcctgcgtctcacccagatgaacacagatctgtttggaggtgttgacgcggttgtaaaatatgtgttggaagggcatgatcgtggggtcaactgggcttcatttcatcccacgttgccactaattgtttctggggcagatgatcggcaagtgaagatatggagaatgaatgacaccaaggcttgggaagttgatactttgcgggggcacatgaataacgtgtcctgtgtgatgttccatgcaaagcaagacatcatagtgtccaactcagaggacaaaagcattcgcatctgggatgccacaaagcgaaccggtattcaaacgttcaggcgggagcatgatcgtttctggattctttctgctcaccctgagatgaatcttcttgccgctggtcatgacagtggtatgattgtgtttaaattggagagggaacgtccagctttctctgtgagtggagatactgttttctatgtgaaggaccgttttcttcgtttttttgaattcaccacacagaaggaagttcagcttgctccaataagaagacctggatcagtgagcttgaaccagtcacccaagacactatcttacagtccaactgaaaatgctgtcctgatttgctctgatgtggatggaggctcatacgaactctacattgttcccaaggattctgctggcagggctgactatttgcaggatgcaaagaagggggctggtgggtcagctgttttcgtggcacgcaacaggtttgcagtccttgagaagagtagcaatcaagttttggtgaggaatcttaagaacgaaattgtaaagaaaagccctcttcctattgccacggatgcaatttattatgctgggactggtagcttgctgtgcaaagccgaagaccgagtgaccatctttgatctgcagcaaaggttaattcttggcgagctccaggcaccttctgttaaatatgttgtttggtcgagtgatatggaatctgtcgcactgctgagcaagcatgcggtggttatagcaaacaagaagctcgtccatcgctgtacactgcacgaaaccattcgtgtgaaaagtggtgcctgggatgagaatggtgtgtttatttacactaccctgaatcatatcaagtattgccttcccaatggagatagtggaattattaaaaccctcgatgttcctatatacataacaagggttattgggaacaatatattctgtctagatcgtgatggtaagaacaagctggtcacagttgatgcatctgagtacattttcaagctggcccttctacgcaaacggtatgatcatgtgatgagtatgatcaagaattcccagctgtgtgggcaagctgtgatttcttatttacaacagaaaggctttccagaagttgccctccactttgtgaaagatgagaagacaagatttaaccttgctcttgagagtggtaacatccaaatcgcagttgcttctgcaaaagagattgatgacaaggatcactggtacaggttgggaattgaggccctgaggcagggaaatgttggtattgtggaatatgcataccaacgtacgaagaattttgagaggcttgctttcctatatcttattactggttacatggacaaggtggggttcatgtgcaaaattgctggacagaacaataacctgatgggtcaattccacaatgctctgtatcttggtgatgctatgaagagagttgagatcctagagaatgctggacagctacctcttgcctatattactgctaccacccatgggctcacagaaattgctgataggcttgccgctgagctgggtgaaaatattccttctcttcctgaaggaaaagctcgctctcttttgatcccccctgctcctctcacagccagtggtgattggccattgcttcgggtgatgcgtggtatctttgagggtggactggatgctactgggaaggctgaacttgaggaagacgatgaagctgctggtgctgactggggtgatgagggcctggatattgttgatgcaagcgaagcgatggcgaatggtggtgacggttttgatgctgaggagggtgaagcaaatgaggaggatggcgaggaaggtggttgggacctagaagatctggaacttctgcctgaagcagagaccccaaaaaatgctggcaatgcacgctcagcggtcttcgttgctcctccaccaggcatgcctgtcagcctgatttggactcagaaatcttctcttgctggggagcatgcagcagcagggaactttgacactgcaatgaggttgcttagtcgccagttgggcataaaaaactttgctcccctcaagcccctgtttcttgatctgcacatgggcagccactcatatcttcatgcacttgcaactgcccccatcataccagttgctgttgagaaaggttggagcgagtctgcaagtcctaatgtgagaggccctcctgcacttgttttcaccttcccacaaatggaagacagactcaaggctgcctataaggccaccacagatggtaagttcccagaagccctgaggcagttccttagcatcttgcataccatccctcttatcgtggtagactcgaggagggaagtggatgaagtgaaagagttgatcgagattgtgagggagtatgttcttggcctgaggatggaacttaagaggaaggagttgagagatgatgtcaaccgccaacaagaattggctgcttatttcactaactgcaagcttcagagagttcatatgaggcttgtgcttggaagcgctatgggtctgtgctacaagcaaaagaacttcgctactgcagagcactttgcaaggatgcttctggagaacaaccctaatgaggcccaggcaaggagggctcgacaggtgcagcagcagtgcagtggcaagaaggatagctctgagctgaactatgactacagaaatccatttgttgtctgtggcgccacatatgttccaatctaccgtggccagaaggatgtttcctgcccgtactgtggatcccggtttgttccttcgatcgaagggcagctttgtaccatatgtgagcttgccgtggttggtgcagatgcttcaggcctcgtctgctcgcccacacagttgagataagtggtgctaaggtagagctcccccattttcttttagtctcttaaaattctagggattctctatctcacattttagctgcatgtttactgattgaggagtgtatacatggtcgtgtttttgtatcttctccccctcatttccctcgatttttgtttgccttgaggcagctgttacacttgtcatatatggacttttgatcatctcatggtggcctatgcgcctacccctggacaattgatgtaccaatattactttcactcttggaaattttttgtcgtggtgttactttcattgtcatcctattgagc

SEQ ID NO: 814 - DNA, 3978 bp, Secale cereale
tcaggaaacccagatctcctcttgcccgagatctaaagcaccttcctcctccccacccatcgccattccctcctccgcccccctcctccgccccacgatccaccgacccgctcctctccgcggccagggccagggccggccgccgccgtcgccggggacggacgcgccgccggcgggggaacggaacggaagatgctgaccaagttcgagaccaagagcaaccgggtcaagggcctgagcttccacccgcggcggccatggatcctcgccagcctccacagcggggtgatccagatgtgggactaccgcatgggcaccctcctcgaccgcttcgacgagcacgacggccccgtccgcggcgtgcacttccacgccacccagcccctcttcgtctccggaggtgatgattacaagattaaggtgtggaattacaagacgcaccgctgcttgtttacgcttactgggcatctcgactacattcgcactgtgcaattccaccatgagtacccatggatcgtaagtgccagtgatgaccagacaatccggatctggaactggcagtcacgtacttgtgtggctgtgctcaccgggcataatcactacgtcatgtgcgcgtccttccaccccaaggaggacctggttgtgtcagcgtcgctagatcagactgtccgtgtttgggatattggtgccctgaggaagaagacggtgtcgcctgcagatgacatcatgcgtctcactcagatgaacactgatctgtttgggggtgtcgatgcggttgtgaaatatgtcttggaaggccatgaccgtggtgtcaactgggcatcatttcaccccacattgccactcattgtttctggggcagatgaccggcaagtgaagctgtggagaatgaatgataccaaggcttgggaagttgatactttgagggggcacatgaataatgtgtcctgtgtgatgttccatgcgaagcaagacatcattgtgtccaactcagaagacaaaagcattcgcatttgggatgccacaaagcgaactggtattcagacatttaggcgggaacatgaccgtttctggatccttgctgcccaccctgaaatgaatcttcttgctgctggtcatgacagtggcatgattgtgtttaaattagagagggaacgcccagctttcagcgtgagtgctgatactgtgttctatgtgaaggacagattcctccggttctttgagtattccacccagaaggaagttcaggtggctccaataagaagaccaggatctgtcagcttgaaccagtcacccaggacactatcttatagtccaactgaaaatgctgtgttgatttgctctgatgtggacgggggctcatatgatctgtacattgttcccaaggattctgctggcagggctgattatttgcaagaggcaaagaagggagctggtggctcggctgtttttgtggcacggaataggtttgctgtccttgagaagagtagcaatcaagttttggtgaagaatcttaagaacgaaattgtgaagaagagtcctcttcctattgcgactgatgcaatttattatgctggtactggtaatttgttgtgcaaagctgaagatcgtgtgaccatctttgatctacaacaaaggctagttcttggtgaactccagacagctggtgttaaatatgtagtttggtccagtgacatggagtatgttgcactactgagcaagcatgcagtagttatagctagcaagaagcttgtccatcgctctacactgcatgagaccattcgtgtgaaaagtggtgcctgggatgagaacggtatttttatttactctactttgaaccatatcaaatactgtcttcccaatggagatagtgggatcataaagacccttgatgttcctgtttacataacaagggttattgggaacaacatcttttgtctagatcgtgatggaaagaacaagctgataacagttgatgcttctgaatacattttcaagctcgcccttctccggaaacgttatgaccatgttatgagtatgattaagagctcacagctgtgtggacaggcagtgatttcatatttgcaacagaaagggtttccagaagttgctctccactttgtgaaagatgagaagacaagattcaatctagctcttgaaagtggtaacatccaaatcgcagtggcttctgcaaaagagattgatgacaaggatcactggtacagattgggaattgaggccctgaggcaggggaatgttggtattgtggaatatgcataccagcggacaaagaattttgagaggctgacttttctgtatcttattactggttacatggacaaggtgggcttcatgtgcaaaattgctggacagaataacaatttgatgggtcagttccacaatgcattgtatcttggcgatgctaggaagcgagctgagatcctggagaatgctggacagcttcctcttgcctatgttactgctgccactcatgggctcactgaaattgctgaaaggcttgctgctgagttgggtgagaatgttccttctctacctgaaggaaaaactcgctcacttttaattccgcccgcacctctaatatccagcgttgattggccattgctccgggtgatgcgtggcatatttgagggtggactggatgctactgggagagcagaagttgaggaagatgatgaagctgctggtgctgactggggtgatgaggacttggatattgtggatgcaagtgatgcagtggcaaatgggggtgatggttttgatcctgaggaaggtgaagcgaacgaggaggatggtgaggaaggtggttgggatcttgaagatctggaattgcctgaatcagagacccccaaagctgctggaaatgctcgctccactgtgtttgttgctcctacactaggaatgcctgtcagccaaatttggactcagaaatcttctcttgctggggagcatgcagcagcaggcaactttgacactgcaatgaggttgctcagccgccagttgggcatcaagaactttgctcccctgaaacccatgtttctcgatcttcatatgggcagtcattcatatcttcgcgcacttgcaactgctcccgttatatcaattgctgttgagaaaggttggagtgagtcctcaagtcctaacgtgaggggccctccttcactagttttcaccttctcacaaatggaagacagactcaaggcagcctacaaagccacaaccgaggggaagttcccagaagcgctgagacagttcctcagcatcttgcataccattccccttatcgtggtggactcacggagagaagttgatgaggtgaaggagttggttgagatagtgagggagtatgttcttggtctaagaatggaactcaagagaaaggaattgaaggacaatgtcaaccggcaacaggaactcgcggcctacttcaccaactgcaagctccagagggttcacatgaggcttgtgctctcgaacgccatggctctatgctacaagcagaagaacttcgcgaccgcagagcactttgcgaggctgctccttgagaacagccctaacgaggtccaagcgaagaaggctcggcaggtgcagcagcagtgcaacggcaagcaggacagccatgagctcaactacgactacagaaatccgttcgtcgtctgtggctcgacgtatgttcccatctaccgcggccaaaaggacatctcgtgcccatactgcggatcccggtttgttcctgccattgaagggcagctttgtaccatatgcgagctggctgtggtcggcgcggacgcctcgggcctcctgtgctcccctacacagacgagatgagcggaagaggctagtcgttagagctcccctatattctttctagtctcgtaaagtctatcttatactttaccaggaggtttactgattgtgtaaggaataagtataatagtacatggttttgtcgagtttttt

SEQ ID NO: 815 - DNA, 4185 bp, Sorghum bicolor
ccgagatctaaaacacctccctctcccgtcgtccattgcattctcctctctctctctctctctctctctctctctctctctcgcgcgagtcccgactcgcccctccagatccaccccctcctcctcttctcctccagatccaccccctcctcctctccgttcctctccgcagctacagctaggagggagctcggcctagccgccgacgtggccgggcacgccgggccgggaggatgctgaccaagttcgagacgaagagcaaccgggtgaagggcctgagtttccacccgcgtcggccatggatcctggcgagtctccacagcggggtgatccagatgtgggactaccgcatgggcaccctcctcgaccgcttcgacgagcacgacgggccggttcgcggcgtccacttccacgccacccagcccctcttcgtctccggaggtgatgattataagattaaggtctggaattacaagacgcaccgctgcctcttcacacttcatgggcaccttgactacattcgcactgtgcaattccatcatgagtacccatggattgtaagtgctagtgacgatcagacaatccgtatctggaactggcaatcacgcacctgtgtggctgtgctgactggacataaccactacgtcatgtgtgcatctttccatcccaaagaagacctggttgtatctgcatcacttgatcagactgtgcgtgtctgggatattggagctctgaggaagaagacagtgtcacctgctgatgacatcctccgtctcacccagatgaacacagatctttttggaggtgttgatgctgtagtgaaatatgtcctcgaaggccatgaccgtggggtcaactgggcctcgtttcatcccactttgccactcattgtttctggggcagatgaccggcaggtgaagctatggagaatgaatgataccaaggcttgggaagttgatactttaaggggccacatgaataatgtgtcttgtgtgatgttccatgcgaagcaagacatcattgtgtccaactcagaagacaaaagcattcgcgtttgggatgccacaaagagaactggtattcagacatttagacgggagcatgaccgtttctggattcttgctgctcaccctgaaatgaaccttcttgctgctggtcatgacagtggcatgattgtgttcaaattagagagggaacgcccggccttctgtgttagtggtgacactgttttctatgtgaaggatcggtttctccggttctttgaatacactagccagaaggaagttcaagtggctccaataagaagacctggatcagtcagcttgaaccagtcacccaggacgctgtcctacagcccaactgagaatgctgtcttgatttgctctgatgctgacgggggttcatatgaactctacattgttcccaaggattctgctggcagatctgattacttgcaagaggcaaagaaaggagctggtggttctgctgtttttgtagcacgcaacaggtttgcagtccttgagaagagtagcaatcaagttttggtgaagaatcttaagaatgaaattgtgaagaaaagcccccttcccattgcgactgatgcaatatattatgctgggaccggtaacctgctgtgcaaatctgaagacagggtgaccatctttgatcttcagcaaaggttagttcttggtgagctccagactcctgctgtcaaatatgttgtttggtccagtgacatggaatccgttgcactgctgagcaagcatgcagtggttatagctagcaagaagcttgtccacaggtgcacactgcatgaaaccatccgtgtgaaaagtggtgcctgggatgagaatggtgtgttcatttacactacactgaaccatatgaagtactgtcttcccaatggagacagtgggatcataaaaacccttgatgttcctatttacataacgagggttgttgggaacaacattttctgcttagatcgtgatggaaagaacaagctgattgcagttgatgcatcggagtacattttcaagctcgcccttctcaggaaacgctatgatcatgttatgagtatgattaagaactcccagctgtgtgggcaggctgtgatttcttatttgcaacagaaaggtttcccagaagttgctctacactttgtgaaggatgagaagaccagatttaacctggctctcgagagtggtaacattcaaattgcagttgcttctgcaaaggagatcgatgacaaggatcactggtacaagttgggaattgaggccctgaggcagggaaatgttggtatagtggaatatgcttatcaacgaacaaagaattttgagaggcttgcttttctgtatcttattactggttacttggacaaggtcggcttcatgtgcaaaattgctggacagaacaacaatttgatgggacagttccacaatgcattgtatcttggggatgccaagaagcgtgttgagatcttggagaatgctgggcagatacctcttgcttatgttaccgctgtcactcatgggctcacagaaattgctgagaggcttgctgctgaattaggcgagaatgttccatctctgcctgaaggaaaatcccactcactactgatccctcctgcacctctcacagcgtgtggtgattggccattactgagggtaatgcgcggtattttcgaaggtggactggatgctactggaagggcagatcttgaggaagacgatgaagctgctggtgctgattggggtgatgaagacttggatattgttgatgcaagtgaagtggtggccaatggtgatggttttgatgtagaagagggtgagccaaatgaggaggatggtgaggaaggtggctgggatctggaagatctggaacttccacctgaaactgagactccaaaatctgttggcaatgctcgctccgctgtatttgttgctcctacaccaggtattcctgtcagccaaatttggacccagagatcttctctggctggggagcaagcggctgcagggaactttgacacagcaatgaggttgcttagccgccagttgggtatcaagaactttgttccactgaagcccttgtttcttgacctgcacatgggcagtcatacatatctgcgtgcgcttgccgccgctcctgttatatcagttgcagtagagaaaggttggaatgagtctgcaagtcctaacgtgaggggccctcctgcacttgttttcagcttctcacaaatggaggatagactcaaggctgcctacaaagccacaactgagggaaagttccctgaagcactgagacagttccttagcatcttgcataccattccagttattgtggtggattcacggagagaagttgatgaggtaaaggaattaattgagatagtgagggagtatgttcttggtctgaggatggaactcaagagaaaggaattgagggatgatgtgacccgtcaacaggagttggctgcttacttcacaaactgcaagcttcagagagttcatatgaggcttgtgcttgcaagcgctatggctctttgcttcaagcagaaaaactatgcaactgcaggacactttgcaaggatgcttcttgagaacagccctcaggaggcccaagcaaagaaggctagacaggttctgcaagcttgccaggacaagaacgattctcaccaactgaactatgatttcagaaatccattcgttgtttgtggcgccacatatgttcctatctatcgtggccaaaaggatgtttcctgcccttactgtggatcccgatttgttccttccatcgaagggcagctttgtaccatatgtgagcttgctgcggttggggcagatgcttcaggcctcctctgctcccctacacagtcgagataagcaatggtagttagaggtcccctatattctttctagtgtcaagttccaagactttatcatatattttaccagggagtttactgattgtaaggaataagtattatacatgtttttgtcgagtttttttttcttttttgtgttctgttaccataatttttgtttgctcagagcctgctgtcatcagtcatcacctgcggtatggtttagacttttgatcgactttggaagctatgctggaaattgatgtatgagatgtttctttcactctttaaaattcttttttggatgtcgctgcgtt

SEQ ID NO: 816 - DNA, 3999 bp, Avena sativa
ctctctcccccctccgcccctctcctccacctcagatccaccgactcccgtcccccgccccgctcctctccgcggccagggccaggggacgccgccgtcgccggggaagacgacgacgagtcggcggggagaagatgctgaccaagttcgagacgaagagcaaccgggtgaagggcctgagcttccacccgcggcggccatggatcctcgccagcctccacagcggggtgatccagatgtgggactaccgcatgggtaccctcctcgaccgcttcgacgagcacgacggtcctgtccgcggcgtgcacttccacgccacccagcccctcttcgtctccggaggtgacgattacaagattaaggtgtggaattataagacacaccgctgcttgtttacgcttactggccacctcgactacattcgtaccgtgcagttccaccatgagtacccatggatcgtaagtgctagcgatgaccagacaatccggatctggaactggcaatcacgtacttgtgtggctgtgctgaccgggcataatcactatgtcatgtgcgcgtctttccaccccaaggaagacctggttgtgtcagcatcactagatcagactgttcgtgtttgggatattggtgctctgaggaagaagacggtgtcacctgctgatgacatcatgcgtctcactcagatgaacacggatctatttggtggtgtcgatgcggttgtgaaatatgtcctggaaggccatgaccgtggtgtcaactgggcctcatttcatcccacgctgccactcattgtttctggggcagatgaccggcaagtgaaactctggagaatgaatgatacaaaggcatgggaggttgatactctgagaggtcacatgaataatgtgtcctgtgtactgttccacgcaaagcaggacatcatcgtgtccaactcagaagacaaaagcattcgcatttgggatgccacaaagcgaactggtattcagacatttaggcgggaacatgaccgtttctggatccttgctgctcaccctgaaatgaatcttcttgctgctgggcatgacagtggcatgattgtgttcaaattagagagggagcgtccagctttcagcgtcagtgctgatactgtattctatgttaaggacagattcctccggttctttgagtactccacccagaaggaagttcaggtggctccaataagaagaccaggatcagtcagcttgaaccagtcacccaggacgctatcttatagtccaacagaaaatgctgtgttgatttgctcagatgtggatgggggctcatatgatctctacatcgttcctaaggattctactggcagtttgcaggaggcaaagaaaggagctgggggttcagctgtttttgtggcacgtaataggtttgctgtccttgagaagagtagcaatcaagttttggtgaagaatcttaagaatgaaattgtgaagaaaagtcctcttcctattgccactgatgcaatttattatgctgggactggtaatttgttgtgcaaagctgaagaccgtgtgaccatctttgatctacagcaaaggctagttcttggtgaactccaggcagctggtgttaaatatgttgtttggtccactgacatggagtctgttgcattgctgagcaagcatgcagtagttatagctagcaagaagcttgtccatcgctctacactgcatgaaaccattcgtgtgaaaagtggtgcatgggatgagaatggtgtgtttgtttactctaccctgaaccatataaaatactgtcttcccaatggagatagcgggatcataaagacccttgatgttcctatttacataacgagggtgattgggaacaacattttctgtctagatcgtgatggcaagaacaaactgataacagtcgatgcttcagaatacattttcaagcttgcccttctccggaaacgttatgaccatgttatgggtatgattaagagctcacagttgtgtggacaggcagtgatttcatatttacagcagaaagggtttccagaagttgctctccactttgtgaaggatgagaagacgagatttaatctagctcttgaaagtggtaacatccaaattgcagttgcatcggcaaaagagattgatgacaaagatcactggtacaggttgggaattgaggccctgaggcaggggaatgttggtattgtggaatatgcataccagcggacaaagaattttgagagacttgcttttctgtatctcattactggttacctggacaaggtgggcttcatgtgcaaaattgctggacagaataacaatttgatgggtcagttccacaatgcattgtatcttggggatgctaggaagcgagctgagatcctggagaatgctgggcagctacctcttgcctatgctactgctgccactcatgggctcactgaaattgctgataggcttgctgctgaattgggtgagaatgttccttctctacctgcaggaaaatctcgctcacttttgattccccctgcacctctcatatccagcgttgattggccattgctccgtgtgatgcgtggtacttttgaggttggattggatgctactgggagagcagaagttgaggaagatgatgaagctgctcctgctgactggggtgaggaggacttggatattgtggatgcaagtgatgcagtgccaaatggtggtggtggttttgatcctgaggagggtgaagcaaatgaggaggatggtgaggatggtggctgggatcttgaagatctggaattgccacctgaagcagatacaccaaaagctgctggaaatgctcgctccagtgtatttgttgctcctacaccaggcatgcctgtcagccaaatttggacacagaaatcttcccttgctggcgagcatgcagcagctgggaactttgacactgccatgaggttgcttagccgccagttgggtatcaagaactttactcctctgaagccattgtttctcgatctccatatggggagccattcgtatcttcgtgcacttgcagctgctcccgttatatcagttgctgttgagaaaggttggagtgagtctgcaagtcctaatgtgaggggccctcctgcactagttttctccttctcgcaaatggaagacagactcaaggcagcctacaaagccacaactgaggggaagttcccagaagcgctgaggcaattcctcagcatcttgcataccatccctcttattgtggtggactcacgaagagaagtcgatgaagtgaaggagctgatcgagatagtgcgggagtatgttcttggtctaagaatggagctcaagagaaaggaattgaaagacaatgtcaaccggcaacaggaattggcggcctacttcactaactgcaagcttcagagggttcacatgaggcttgtgctctcgaacgccatggctctatgctacaagcagaagaactttgcgaccgcggagcatttcgcgaggctgctccttgagaatagcccgaacgaggtccaagcgaagaaggctcggcaggtgcagcagcagtgcagtgggaagcaagacagctgtgagctgaactacgactacagaaatccgttcgtggtctgcggctctacatacgtccctatctaccgtggccagaaggatatctcctgcccatactgttcgtcacggtttgttccttcggttgaagggcagctttgtaccatatgcgagctggctgtggtcggcgcagacgcctcgggcctcctgtgctcccctacacagcagagataaaaaaagcggaactagttagagctcccctatattctttctagtctcgtaaagtctgtcttatattttaccaggaggtttacagattgtaaggaataagtatattatccatggttttgttgagtttttcttgactatctctcagtctgccccttttttgtttgccttgaggatgctgttacacctgttaatgcttatatggaatgttgatcgactcatg

SEQ ID NO: 817 - DNA, 4186 bp, Setaria italica
ctcattagatccccatcttccctcgtccggtgcatactcctccctctctcccgttcccctccagatccaccacctcctcgccgctcctctccgcggccaagggctagagggtctcgggcttcacccgccgccgtggccggggacgccaggccgggaggatgctgaccaagttcgagacgaagagcaaccgggtgaagggcctgagcttccacccgcggcggccatggatcctggcgagcctccacagcggggtgatccagatgtgggactaccgcatgggcaccctcctcgaccgcttcgacgagcacgacgggcctgtccgcggcgtccacttccacgccacccagccgctcttcgtctccggaggtgatgattataagataaaggtctggaattacaagacgcaccgctgcctcttcacacttcatgggcaccttgactacattcgcactgtgcaattccatcatgagtacccatggatcgtaagtgctagtgatgatcaaacaatccggatctggaactggcagtcacgcacctgcgtagccgtgctgactgggcataaccactatgtcatgtgtgcatctttccatcccaaagaggacttggttgtatcagcatcacttgatcagactgtccgcgtctgggatatcggagctctgaggaagaagacagtgtcacctgcagatgacatcctccgtctcacccagatgaacacagatctatttggaggtgttgatgctgtagtgaaatatgtcttggaaggccatgatcgtggtgtcaattgggcctcatttcatccctctttgccactcattgtttctggtgcagatgaccggcaagtgaagctatggagaatgaatgacaccaaggcttgggaagttgatactttgaggggccacatgaataatgtgtcttgcgtgatgttccatgcaaagcaagacatcattgtgtctaactcagaagacaaaagcattcgcatttgggatgccacaaagagaactggtattcaaacatttaggcgggaacacgaccgcttttggattcttgctgctcaccctgaaatgaatcttcttgctgctggtcatgacagtggcatgattgtgttcaaactagagagggaacgcccggccttctgtgttagtggtgacactgttttctatgtgaaggatcgatttctccgattctttgaatactccacccagaaggaagttcaagtggctccaataagaaggcccggatcagttagcttgaaccagtcaccaaggacactatcatacagtccaaccgaaaatgctgtcttgatctgttcagatgctgatgggggctcatatgaactctacattgttcccaaggattcagctggcaggtctgattatttgcaagaggcaaagaagggagctggtggttctgctgtttttgtggcgcgcaacaggtttgcagtccttgagaagagtagcaatcaagttttggtgaagaatcttaagaatgaaattgtgaagaaaagcccccttccaattgcgactgatgcaatatactatgctgggaccggtaacttgctgtgcaaagctgaagaccgggttgccatctttgatcttcagcaaaggctagttcttggtgagctccagacgcctgctgttaaatatgttgcttggtccactgatatggaatctgttgcactgttgagcaagcatgcagtcgttatagctagcaagaagcttgtccatcgatgcacattgcatgaaaccatccgtgtgaaaagtggtgcctgggatgagaatggcgtgttcatttacactacactgaaccatatgaagtactgtcttcccaatggagacagcgggatcataaaaacgcttgatgttcctatttacataacaagggttgttgggaacaatattttttgcctagatcgtgatggaaagaacaagctgattgctgttgatgcatcagagtacattttcaagctcgctcttctccgaaaacgctatgaccatgttatgagtatgattaagaactcccagctatgtggacaggctgttatttcttatttgcagcagaaaggttttccagaagttgctctacattttgtgaaggatgagaagaccagatttaacctagctcttgagagtggtaacattcaaattgcagttgcttctgcaaaggagattgatgacaaagatcactggtacaggctggggattgaggccctgaggcaaggaaatgttggtattgtggaatatgcataccaacggacaaagaattttgagaggcttgcttttctgtatcttattactggctacttggacaaggtaggcttcatgtgcaaaattgctggtcagaataacaatttgatgggacagttccacaatgcattatatctcggggatgctaagaagcgagttgagatcttggagaatgctgggcagctaccacttgcttatgttactgctgtcactcatgggctcactgaaattgccgagaggattgctgctgaattaggcgaaaatgctccttctctgcctgaaggaaaatctcactcgctgctgatcccccctgcacctcttacagcctgtggtgattggccattgctgcgggtgatgcgtggaatttttgaaggtggactggatgctactggaagggcagagcttgaggaagatgatgaagctgctggtgctgactggggtgatgaagacttggatattattgatgcaagtgaggtggtggcaaatggtggtgatagttttgttgaagctgaggagggtgaaccaaatgaggaggatggtgaggaaggtggctgggacttggaagatctggaacttccgcctgaaacagagactccaaaagctgttggcaatgctcgctctgctgtatttgttgctcctacacctggcattcctgtcagccaaatttggactcagagatcttctctggctggggagcatgcggctgcagggaactttgacacagctatgcggttgcttagccgtcagttgggtatcaagaacttcactcctctaaagcccttgtttcttgatttgcacatgggcagtcacacatacctacgtgcacttgctgctgctccagttatatcagttgctgttgagaaaggatggaatgagtctgcaagtcctaatgtgagaggccctcctgcacttgttttcagcttctcacaattggaagacagactcaaggctgcctacaaagctacaactgagggcaagttcccagaagcactgaggcagttccttaacatcttacataccattcctgttattgtggtggactcacggagagaagttgatgaagtgaaggaattaattgagatagtgaaagagtatgttcttggtctgaaaatggagcttaagagaaaggaattgagggatgatgtgacccgtcaacaagagttggctgcttacttcactaattgcaagcttcagagagttcatatgaggcttgtgcttgcaagcgctatggctctttgcttcaagcaaagaaactatgctactgcagcacactttgcaaggatgcttcttgagaacagccctcaggaggctcaagcaaagaaggctcggcaggtgatgcaagcttgccaggacaagaatgattctcaccaactgaactatgacttcagaaatccattcgttgtctgtggtgctacatatgttcctatctatcgtggccaaaaggatgtttcctgcccatactgcggatcccggtttgttccttccatcgaagggcagctttgtaccatatgtgagcttgccactgttggggcagatgcctcaggcctcctctgctccccgacacagttgagataggcgatggaagctacaggcccctatattctttctagtgtctaaaagttctaaatgtaagactttatcatatattttatcaggaactttactgattgtaaggaataagtattatacatggttttatctcgagtttttctttttcgtgttttcttaccataatttttgtttgcctagagactgctgtgatcacttgccatatggcttagacttttgatcgacctatgtaagctatgatatacattgatgtatgcaaagtttctttcacactttaaaattccttttggatgtctcgggtgcattgaatatgtaatctggagcttatctttgcttgatatgttggttctatgtgatatatatgttgattgctg

SEQ ID NO: 818 - DNA, 4129 bp, Setaria italica
ttagatccccatcttccctcgtccggtgcatactcctccctctctcccgttcccctccagatccaccacctcctcgccgctcctctccgcggccaagggctagagggtctcgggcttcacccgccgccgtggccggggacgccaggccgggaggatgctgaccaagttcgagacgaagagcaaccgggtgaagggcctgagcttccacccgcggcggccatggatcctggcgagcctccacagcggggtgatccagatgtgggactaccgcatgggcaccctcctcgaccgcttcgacgagcacgacgggcctgtccgcggcgtccacttccacgccacccagccgctcttcgtctccggaggtgatgattataagataaaggtctggaattacaagacgcaccgctgcctcttcacacttcatgggcaccttgactacattcgcactgtgcaattccatcatgagtacccatggatcgtaagtgctagtgatgatcaaacaatccggatctggaactggcagtcacgcacctgcgtagccgtgctgactgggcataaccactatgtcatgtgtgcatctttccatcccaaagaggacttggttgtatcagcatcacttgatcagactgtccgcgtctgggatatcggagctctgaggaagaagacagtgtcacctgcagatgacatcctccgtctcacccagatgaacacagatctatttggaggtgttgatgctgtagtgaaatatgtcttggaaggccatgatcgtggtgtcaattgggcctcatttcatccctctttgccactcattgtttctggtgcagatgaccggcaagtgaagctatggagaatgaatgacaccaaggcttgggaagttgatactttgaggggccacatgaataatgtgtcttgcgtgatgttccatgcaaagcaagacatcattgtgtctaactcagaagacaaaagcattcgcatttgggatgccacaaagagaactggtattcaaacatttaggcgggaacacgaccgcttttggattcttgctgctcaccctgaaatgaatcttcttgctgctggtcatgacagtggcatgattgtgttcaaactagagagggaacgcccggccttctgtgttagtggtgacactgttttctatgtgaaggatcgatttctccgattctttgaatactccacccagaaggaagttcaagtggctccaataagaaggcccggatcagttagcttgaaccagtcaccaaggacactatcatacagtccaaccgaaaatgctgtcttgatctgttcagatgctgatgggggctcatatgaactctacattgttcccaaggattcagctggcaggtctgattatttgcaagaggcaaagaagggagctggtggttctgctgtttttgtggcgcgcaacaggtttgcagtccttgagaagagtagcaatcaagttttggtgaagaatcttaagaatgaaattgtgaagaaaagcccccttccaattgcgactgatgcaatatactatgctgggaccggtaacttgctgtgcaaagctgaagaccgggttgccatctttgatcttcagcaaaggctagttcttggtgagctccagacgcctgctgttaaatatgttgcttggtccactgatatggaatctgttgcactgttgagcaagcatgcagtcgttatagctagcaagaagcttgtccatcgatgcacattgcatgaaaccatccgtgtgaaaagtggtgcctgggatgagaatggcgtgttcatttacactacactgaaccatatgaagtactgtcttcccaatggagacagcgggatcataaaaacgcttgatgttcctatttacataacaagggttgttgggaacaatattttttgcctagatcgtgatggaaagaacaagctgattgctgttgatgcatcagagtacattttcaagctcgctcttctccgaaaacgctatgaccatgttatgagtatgattaagaactcccagctatgtggacaggctgttatttcttatttgcagcagaaaggttttccagaagttgctctacattttgtgaaggatgagaagaccagatttaacctagctcttgagagtggtaacattcaaattgcagttgcttctgcaaaggagattgatgacaaagatcactggtacaggctggggattgaggccctgaggcaaggaaatgttggtattgtggaatatgcataccaacggacaaagaattttgagaggcttgcttttctgtatcttattactggctacttggacaaggtaggcttcatgtgcaaaattgctggtcagaataacaatttgatgggacagttccacaatgcattatatctcggggatgctaagaagcgagttgagatcttggagaatgctgggcagctaccacttgcttatgttactgctgtcactcatgggctcactgaaattgccgagaggattgctgctgaattaggcgaaaatgctccttctctgcctgaaggaaaatctcactcgctgctgatcccccctgcacctcttacagcctgtggtgattggccattgctgcgggtgatgcgtggaatttttgaaggtggactggatgctactggaagggcagagcttgaggaagatgatgaagctgctggtgctgactggggtgatgaagacttggatattattgatgcaagtgaggtggtggcaaatggtggtgatagttttgttgaagctgaggagggtgaaccaaatgaggaggatggtgaggaaggtggctgggacttggaagatctggaacttccgcctgaaacagagactccaaaagctgttggcaatgctcgctctgctgtatttgttgctcctacacctggcattcctgtcagccaaatttggactcagagatcttctctggctggggagcatgcggctgcagggaactttgacacagctatgcggttgcttagccgtcagttgggtatcaagaacttcactcctctaaagcccttgtttcttgatttgcacatgggcagtcacacatacctacgtgcacttgctgctgctccagttatatcagttgctgttgagaaaggatggaatgagtctgcaagtcctaatgtgagaggccctcctgcacttgttttcagcttctcacaattggaagacagactcaaggctgcctacaaagctacaactgagggcaagttcccagaagcactgaggcagttccttaacatcttacataccattcctgttattgtggtggactcacggagagaagttgatgaagtgaaggaattaattgagatagtgaaagagtatgttcttggtctgaaaatggagcttaagagaaaggaattgagggatgatgtgacccgtcaacaagagttggctgcttacttcactaattgcaagcttcagagagttcatatgaggcttgtgcttgcaagcgctatggctctttgcttcaagcaaagaaactatgctactgcagcacactttgcaaggatgcttcttgagaacagccctcaggaggctcaagcaaagaaggctcggcaggtgatgcaagcttgccaggacaagaatgattctcaccaactgaactatgacttcagaaatccattcgttgtctgtggtgctacatatgttcctatctatcgtggccaaaaggatgtttcctgcccatactgcggatcccggtttgttccttccatcgaagggcagctttgtaccatatgtgagcttgccactgttggggcagatgcctcaggcctcctctgctccccgacacagttgagataggcgatggaagctacaggcccctatattctttctagtgtctaaaagttctaaatgtaagactttatcatatattttatcaggaactttactgattgtaaggaataagtattatacatggttttatctcgagtttttctttttcgtgttttcttaccataatttttgtttgcctagagactgctgtgatcacttgccatatggcttagacttttgatcgacctatgtaagctatgatatacattgatgtatgcaaagtttctttcacactttaaaattccttttggatgtctcgggtgcattgaatatgtaatctgg

SEQ ID NO: 819 - DNA, 4065 bp, Pennisetum glaucum
ggcctcctccccctccctcctcccgttcccctccagatccaccagaccaccacctcctcgccgctcctctccgcggccaagggctagagggtctctgggcttcacccgccgcggtggccggggacgccaggcctggaggatgctgaccaagttcgagacgaagagcaaccgggtgaagggcctgagcttccacccgcggcggccatggatcctggcgagcctccacagcggggtgatccagatgtgggactaccgcatgggcaccctcctcgaccgcttcgacgagcacgacgggcctgtccgcggcgtccacttccacgccacccagcctctcttcgtctccggaggtgacgattataagataaaggtctggaattacaagacacatcgctgcctcttcacacttcatgggcaccttgactacattcgcactgtgcaattccatcatgagtacccatggatcgtaagtgctagtgatgaccagacaatccggatctggaactggcagtcacgcacctgcgtagccgtgctaactgggcataaccactatgtcatgtgtgcatctttccatcccaaagaggacttggttgtatcagcatcacttgatcagactgtccgtgtctgggatattggagctctgaggaagaagacagtgtcacctgcagatgacatcctccgtctcacccagatgaacgcagatctatttggaggtgttgatgctgtagtgaaatatgtcttggaaggccatgaccgtggtgtcaattgggcctcatttcatccctcgttgccgcttattgtttctggtgcggatgaccgtcaggtgaagctatggagaatgaatgacaccaaggcttgggaagttgatactttgaggggccacatgaataatgtgtcttgcgtgatgttccatgcaaagcaagacatcattgtgtctaattcagaagacaaaagcatccgcatttgggatgccacaaagagaactggtattcaaacatttaggcgggaacatgaccgtttttggattcttgctgctcaccctgaaatgaatcttctggctgctggtcatgacagtggcatgattgtgttcaaactagagagggaacgcccggccttctgtgttagtggtgacactgttttctatgtcaaggatcgatttctccgattcttcgaatactccacccagaaggaagttcaagtggctccaataagaaggcctggatcagttagcttgaaccagtcaccaaggacactatcatacagtccaactgaaaatgctgtcttgatctgttcagatgctgatgggggctcatatgaactctacattgttcccaaggattcagctggcaggtctgattatttgcaagaggcaaagaagggagctggtggttctgctgtttttgtggcacgcaacaggtttgcagtccttgagaagagtagtaatcaagttctggtgaagaatcttaagaatgaaattgtgaagaaaagccccctcccaattgcgactgatgcaatatactatgctggcaccggtaacttgctgtgcaaagctgaagaccgtgttgccatctttgatcttcagcaaaggctaattcttggggagctccagacacctgctgttaaatatgttgcttggtccactgatatggaatctgttgcactgatgagcaagcatgcagtcgttatagctagcaagaagcttgtacatcgatgcacattgcatgaaaccatccgtgtgaaaagtggtgcctgggatgagaatggtgtgttcatttacactacactgaaccatatgaagtactgtcttcccaatggagacagcgggatcataaaaactcttgatgttcctatctacataacaagggttgctgggaacaatattttttgcctagatcgtgacggaaagaataagctgattgctgttgatgcatctgagtacattttcaagctcgctcttctccgaaaacgctatgatcatgttatgagcatgattaagagctcccagctatgtggacaggctgttatttcttatttgcagcagaaaggttttccagaagttgctctacattttgtgaaggatgagaagaccagatttaacctagctctggagagtggtaatattcaaattgcagttgcttctgcaaaggagattgatgacaaagatcactggtacaggctgggaattgaggccctgaggcaaggaaatgttggtattgtggaatatgcataccaacggacaaagaattttgagaggctcgcttttctatatcttattactggctacttggacaaggtaggcttcatgtgcaaaattgctggtcagaataacaatttgatgggacagtttcacaatgcattatatctcggggatgctaagaagcgagttgagatcttggagaatgccgggcagctaccacttgcttatgttactgctgtcactcatgggctcactgaaattgccgagaggattgctgctgaattaggcgaaaatgttccttctctgcctgaaggaaaatctcactcactgctgatcccccctgcacctcttacagcctgtggtgattggccattgctgcgggtgatgcgtggaattttcgaaggtggactggatgctactggaagggcagaggttgaggaagatgatgaagctgctggtgctgactggggtgatgaagacttggatattattgatgcaagtgaggtggtggcaaatggtggtgatagttttgttgaagctgaggagggtgaaccaaacgaggaggatggtgaggaaggtggctgggacttggaagatctggaacttccgcctgaaacagagactccaaaagctgtcggcaatgctcgctctgctgtatttgttgctcctacacctggcattcctgtcagccaaatttggactcagagatcttctttggctggggagcatgcggctgcagggaactttgacacagcaatgcggttgcttagccgtcagttgggtatcaagaacttcactcctctaaagcccttgtttcttgatttgcacatgggcagtcacacatacctacgtgcacttgctgctgctccagttatatcagttgctgttgagaaaggatggaatgagtctgcaagtcctaatgtgagaggccctcctgcccttgttttcagcttctcacaattagaagacagactcaaggctgcctacaaatatacaactgagggtaagttcccagaagcactgaggcagttccttaacatcttgcacaccattcctgttattgtggtggactcacgtagagaagttgatgaagtgaaggaattaattgagatagtgagagagtatgttcttggtctgaaaatggagcttaagagaaaggaattgagggatgatgtgacccgtcaacaagagttggctgcttacttcactaattgtaagcttcagagagttcatatgaggcttgtgcttgcaagcgctatggctctttgcttcaagcaaagaaactatgctactgcagcacactttgcaaggatgcttcttgagaacagccctccggaggctcaagcaaagaaggctcggcaggtggtgcaagcttgccaggacaagaatgattctcaccaactgaactatgacttcagaaatccatttgtggtctgtggtgctacatatgttcctatctatcgtggccaaaaggatgtttcctgtccatactgcggatcccgttttgttccttccatcgaagggcagctttgtaccatatgtgagcttgccacagttggggcagatgcttcaggtctcctctgctcccctacacagttgagataggcgatggaagctgcaggcccctatattctttctagtgtctaaagttttaaatgtaagactttatcatatattttatcaggaactttactgattgtaaggaataagtattatacatggttttatctcgagtttttcttttttgtgttctcttaccataatttttgtttgctagagactgctgtgatcacttgccatatggcttagacttttgatggacctatgtaagctatgatatacattgatgtatgcaaagtttcttttacact

SEQ ID NO: 820 - DNA, 4330 bp, Zea mays
accccttgcgccgagatctaaaacacgccctctcctgtcatccattgcattttcctccccctctctctcgcgcgggggtcccgagtcccgactcgcccctccagatccaccaccaccacctcttctcctccagatccaccaccccatcctctccgcagctacagccaggtggagctcggcttagccgtcgacgtggctgggcacgccgggacgggaggatgctgaccaagttcgagacgaagagcaaccgggtgaaggggctgagtttccacccgcgtcggccatggatcctggcgagtctccacagcggggtgatccagatgtgggactaccgcatgggcaccctcctcgaccgcttcgacgagcacgacgggccggttcgcggcgtccacttccacgccactcagcctctcttcgtctccggaggtgatgattataagattaaggtctggaattacaagacgcaccgctgcctcttcacacttcatgggcatcttgactacattcgcaccgtgcaattccatcatgagtacccatggattgtaagtgctagtgacgatcagacaatccggatctggaactggcagtcacgcacctgtgtggctgtgctgactgggcataaccattatgtcatgtgtgcatctttccatcccaaagaagacctagttgtatcggcatcacttgatcagactgtgcgtgtttgggatattggagctctaaggaagaagacagtgtcacctgcggatgacatcctccgtctcacccagatgaacacagatctttttggaggtgttgatgctgtagtgaaatatgtcctcgaaggccatgaccgtggggtcaactgggcctcgtttcatcccactttgccgctcattgtttctggggcagatgaccggcaggtgaagctatggagaatgaacgataccaaggcttgggaagttgatactttaaggggtcacatgaataatgtgtcctgtgtgatgttccatgcgaagcaagacatcattgtgtctaactcagaagacaaaagcattcgcatttgggatgccacaaagagaactggtatccagacatttagacgggagcacgaccgtttctggattcttgctgctcaccctgaaatgaaccttcttgctgctggccatgacagtggcatgattgtgttcaaattggagagggaacgcccggccttctgcgttagtggtgacactgttttctatgtgaaagatcgatttctccgtttctttgagtactccacccagaaggaagttcaagtggctccaataagaagacctggatcggtcagcttgaaccagtcacccaggatgctgtcctacagcccaaccgagaatgctgtcttgatttgctctgatgctgacgggggttcatatgaactctacattgttcccaaggattctgctggcaggtctgattacttacaagaggcaaagaaaggggcgggtagttctgctgtttttgtagcgcgtaacaggtttgcagtccttgagaagagtagcaatcaagttttggtgaagaatcttaagaatgaaattgtgaagaaaagcccccttcccattgcgactgatgcaatatattatgctgggaccggtaacctgctttgcaaagctgaagatcgggtggccatctttgatcttcagcaaaggttagttcttggtgagcttcagacacctgctatcaaatacgttgtttggtccagtgatatggaatccgttgcactgctgagcaagcatgcagtggttatagctaccaagaagcttgtccataggtgcacactacatgaaaccatccgtgtgaaaagtggtgcctgggatgagaatggtgtgttcatttacactacactgaaccatatgaagtactgtcttcccaatggagacagtgggatcataaaaaccattgatgttcctatttacataacgagggttgttgggaacaatattttctgcttagatcgtgatgggaagaacaagctggttgcagttgatgcatcggagtacattttcaagcttgcccttctccgaaagcgctatgaccatgttatgagtatgattaagaactcccagttgtgtgggcaagctgtgatttcttatttacaacagaaaggtttcccagaagttgctctacactttgtgaaggatgagaagaccagatttaacttagctcttgagagtggaaacattcaaattgcagttgcttctgcgaaggagattgatgacaaggatcactggtacaagttgggaattgaggccctgaggcagggaaatgttggtatagtggaatatgcttaccaacgaacaaagaattttgagaggcttgcttttctgtatcttattaccggttacttggacaaggtgggcttcatgtgcaaaattgctggacagaacaacaatttgatgggacagttccacaatgcgttgtatcttggggatgccaagaagcgtgttgagatcttggagaatgctgggcagctgcctcttgcttatgttaccgctgccactcatgggctcacagaatttgctgagaggattgctgctgaattaggcgagaatgttccttctctacctgaaggaaaacccaaatcactactgatcccccctgcacctctcacagcctgtggtgattggccattgctgagggtaatgcgcggtatttttgaaggtggattggatgctactggaagggcggatcttgaggaagatgatgaagctgctggtgctgattggggtgatgaggagttggatattgttgatgcaagtgaggttgtggccaatggtgatggttttgatgtagaagagggtgaaccaaatgaggagggtggtgaggaaggtggctgggacctggaagatctggaacttccgcctgaaactgagactccaaaagctgttggcaatgctcgttctgctttatttgttgctcctacaccaggtattcctgtcagccaaatttggactcagagatcttctctggctggggagcaagcggctgcagggaactttgacacagcaatgaggttgcttagccgccagttgggtatcaagaactttgttccactaatgcccttgtttcttgatctgcacatgggcagtcatacatatttgcgtgggcttgctgccgctcctgttatatcagttgcagtagagaaaggttggaatgagtccgcaagtcctaatgtgaggggccctcctgcgcttgttttcagcttctcacggatggaagacagactcaaggctgcctacaaagccacaactgagggcaagttcccagaagcactgaggcagttccttagcatcttacataccattccagttatcgtggtggactcacggagagaagttgatgaggtgaaggagttaatcgagatagtgagggagtatgtccttggtctgaggatggaactcaagagaaaggaactgagggatgatgtgacccgtcaacaggagttggctgcttacttcacaaactgcaagcttcagagagttcatatgaggcttgtgctcgctagtgccatggctctttgcttcaagcagaaaaactatgcaactgcggcacactttgctaggatgcttcttgagaacagccctcaggaggcccaagcaaagaaggcccgacaggtgctgcaagcttgccatgacaaggacgattcccaccaactgaactatgacttcagaaatccattcgttgtttgtggcgctacgtatgttcctatctatcgtggccaaaaggatgtttcgtgcccatactgtggatcccgatttgttccttccatcgaaggacagctttgtaccatatgcgagcttgctgcggttggggcagatgcatcaggcctcctctgctctcctacacagtcgagataagcgatggtagttagaggtcccctatattctttctagcgtctcaagttccaagatttcatcatatatatgttaccagagagtttactgattgtaaggaataagtattatacatgctgttgagtttttcttttcttttttgttctgttaccataatttttgtttgccttaggggctgctgtcatcacctgccgtatggtttagatttctgatcgacttccaatatgctggaaattgatgtatgagatgtttctttcgttcttcaaaaatcttttttgggatgcctcagctttgcttttagtctggaggtgatctctgctcgctaggcgggctaatgtgacgtcaaaattcctcaagcctgaaagagtttacatgctagagtgccaatctcagatctcttagtacacacgaagagacatgggaattagtggtgagagttgacaagagttaaggtgagaaat

SEQ ID NO: 821 - DNA, 4330 bp, Zea mays
ccgagatctaaagcacctctctcccgtcgtcattgcattctcccccctctgcccttctctctccctctctcgcgagtcccgagtcccgactcgcacctccagatccacctcctcctccctcttccagatccaccatctcttctccgttcctctccgcagctacagctggggagctcagcttagccgccgccgtggccgggcacgccgggccgggaggatgctgaccaagttcgaaacgaagagcaaccgggtgaagggcctgagtttccacccgcgtcggccatggatcctggcgagtctccacagcggggtgatccagatgtgggactaccgcatgggcaccctcctcgaccgcttcgacgagcacgacgggccggttcgcggcgtccacttccacgccacacagccgctcttcgtctccggaggtgatgattataagattaaggtctggaattacaagacacaccgttgccttttcacacttcacggacaccttgactacattcgcactgtgcaattccatcatgagtatccatggattgtaagtgctagtgacgatcagacaatccggatctggaactggcagtcacgcacctgtgtggctgtgctgactgggcataaccattacgtcatgtgtgcatctttccatcccaaagaagacctggttgtatcggcatcacttgatcagactgtacgtgtctgggatatcggagctctgaggaagaagacagtgtcacctgcagatgacatcctccgtctcacccagatgaacacagatctttttggaggtgttgatgctgtagtgaaatatgtcctggaaggccatgatcgtggggtcaactgggcctcatttcatcccactttgccactcattgtttctggggcagatgaccggcaggtgaagctatggagaatgaatgataccaaggcttgggaagttgatactttaaggggccacatgaataatgtgtcttgtgtgatgttccatgcgaagcaagacatcatcgtgtcaaactcagaagacaaaagcattcgcatttgggatgccacaaagagaactggtattcagacatttagacgggagcacgaccgtttctggattcttgctgctcaccctgaaatgaaccttcttgctgctggtcatgacagtggcatgattgtgttcaaattagagagggaacgcccagccttctgcgttagtggtgacactgtcttctatttgaaggatcggtttctccggttctttgaatactccacccagaaggaagttcaagtggctccaataagaagacctggatcagtcagcttgaaccaatcacccaggacgctgtcctacagcccaactgagaatgctgtcttgatttgctctgatgctgatgggggttcatatgaactctacattgttcccaaggattctgctggcaggtctgattacttgcaagaggcaaagaaaggagctggtggttctgctgtttttgtagcgcgcaacaggtttgcagtccttgagaagagtagcaatcaagttttggtgaagaatcttaagaatgaaattttgaagaaaagcccccttcccattgcgactgatgcaatatattatgctgggaccggtaacctgctgtgcaaaggtgaagacagggtggccatctttgatcttcagcaaaggttagttcttggtgagctccaaacacctgctatcaaatatgttgtttggtctagtgacatggaatctgtggcactactgagcaagcatgcagtggttatagctagcaagaagcttgtccataagtgcacactgcatgaaaccatccgtgtgaaaagtggtgcctgggatgagaatggtgtgttcatttacactacactgaaccatatgaagtactgtcttcccaatggagatagtgggatcataaagactctcgatgttcctatttacataacgagggttgttgggaacaacattttctgcttagatcgtgatggaaaaaacaagctgattgcagttgatgcatcagagtacattttcaagctcgcccttctcagaaaacgctatgatcatgttatgagtatgattaagaactcccagctgtgtgggcaggctgtgatttcttatttacaacagaaaggtttcccagaagttgctctacactttgtgaaggatgagaagaccagatttaacctagctctcgagagtggtaacattcaaattgcagttgcttctgcaaaggagattgatgacaaggatcactggtacaagttgggaattgaagccctgaggcagggaaatgttggtatagtggaatatgcttaccaacgaacaaagaattttgagaggcttgcttttctgtatcttattactggttacttggacaaggtgggcttcatgtgcaaaattgctggacagaataacaatttgatgggacagttccacaatgcattgtatcttggggatgccaagaagcgggttgagatcctggagaatgctggacagctacctcttgcttatgttactgctgtcactcatgggctcacagaaattgctgagaggattgcttctgaattaggcgagaatgttccttctctgcctgaaggaaaatcccactcactactgatcccccctgcacctctcacagcgtgtggtgattggccattgcttagggtagtgcgcggtatttttgaaggtggactggatgctactggaagggcagatcttgaggaagacgatgaagctgctggtgctgattggggtgatgaagacttggatattgttgatgtaagtgaggtggtggcaaatggtggtgatggtgttgatgtagaagagggtgagccaaatgaggaggatggtgaggagggtggctgggacctggaagatctggaacttccgcctgaaactgagactccaaaagctgttggcaatgctcgatctgctttattcgttgctcctacaccaggtattcctgtcagccaaatttggacccagagatcttctctggctggggagcaagcggcagcagggaacttcgacacagcaatgaggttgcttagccgccagttgggtatcaagaactttgttccactgaagcccttgtttattgatctgcacatgggcagtcatacatatatgtgtgcgtttgccgctgcgcctgttatatcagttgcagtagagaaaggttggaatgagtctgcaagtcctaatgtgaggggccctcctgcacttgttttcagcttctcacaaatggaagatagactcaaggctgcctacaaagccacaactgagggcaagttccccgaagcactgagacagttccttagcatcttgcataccattccagttattgtggtggattcgcggagagaagttgatgaggtgaaggaattaatcgagatagtgagggagtatgttcttggtctgaggatggaactcaagagaaaggaattgagggatgatgtgacccgtcagcaggagttggctgcttacttcacgaactgcaagcttcagagagttcatatgaggcttgtgctcgcaagcgctatggctctttgcttcaagcagaaaaactatgcaactgcagcacactttgcaaggatgcttcttgagaatagccctcaggaggcccaagcaaagaaggctcgacaggtgctgcaagcctgccaggacaaggacgattctcaccaactgaactatgacttcagaaatccattcgttgtttgtggtgctacatatgttcctatctatcgtggccaaaaggacgtttcctgcccatactgtggatcccgatttgttccttccatcgaagggcagctttgtaccatatgtgagcttggtgcggttggggcagatgcttcaggtctcctctgctctcctacacaatcgagataagccatggtagttagagcccccctatattctttctagtgtcttaagttccaagacttaatcatatattttaccagggagtttagtgattgtaaggaataagtattatacatgtttttatcaagttttttttttcttttttcgtgttctgttaccataatttttgtttgcctagagggtgctgtcatcacctgccgtatggtttagacttctgatcaactttggaagctatgctggaaattgatgtatgagatgtctctttcactctttaaaattctttttttgggatgtctctgcgttgctttttagtttatagtctggaggtattctttgctcggtacgcgggctaatgtgctttatgtcaaaatacattaagcatggaagagtttacctgctagggtgccaatcccatctaaagagcagtgtcttcagaaaaacttgatattatatgaactgtgg

SEQ ID NO: 822 - DNA, 4407 bp, Sorghum bicolor
cagcaaataaacctcattcagatcggaggctaggctaggctacgctaggctacgctagttggtctggtgcggctgcacagcaccaacctgcagtttcgctgggatctcaattctcatctgggagagggcgggcgagatccatctcatctccgctccctccgcttcctcgtccggcctcttcctccgatccaccgtcccccccacccgccagggccgccgccgctgccgagagcgagcggaggtctccctcctcggacgagggaggaagatgctcaccaagttcgagaccaagagcaaccgggtcaagggcctcgccttccacccgcgccgcccatggatcctgtccagcctccacagcggcgtcatccagatgtgggactaccgcatgggcaccctcctcaaccgcttcgacgagcacgacgggcccgtcagaggcgtccacttccacgccacgcagccgctcttcgtgtccggaggtgatgattataagattaaggtctggaactacaagactcaacgctgcctcttcacacttcatgggcaccttgattacattcgcactgtgcaattccaccatgagtgcccatggatcgtaagtgctagcgacgatcagacaatccggatctggaattggcagtcacgcacatgtgtggccgtgctaactgggcataaccactatgtcatgtgtgcctccttccatcctaaagaggatctggttgtatcggcctcgcttgatcagactgtacgtgtctgggatattggggccctgaggaagaagtcagcatcacctgcagatgacatcctccgtctcactcagatgaacacggatctatttggaggcattgatgctgtagtcaaatatgtcttggaaggccatgaccgtggggtcaactgggcctcatttcatcccagtttgcctctcattgtttctggggcggatgaccggcaggtgaagatatggagaatgaatgataccaaggcttgggaagttgatacattgaggggccacatgaataatgtttcttgtgtgttgttccatgcgaagcaagacatcatcgtgtctaactcagaagacaaaagcattcgcatctgggatgccacaaagagaactggcattcagacatttaggcgggaacatgaccgtttctggatccttgctgctcaccctgaaatgaaccttcttgctgctggtcatgacagtggcatgattgtgttcaaattagagagggaacgcccagccttctgtgttagtggtgacacagttttctatgtgaaggatcggtttctcaggttctttgaatactccacacagaaggaagttcagttggctccaataagaagacctggatcagtcagcttgaaccagtcgcccaggacactatcgtatagtccgaccgaaaatgctgtcttgatttgctctgatgctgatgggggttcatatgaactctacattgttcccaaggattctgctggcaggtctgattacttgcaagaggcaaagaagggagctggtggttctgctgtttttgtggcgcgcaacaggtttgcggtccttgagaggagtagcaatcaagttttggtgaagaatctgaagaatgaaatcatgaagaaaagcccccttcctattgcgacggatgcaatatattatgctgggacaggtaacttgctatgcaaggctgaagaccgggtggccatctttgatcttcagcaaaggctagttctcggagagctacagacacctgctgtcaaatatgttgtttggtccagtgatatggaatctgttgcactcctgagcaagcatgctgtggttatagctagcaagaagcttgtccatcaatgcacactgcatgagaccacccgtgtgaaaagtggtgcctgggatgagaatggtgtgttcatctacactacactgaaccatatgaagtactgccttcctaatggagacagtgggatcataaaaacccttgatgttcctatttacgtgacaagggttattgggaacaacattttctgcctagatcgtgatggaaagaacaagctgattgcagttgatgcatcagagtacatttttaagctagcccttctcagaaaacgctatgatcatgttatgagtatgattaagaactcccagctgtgtgggcaggctgtgatttcttatttacaacagaaaggttttccggaagttgctctgcactttgtgaaggatgagaaaaccagatttaacttagctcttgagagtggtaacattcaaattgcagttgcttctgcaaaggagattgatgacaaggatcactggtacaggttgggaattgaggccctgaggcaaggaaatgttggtattgtggaatatgcataccaacgaacaaaaaattttgagaggcttgcttttctgtatctcattactggttacttggacaaggtgggcttcatgtgcaaaattgctggacaaaataataatttgatgggacaattccacaatgcattgtatcttggggatgctaagaagagaattgagatcttggaaaatgctgggcagctacctcttgcttatgttcttgctgtcactcatgggctcactgaaattgctgagaggattgctgctgaattaggcgagaatgttccttgtctgcctgaaggaaaatcacactcgctactgattccccctgcacctctcacagcctgcggtgattggccattgctgagggtaatgcgtggtattttcgaaggtggactggatgctactggaagggcagagcttgaggaagatgatgaagcttctggtgctgactggggtgatgaagacttggatattgttgatgcaagtgaagtggtggcaaatggtggtgattattttgatgcggaggagggtgaaccaaatgaggaggatggtgaggaaggtggctgggacttggaagatctggaacttccacctgatacagagactccaaaatctgctggcaatgctcgctctgctgtatttgtcgctccaacagcaggcatccctgtcagccaaatctggacacaaaaatcttctctggctggggagcatgcggctgcagggaactttgacacagcaatgaggttgcttagccggcagttgggcatcaagaactttgctccgctgaagcccttgtttcttgatctgcatatgggcagtcattcatatctccgcgcacttgctgctgctccggttatatctgttgctgtagagaaaggttggaacgagtccgcaagtcctaatgtaagaggccctcctgcacttattttcagtttctcacaaatggaagacagactcaaggccgcctacaaagctacaactgagggcaagttcccagaagcactgaggcagttccttaacatcttacataccatccctgtaatcgtcgtagattcacggagagaagttgatgaagtgaaggaattaatcgagatagtgagggagtatattcttggtctgaagatggaactcaagagaaaggaattgagggatgatgtgacccgccaacaggagttggctgcttacttcacaaactgcaagcttcagagaattcatatgaggcttgtgcttgcaagcgccatggctctttgcttcaagcagaaaaactacgctactgcgaaacactttgcaaggatgcttcttgagaacagccctcaagaggcccaagcaaggaaggctcgacaggtgctgcaagcttgccaggataaggatgattctcaccaactgaactatgacttcagaaatccatttgttgtttgtggcgctacatatgttcctatctaccgcggccaaaaggatatttcttgcccatattgtggatcccggtttgttccttccatcgaagggcagctttgtaccatatgcgagcttgccatagttggggcagatgcttcaggtctgctctgctcccctacgcagctgaagtaaacgatgttagcttacctcctgctgtccgcatcttcagtagtaccatcttgcaatgatgtttggatgtctcgatctggaggggatcaatcaattcaccaaacttatcttcgcttcagctcttcagcctccatggcattcctaattttggtctggaggggatcaattcatcttgttcttatctcaactcaattatcgtagctatgttttgtatacttattgatgtacgatagctgatgtgaatgctgggtcaccgaacccaattttcttatggcatatgccatcttgatctctacaatttcagtatattgcacagtagattgtactcaagttggcattttaaaattgaagtgattgtaccaaggattgggactagtgttttaacactgaatttgtgaatgatacacaactttttatcactgaattggtgggtaacaaattggaatgtcaatatgttttgtccagttaatataatggccaagtca

SEQ ID NO: 823 - DNA, 4311 bp, Zea mays
gcccctggcactcgctgcacctgcagtttccttctccgggatctcaattctcatctgggagagggcgggcgagatccattccagtcgcccccattcactccccttcctcgtccgtcctcttcctccctccgatccaccgctccccctacccgccgggccgccgctacctcgagcgagcggagatctctctcctcgaacgggggggaggaagatgctcaccaagttcgagaccaagagcaaccgggtcaagggcctcgccttccacccgcgccgcccatggatcctgtccagcctccatagcggagtcgttcagatgtgggactaccgcatgggcaccctcctcaaccgcttcgacgagcacgacgggcccgtcaggggcgtccactttcacgccacgcagccgctcttcgtgtccggaggtgacgattacaagattaaggtctggaattacaagactcaacgctgcctattcacacttcatgggcacctcgactacattcgcactgtgcaattccaccatgagtgcccatggatcgtaagtgctagcgacgatcagacaatccggatctggaattggcagtcacgcacatgtgtggccgtgctaactgggcataaccactatgtcatgtgtgcctccttccatcccaaagaggatctggttgtatcggcatcacttgatcagaccgtgcgtgtctgggatattggggctctgagaaagaagtcagcatcacctgccgatgacatcctccgcctcactcagatgaacacagatctatttggaggtattgatgctgtagtcaaatatgtcttggaaggccatgaccgcggggtcaactgggcctcatttcatcccactttgcctctcattgtttccggggcagatgaccggcaggtgaagatatggagaatgaacgataccaaggcttgggaagttgatacgttgaggggccacatgaataatgtgtcttgtgtgatgtttcatgcgaagcaagacatcatcgtgtctaactcagaagacaaaagcattcgtgtttgggatgccacaaagagaactggcattcaaacatttaggcgggaacatgaccgtttctggattcttgctgctcaccctgaaatgaaccttcttgctgctggtcatgacagtggcatgattgttttcaaattagagagggaacgcccggccttctgtgtcagtggtgacacagttttttatgtgaaggaccggtttctaaagttctttgaatactccacacagaaggaagttcagttggctccaataagaagacctgggtcagtcagcttgaaccagtcacccaggacactatcgtatagtccaactgaaaatgctgtcttgatttgctttgatgctgatgggggttcatatgaactctacattgctcccaaggattctgctggcaaggctgattacttgcaagaggcaaagaagggagctggtggttctgctgtatttgtggcacgcaacaggtttgcagtccttgagaggagtagcaatcaagttttggtgaagaatctgaagaatgaaatcatgaagaaaagcccccttcctattgcgacagatgcaatatattatgctgggacaggtaacttgctgtgcaaggctgaagaccgggtggccatctttgatcttcagcaaaggctagttcttggtgagctacagacacctgctgtcaaatatattgtttggtccagtgatatggaatctgttgcattcctgagcaagcatgttgtggttatagccagcaagaagcttgtccatcaatgcacactgcatgaaaccacccgtgtgaaaagtggtgcttgggatgagaatggcgtgttcatctacaccacactgaaccatatgaagtactgccttcccaatggcgacagtgggatcataaaaacccttgatgttcctatttacataacaagggttatcgggaataacattttctgcctagaccgtgatggaaagaacaagctgattgcagttgatgcaacagagtacattttcaagctcgctcttctcagaaaacgctatgatcatgttatgagtatgatcaagaactcccagttgtgtgggcaggctgtgatttcttatttacaacagaaaggttttccagaagttgctcttcactttgtgaaggatgagaagaccagatttaacttggcccttgagagtggtaacattcaaattgcagttgcttctgcaaaggagattgatgacaaggatcactggtacaggttgggaattgaggccctgaggcaaggaaatgttggtatcgtggaatatgcataccaacgaacaaaaagttttgagaggcttgcttttctgtatctcattactggttacttggacaaggtgggcttcatgtacaaaattgctggacagaataataatttgatgggacaatttcacaatgcattgtatcttgggcatgttaataagagagttgagatcttggaaaatgctgggcagctgcctcttgcttatgttcttgctgtcacacatgggctcactgaaattgctgagaggattgctgctgaattaggcgagcatgttcctttgctgcctgaaggaaaatcacactcgttactgatcccccctgcacctctcacagcctgtggtgattggccattgctgagggtagtgcgtggtatttttgaaggtggactggattctactggaagggcagagcttgaggaagatgatgaagcttctggtgctgactggggtgatgaggacttggatattgttgatgcaagtgaggtggtggcaaatggtggcgattattttgatgcagagggtgaaccaaacgaggaggagggtgaggaaggtggctgggacctggaagatctggaacttccacctgatacagagactccaaaatctgctggcaatgctcgctctcctgtatttgtcactccaacagcaggcatccctgtcagccaaatttggactcaaaaatcttctctggctggggagcatgcggctgcagggaactttgatacagcaatgaggttgcttagccgacaattgggcatcaagaactttgctccgctgaagcccttgtttcttgatctgcatatgggcagtcattcatatctgcgtgcccttgctgctgctccagttatatcagttgctgtagagaaaggttggaatgagtccgcaagtcctaatgtaagaggccctcctgcacttattttcagcttctcacaaatggaagacagactcaaggctgcctacaaagccacaactgagggcaggttcccagaagcactgaggcagttccttagcatcttacatacgattcctgtaatcgttgtagactcacggagagaagttgatgaagtgaaggaattaattgagatagtgagggagtatattcttggtctgaagatggaactcaagagaaaggaattgagggatgatgtgacccgccaacaggagttggccgcttacttcacaaattgcaagcttcagagaattcatatgaggcttgtgctttctagcgccatggctctttgcttcaagcagaaaaactatgctactgcagcacactttgcaaggatgcttcttgagaacagccctcaagaggctcaagcaaggaaggctcgacaggtgctgcaagcttgtcaggataaggatgattctcaccaactgaactatgactttagaaatccatttattgtttgcggtgctacatatgttccaatctaccgtggccaaaaggatatttcttgcccatactgtggatcccggtttgctccttccatcgaagggcagctttgtaccatatgtgagcttgccatagttggggcagacgcctcaggcctggtctgctcccctacgcagatgaagtagacgatgttatcttacctcctgctgtccgcatcttcagcagcaccatctcgcaatgatgcctggatgtcttgatttggaggggatgaaacaattcaccgaacaccaaacttatcaacgccctccatgtcattccaaattttcgtctggaggggattcatcttggtcttgtctcaattatcgcagctgcgttttcagctctattttgtaaacatattgatgtacgatagctgatgtgagtgctggttcactgaaacgattttctgttatggcatatgccattttaatctctacagtttcagtatattgcacagtagattgtactcaaacatttaaaatttgattgtaccaaggattgagaccagtgttttaacactgaaaaattatgattgatacacaaccttttgtcactgaattgatgggtagtaattgcaatatcaatatatttt

SEQ ID NO: 824 - DNA, 3864 bp, Hordeum vulgare
tcgacgagcacgacggccccgtccgcggcgtgcacttccacgccacccagcccctcttcgtctccggaggtgacgattacaagattaaggtgtggaattacaagacacaccgctgcttgtttacgcttactgggcatctcgactacattcgtactgtgcagttccaccatgagtacccatggatcgtaagtgccagcgatgaccagacaatccgtatctggaactggcagtcacgtacttgtgtggctgtgctcactgggcataatcactatgtcatgtgcgcgtccttccaccccaaggaggacctggttgtgtcagcatcgctagatcagactgttcgtgtttgggatattggtgccctgaggaagaagacggtgtcacctgcagatgacatcatgcgtctcactcagatgaacactgatctgtttgggggcgtcgatgcggttgtgaaatatgtcttggaaggccatgaccgtggtgtcaactgggcatccttccatcccacattgccactcattgtttctggggcagatgaccggcaagtgaagctgtggagaatgaatgataccaaggcttgggaagttgatactttgagggggcacatgaataatgtgtcctgtgtgatgttccatgcgaagcaagacatcattgtgtccaactcagaggacaaaagcattcgcatctgggatgccacaaagcgaaccggcattcagacatttaggcgggaacatgaccgtttctggatccttgctgcccaccctgaaatgaatcttcttgctgctggtcatgacagtggcatgattgtgtttaaattagagagggaacgcccagctttcagcgtgagtgctgatactgtgttctatgtgaaggacagattcctccggttctttgagtactccacccagaaggaagttcaggtggctccaataagaagaccaggatccgtcagcttgaaccagtcacccaggacactatcttatagtccaacggaaaatgctgtgttgatttgctctgatgtggacggcggctcatatgatctgtacattgttcctaaggattctgctggcagggctgattatttgcaagaggcaaagaagggagctggtggctcggctgtttttgtggcacggaataggtttgctgtccttgagaagagtagcaatcaagttttggtgaagaatcttaagaatgaaattgtgaagaagagtcctcttcctattgcgactgatgcaatttattatgctggaactggtagtttgttgtgcaaagctgaagatcgtgtgaccatctttgatctacaacaaaggctagttcttggtgaactccaggcacctggtgttaaatatgtagtttggtccggtgacatggagtatgttgcactgctgagcaagcatgcagtagttatagctagcaagaagcttgtccatcgctctacactgcatgaaaccattcgtgtgaaaagtggtgcctgggatgagaacggtgtttttatttactctactttgaaccatatcaaatactgtcttcccaatggagacagtgggatcataaagactcttgatgtccctgtttacataacaagggttattgggaacaatattttctgtcttgatcgtgatggaaagaacaagctgataacagtcgatgcttctgaatacattttcaagctcgcccttctccggaaacgttatgaccatgttatgagtatgattaagagctcacagctctgtgggcaggcagtgatttcatatttgcaacagaaaggatttccagaagttgctctccactttgtgaaagatgagaagacaagatttaatctagctcttgaaagtggtaacatccaaatcgcagtggcttctgcaaaagagattgatgacaaggatcactggtacaggttgggaattgaggccttgaggcaggggaatgttggtattgtggaatatgcataccagcggacgaagaattttgagaggctgacttttctgtatcttattactggttacatggacaaggtgggcttcatgtgcaaaattgctggacagaataacaatttgatgggtcagttccacaatgcattatatcttggggatgctaggaagcgagctgagatcctggagaatgctggacagcttcctctagcctatgttactgctgccactcatgggctcactgaaattgctgaaaggcttgctgctgagttgggtgagaatgttccttctctacccgagggaaaaactcgctcacttttaattccgccggcacctctcatatccagcgttgattggccattgctccgggtgatgcgtggcatatttgagggtgggctggatgctactgggagagcagaagtagaggaagacgatgaagctgctggtgctgactggggtgatgaggacttggatattgtggatgcaagtgatgcattagcaaatgggggtgatggttttgatcctgaggagggtgaagcgaatgaggaggatggcgaggaaggtggttgggatcttgaagatctggaattgcctgaatcagagacccccaaagctgctggaaatgctcgctctactgtgtttgttgctcctgcaccaggaatgcctgtcagccaaatttggactcagaaatcttcccttgccggggagcatgcagcagcaggaaactttgacactgcaatgaggttgctcagccgccagttgggcatcaagaactttgctcccctgaagcccttgtttcttgatctgcacatgggcagtcattcatatcttcgcgcacttgcaactgctcccgttatatcaattgctgttgagaaaggctggagtgagtcatcgagtcctaacgtgaggggccctcctgcactaattttcaccttctcacaaatggaagacagactcaaggcagcctacaaagccacaaccgaggggaagttcccagaagcgctgagacaattcctcagcatcttgcataccattccccttattgtcgtcgactcacggagagaagttgatgaagtgaaggagttgatcgagatagtgagggagtatgttcttggtctaagaatggaactcaagaggaaggaactgaaggacaatgtcaaccggcaacaggagctggcggcctacttcaccaactgcaagctccagagggttcacatgagactcgtgctctcgaacgccatggctctatgctacaagcagaagaacttcgcgaccgccgagcactttgcgaggctgctcctcgagaacagccccaacgaggtccaggcgaagaaggctcggcaggtgcagcagcagtgcaacggcaagcaggacagccatgagctcaactacgactacagaaatccgttcgtcgtctgtggctcgacgtatgtccccatctaccgcggccaaaaggacatctcgtgcccttactgcggatcccggtttgttcctgccacggaagggcagctttgtaccatatgcgagctggcggtggtcggcgcggacgcctcgggcctcctgtgctcccctacacagacgagatgagcagaagaggctagtcgttagagctcccctatattctttctagtctcgtaaagcctgtcttgtcttatattttaccaggaggtttactgattgtgtaaggaataagtataatagtacatggttttgtcggagttcttctcatacttttttctatctccataccatatacccccggtttttgcttgccttgaggatgctgttatgcttgagacttatcatgatcaactcatgcaaacttttcctaccccgttgatgtatcatagtttttctcacagtgagattatatgttgatgccaggttatatatgtgagtaatacatgaagtctatcgatgagttacgtatgcaaat

SEQ ID NO: 825 - DNA, 3777 bp, Avena sativa
ctcctcgaccgcttcgacgagcacgacggtcctgtccgcggcgtgcacttccacgccacccagcccctcttcgtctccggaggtgacgattacaagattaaggtgtggaattacaagacacaccgctgcttgtttacgcttactggccacctcgactacattcgtaccgtgcagttccaccatgagtacccatggattgtaagtgctagtgatgaccagacaatccggatctggaactggcaatcacgtacttgtgtggctgtgctgaccgggcataatcactatgtcatgtgtgcgtctttccaccccaaggaagacctggttgtgtcagcatcactagatcagactgttcgtgtttgggatattggtgctctgaggaagaagacggtgtcacctgcagatgacatcatgcgtctcactcagatgaacacagatctatttgggggtgtcgatgcggttgtgaaatatgtcctggaaggccatgaccgtggtgtcaactgggcctcatttcatcccacgctgccactcattgtttctggggcagatgaccggcaagtgaagctgtggagaatgaatgataccaaggcttgggaagtcgatactttgagggggcacatgaataatgtgtcctgcgtgatgttccatgcgaagcaagacatcattgtgtccaactcagaagacaaaagtattcgcatctgggatgccacaaagcgcactggtattcagacatttaggcgggaacatgaccgtttctggattcttgctgctcaccctgaaatgaatcttcttgctgctgggcatgacagtggcatgattgtgtttaaattagagagggagcgtcctgctttcagtgtcagtgctgatactgtattctatgttaaggacagattcctccggttctttgagtactccacccagaaggaagttcaggtggctccaataagaagaccaggatcagtcagcttgaaccagtcacccaggacactatcttatagtccaacagaaaatgctgtgttgatatgctcagatgtggatgggggctcatatgatctctacatcgtccctaaggattctactggcaatttgcaagaggcaaagaagggagctggtggttcagctgtttttgtggcacggaataggtttgctgtccttgagaagagtagcaatcaagttttggtgaagaatcttaagaatgaaattgtgaagaaaagtcctcttcctattgccactgatgcaatttattatgctgggactggtaatttgttgtgcaaagctgaagaccgtgtgaccatctttgatctacagcaaaggctagttcttggtgaacttcaggcagctggtgttaaatatgttgtttggtccactgacatggagtctgttgcattgctgagcaagcatgcagtagttatagctagcaagaagcttgtccatcgctctacactgcatgaaaccattcgtgtgaaaagtggtgcatgggatgagaatggtgtgtttgtttactctaccctgaaccatataaaatactgtcttcccaatggagatagcgggatcataaagacccttgatgttcctatttacataacgagggtgattgggaacaacattttctgtctagatcgtgatggcaagaacaaactgataacagtcgatgcttcagaatacattttcaagcttgcccttctccggaaacgttatgaccatgttatgagtatgattaagagctcacagttgtgtggacaggcagtgatttcatatttacagcagaaagggtttccagaagttgctctccactttgtgaaagatgagaagacaagatttaatctagctcttgaaagtggtaacatccaaattgcagttgcatctgcaaaagagattgatgacaaagatcactggtacaggttgggaattgaggccctgaggcaggggaatgttggtattgtggaatatgcataccagcggacaaagaattttgagagacttgcttttctgtatctcattactggttacctggacaaggtgggcttcatgtgcaaaattgctggacagaataacaatttgatgggtcagttccacaatgcattgtatctcggggatgctaggaagcgagctgagatcctggagaatgctgggcagctacctcttgcctatgctactgctgccactcatgggctcactgaaattgctgataggcttgctgctgaattgggtgagaatattccttctctacctgcaggaaaatctcgctcacttttgattccccctgcacccctcatatccagcgttgattggccattgctccgtgtgatgcgtggtacttttgaggttggattggatgctactgggagagcagaagttgaggaagatgatgaagctgctcctgctgactggggtgaggaggacttggatattgtggatgcaagtgatgcagtgccaaatggtggcggtggttttgatcctgaggagggtgaagcaaatgaggaggatggtgaggatggtggctgggatcttgaagatctggaattgccacctgaagcagatacaccaaaagctgctggaaatgctcgctccagtgtgtttgttgctcctacaccaggcatgcctgtcagccaaatttggacacagaaatcttcccttgctggcgagcatgcagcagctgggaactttgacactgccatgaggttgcttagccgccagttcggtatcaagaactttactcctctgaagccattgtttctcgatctccatatgggcagccattcgtatcttcgtgcacttgcagctgctcccgttatatcagttgctgttgagaaaggttggagtgagtctgcaagtcccaatgtgaggggccctcctgcactagttttctccttctcacaaatggaagacagactcaaggcagcctacaaggccacaaccgagggtaagttcccagaagcactgaggcaattcctcagcatcttgcataccatccctcttattgtggtggactcacgaagagaagtcgatgaagtgaaggagctgatcgagatagtgagggagtatgttcttggtctaagaatggagctcaagagaaaggaattgaaagacaatgtcaaccggcaacaggaattggcggcctacttcactaactgcaagcttcagagggttcacatgaggcttgtgctctcgaacgccatggctctatgctacaagcagaagaactttgcgaccgcggagcatttcgcgaggctgctcctcgagaatagcccgaacgaggtccaagcgaagaaggctcggcaggtgcagcagcagtgcagcggcaagcaagacagctatgagctgaactacgactacagaaatccgttcgtcgtctgcggctctacgtacgtccctatctaccgtggccagaaggatatctcctgcccatactgttcgtcacggtttgttccttcggtcgaagggcagctttgtaccatatgcgagctggctgtggtcggcgcagacgcctcgggcctcttgtgctgccctacacagcagagatgaaaacggaactagttagagctcccctatattctttctagtctcgtaaagtctgtcttatattttaccaggaggtttacagattgtaaggaataagtatattatccatgggttttgttgagtttttcttgactttatctctcagtctgccccttttttgtttgccttgaggatgctgttacacctgttaatgcttatatggaatgttggttgactcatgcaagctttgctcatccattgatctatcatcgttttgtg

SEQ ID NO: 826 - DNA, 4243 bp, Brachypodium distachyon
agcagcacgcagatcttcctctcctcttctcttctcttctcttccttcttctcccccagccagccagccagatccaaatcaccaaactgacccaacctagcccagatccaccctcctcccccacctctccctcctcctgccggccggtgggtggagggccggccgtccatccaaggcggcggcggcggacggcgggcgagatgctgaccaagttcgagaccaagagcaaccgggtcaagggcctctccttccacccgcgccgcccatggatcctcgccagcctccacagcggggtcgtccagatgtgggactaccgcatgggcacgctcctcgaccgcttcgacgagcacgacggccccgtccgcggcgttcacttccacaagacccagccgctcttcgtctctggaggtgacgattacaagattaaggtgtggaactacaagacacatcgctgcctcttcacactccatgggcaccttgactacatccgcacggtccagttccatgacgagcatccatggatcgtcagtgctagcgatgaccagacaatccgtatttggaactggcagtcacgcacctgtgttgccgtgttgacagggcataatcactatgtcatgtgtgcctccttccatcccaaggaggacctggtcgtgtcagcatctctggatcagaccgtcagggtgtgggatattggggcgctcaggaagaagtcgtcgtccccagcggatgacattatgcgtctcacgcagatgaacactgatttatttggaggcattgatgctgttgtcaagtatgtcctggagggtcatgatcgtggggtcaactgggcctcatttcatcccacgctgccacttatcatttctggggcagatgaccggcaagtgaaactgtggagaatgaatgatacaaaggcatgggaggttgatactctgagaggtcacatgaacaatgtgtcatgtgtactgttccacgcgaagcaggacatcattgtatccaactcagaagacaagagcatccgtgtttgggatgccacaaagagaactggtatccagacattcaggcgagagcatgaccgcttctgggtccttgctgctcaccctgaaatgaatcttcttgctgctggtcatgatagtggcatgattgtatttaagctggaaagggaacgcccggctttctccgtgagtggtgatacagtgttctatgtgaaggaccgcttcctccgtttctacgagtactcaacacagaaggaggtccaggtggccccgataaggaggcctggatcagtcagcttgaatcagtcaccaaggacgttatcatatagcccaactgagaatgctgtcttgatctgctctgatgtggatgggggctcatacgagctttacattgttcctaaggactctgctggcagggctgattatttgcaggatgcaaagaagggtgctggtggttctgcagttttcatagcacggaaccggtttgcagtcctggagaagagcagcaaccaggttttggtgaagagccttaagaatgagatcgtgaagaaaagtcctcttcctattgcaactgatactatttactatgctggaactgggaacattttgtgcaaagctgaagacagagtggccatctttgatctgcagcagcggcttgttattggtgaactccaggcgtctgccgttaagtatgtggtttggtccagtgatatggagtccgttgcactgctcagcaagcatgccgtagtcattgcaaacaagaagcttgtccatcgctgcacacttcacgaaaccatacgtgtaaagagtggtgcctgggatgaaaatggtgtgttcatatattccactttgaaccatatcaagtactgccttcctaatggggacagtggtattatcagaactcttgatgttcctatttacattaccaaagtaactgggaacaacatttgctgtctggaccgtgatggaaagaacaagataataatagttgatgcatctgaatacattttcaagctggcccttctacggaaacgctatgatcatgtcatgagtatgataaaaaactcacagctttgtgggcaagcagtcatttcttatttacagcagaaagggtttccagaagttgctctccactttgtgaaagatgagaagaccagatttaacctggctcttgagagtggaaacatccaaattgctgttgcttctgcaaaggagcttgatgacaaggatcactggtacaggttgggaattgaggctctgaggcaagggaatgttggtatagttgaatatgcataccagaggacaaagaattttgacaggctggcttttctctatctgctaactggttacttggacaaggttggctttatgtctaagatagccgggcagaataacaatttgatgggccagttccacaatgcattgtatcttggggatgtcaggaaaagagttgagatcttggagagtgcaggacaggtacctcttgcatatgtaactgcagccacccatgggctcactgaaattgcagataggcttgctagtgaattgggagaaaatgtgccttctctacctgaagggaaagatagatcacttttaattcctcctgcacctctcacagcctgtggtgattggccattgttgagggtgatgcgtggtatttttgagggtggactagatgctactgggagggcggagcatgaggaagacgatgaagatattgctggtgattggggtgatgaagaccttgaaattgttgatgtaagtaatgtggttgaaaatggagatgttactggccatgttgagggaagtgaagcaaatgaagaggatggggaagaggaaggtggctgggaccttgaagacctggagttaccagaggcagagacaccaaaagctactggtccagcccgttccactttgtttgtggctcctacaccaggcatgcctgtcagccaaatttggactcagaaatcatctcttgctggggagcatgctgcagcggggaattatgacactgcaatgcgattgctaagccgccagttgggcatcaggaactttgctcctttgaagtccttgtttcttgatgcacacatgggtagtcatacctttctgcgtgcatttgcaagtgctccagttatacctgttgctgtggagaagggctggagtgaatctgctagtcccaatgtgaggggcccacctgcacttgtgtttagcttctctcaaatggatgacaagcttaaggctgcatataaagccacaacagagggtaaattcccagaagcactgaggcagtttcttaacatcctatataccatcccactccttgttgtggactcgaggagagaagttgatgaagtgaaggagcttattgagatagtgagagagtatgttcttggtcttaggatggaagtcaaaaggaaggaactgaaagatgatgctacccgtcaacaggagttggctgcatacttcactaactgcaagctgcagaaggttcatatgcgtcttgtcctcaccagtgccatgggtctttgtttcaagggtggaaactatgccactgcagcaaactttgcacgcatgcttttggaaaacagcccaaatgaggcccaagcaaagaaggctcggcaggttctgcaggcttgtggtgacaggaaagatgggcatcagctgaactacgacttcagaaatccgtttgttgtgtgcggagcaacctttgttccaatataccgtgggcagaaggatatttcctgcccatactgcgcgtctcggtttgtgccctccgtcgaaggtcagctttgcagcatatgcgagctctcggtggttggagcggacgcttcgggcctcctatgctcccctacacaatcgagataaatggcaacggtggcttcaccttgtgtttatgtctgtatctccagttcgaggaccatctgttatcgttatatcgttatattctaccagagatttcattaccaacttgtgaggaataagtatagtaattggttgtcttgagtcatttcttcctctgtccttgattttggtcttatacggctttagacctcattttttgccctcgaggaacaagtataggaataactgttttcgttgtattctatcagtcagatatgctttgtgtgtttggtttctgtttattgttctgcgtttggttggtatgcaaccctgtatacaattacagggtttattctggtgccatgtcggtttttgcccagacaacaacaccagcaatgctgctgtgacca

SEQ ID NO: 827 - DNA, 4663 bp, Brachypodium distachyon
agcagcacgcagatcttcctctcctcttctcttctcttctcttccttcttctcccccagccagccagccagatccaaatcaccaaactgacccaacctagcccagatccaccctcctcccccacctctccctcctcctgccggccggtgggtgggtgcgcggctgctcaggttgtttaggagggtcccgtcgccggagaagaagagggccggccgtccatccaaggcggcggcggcggacggcgggcgagatgctgaccaagttcgagaccaagagcaaccgggtcaagggcctctccttccacccgcgccgcccatggatcctcgccagcctccacagcggggtcgtccagatgtgggactaccgcatgggcacgctcctcgaccgcttcgacgagcacgacggccccgtccgcggcgttcacttccacaagacccagccgctcttcgtctctggaggtgacgattacaagattaaggtgtggaactacaagacacatcgctgcctcttcacactccatgggcaccttgactacatccgcacggtccagttccatgacgagcatccatggatcgtcagtgctagcgatgaccagacaatccgtatttggaactggcagtcacgcacctgtgttgccgtgttgacagggcataatcactatgtcatgtgtgcctccttccatcccaaggaggacctggtcgtgtcagcatctctggatcagaccgtcagggtgtgggatattggggcgctcaggaagaagtcgtcgtccccagcggatgacattatgcgtctcacgcagatgaacactgatttatttggaggcattgatgctgttgtcaagtatgtcctggagggtcatgatcgtggggtcaactgggcctcatttcatcccacgctgccacttatcatttctggggcagatgaccggcaagtgaaactgtggagaatgaatgatacaaaggcatgggaggttgatactctgagaggtcacatgaacaatgtgtcatgtgtactgttccacgcgaagcaggacatcattgtatccaactcagaagacaagagcatccgtgtttgggatgccacaaagagaactggtatccagacattcaggcgagagcatgaccgcttctgggtccttgctgctcaccctgaaatgaatcttcttgctgctggtcatgatagtggcatgattgtatttaagctggaaagggaacgcccggctttctccgtgagtggtgatacagtgttctatgtgaaggaccgcttcctccgtttctacgagtactcaacacagaaggaggtccaggtggccccgataaggaggcctggatcagtcagcttgaatcagtcaccaaggacgttatcatatagcccaactgagaatgctgtcttgatctgctctgatgtggatgggggctcatacgagctttacattgttcctaaggactctgctggcagggctgattatttgcaggatgcaaagaagggtgctggtggttctgcagttttcatagcacggaaccggtttgcagtcctggagaagagcagcaaccaggttttggtgaagagccttaagaatgagatcgtgaagaaaagtcctcttcctattgcaactgatactatttactatgctggaactgggaacattttgtgcaaagctgaagacagagtggccatctttgatctgcagcagcggcttgttattggtgaactccaggcgtctgccgttaagtatgtggtttggtccagtgatatggagtccgttgcactgctcagcaagcatgccgtagtcattgcaaacaagaagcttgtccatcgctgcacacttcacgaaaccatacgtgtaaagagtggtgcctgggatgaaaatggtgtgttcatatattccactttgaaccatatcaagtactgccttcctaatggggacagtggtattatcagaactcttgatgttcctatttacattaccaaagtaactgggaacaacatttgctgtctggaccgtgatggaaagaacaagataataatagttgatgcatctgaatacattttcaagctggcccttctacggaaacgctatgatcatgtcatgagtatgataaaaaactcacagctttgtgggcaagcagtcatttcttatttacagcagaaagggtttccagaagttgctctccactttgtgaaagatgagaagaccagatttaacctggctcttgagagtggaaacatccaaattgctgttgcttctgcaaaggagcttgatgacaaggatcactggtacaggttgggaattgaggctctgaggcaagggaatgttggtatagttgaatatgcataccagaggacaaagaattttgacaggctggcttttctctatctgctaactggttacttggacaaggttggctttatgtctaagatagccgggcagaataacaatttgatgggccagttccacaatgcattgtatcttggggatgtcaggaaaagagttgagatcttggagagtgcaggacaggtacctcttgcatatgtaactgcagccacccatgggctcactgaaattgcagataggcttgctagtgaattgggagaaaatgtgccttctctacctgaagggaaagatagatcacttttaattcctcctgcacctctcacagcctgtggtgattggccattgttgagggtgatgcgtggtatttttgagggtggactagatgctactgggagggcggagcatgaggaagacgatgaagatattgctggtgattggggtgatgaagaccttgaaattgttgatgtaagtaatgtggttgaaaatggagatgttactggccatgttgagggaagtgaagcaaatgaagaggatggggaagaggaaggtggctgggaccttgaagacctggagttaccagaggcagagacaccaaaagctactggtccagcccgttccactttgtttgtggctcctacaccaggcatgcctgtcagccaaatttggactcagaaatcatctcttgctggggagcatgctgcagcggggaattatgacactgcaatgcgattgctaagccgccagttgggcatcaggaactttgctcctttgaagtccttgtttcttgatgcacacatgggtagtcatacctttctgcgtgcatttgcaagtgctccagttatacctgttgctgtggagaagggctggagtgaatctgctagtcccaatgtgaggggcccacctgcacttgtgtttagcttctctcaaatggatgacaagcttaaggctgcatataaagccacaacagagggtaaattcccagaagcactgaggcagtttcttaacatcctatataccatcccactccttgttgtggactcgaggagagaagttgatgaagtgaaggagcttattgagatagtgagagagtatgttcttggtcttaggatggaagtcaaaaggaaggaactgaaagatgatgctacccgtcaacaggagttggctgcatacttcactaactgcaagctgcagaaggttcatatgcgtcttgtcctcaccagtgccatgggtctttgtttcaagggtggaaactatgccactgcagcaaactttgcacgcatgcttttggaaaacagcccaaatgaggcccaagcaaagaaggctcggcaggttctgcaggcttgtggtgacaggaaagatgggcatcagctgaactacgacttcagaaatccgtttgttgtgtgcggagcaacctttgttccaatataccgtgggcagaaggatatttcctgcccatactgcgcgtctcggtttgtgccctccgtcgaaggtcagctttgcagcatatgcgagctctcggtggttggagcggacgcttcgggcctcctatgctcccctacacaatcgagataaatggcaacggtggcttcaccttgtgtttatgtctgtatctccagttcgaggaccatctgttatcgttatatcgttatattctaccagagatttcattaccaacttgtgaggaataagtatagtaattggttgtcttgagtcatttcttcctctgtccttgattttggtcttatacggctttagacctcattttttgccctcgaggaacaagtataggaataactgttttcgttgtattctatcagtcagatatgctttgtgtgtttggtttctgtttattgttctgcgtttggttggtatgcaaccctgtatacaattacagggtttattctggtgccatgtcggtttttgcccagacaacaacaccagcaatgctgctgtgaccaagatcctctcatatattgatttgtttgttcctgtaaaagatcaaataggtgcagtatacatcagcagctcagcataaagatcacgcaggcctgacgcacctctgtatgcatatcggatattttctccgtctaacaaaagatgtcttgaccgattaagacaccgagcaggagctttttatctgatgaatgtagtgaagcatgcatcactggactggtccagacatgaggtaaaagctcttcgattagacatggcagctttcaggtggccatggggtctggcctgctgccataaaccgtagatgggacgaagaacaactagcccacactcgctcacctgtagagccatgtttttcctgagttcgcttcctca

SEQ ID NO: 828 - DNA, 4368 bp, Hordeum vulgare
gtctcagcagcttaagcaggacacacatcttcttcccctccgagatccaaatcaccaaactgacagcagcccagatccacccaccccacctcacctctctcgcccccgccggtgggtttaggggcggccgccggagagggagggcggcggcgagacgagatgctgaccaagttcgagaccaagagcaaccgggtcaagggcctcgccttccacccgcggcgcccatggatcctcgccagcctccacagcggggtcgtccagatgtgggactaccgcatgggcaccctcctcgaccgcttcgacgagcacgacggccccgtacgcggcgtccacttccacaagacacagccgctcttcgtttccggaggtgacgattacaagatcaaagtgtggaactacaagacgcaccgctgcctcttcacgctccatggccaccttgactacatccgcactgtccagttccacgacgagcacccgtggatcgtcagtgccagcgacgaccagacaatccgtgtctggaactggcagtcgcgcacctgcgtggcggtgctgacggggcacaatcactatgtcatgtgtgcttccttccatcccaaggaggacctggtcgtgtcagcgtctctggatcagaccgtccgggtgtgggatattggcgctctcaggaagaagtcgtcgtccccagccgatgacatcatgcgtctcacccagatgaacactgatctgtttggaggcatcgatgctgtggtcaagtatgtcttggagggtcatgaccgcggggtcaactgggcctcgtttcatcctaccctgccacttattgtttctggggcagatgaccggcaagtgaaactctggaggatgaatgatacaaaggcatgggaggttgatactcttagaggtcacatgaacaatgtctcctgtgtattgttccacgcgaagcaggacatcatcgtatccaactcagaagacaagagtatccgtgtctgggatgccacaaagagaactggtatccagacattcaggcgggagcatgaccgcttctgggtccttgctgctcaccctgaaatgaatcttcttgcagctggtcatgatagtggcatgattgtgtttaagttggagagagagcgcccagctttcgccgttagtggtgatacagttttctatgtgaaggaccgcttcctccgtttctatgagtactctacacagaaggaggtccaggtggctccgataagaaggcctgggtcagtcagcttgaatcagtcaccaaggacattatcatatagcccaactgagaatgctgtcttgatctgctctgatgttgatgggggctcatatgaactcttcattgttcctaaagattctgctggcagggccgattatttgcaggatgcaaagaagggatctggcggttctgcagttttcatagcccggaaccggtttgcagtcctggagaagagcagcaaccaggttttagtgaagagtcttaagaatgagattgtgaagaaaagccctcttcctatcgcaactgatgttatttactatgctggaaccggtaacatattgtgcagagctgaagacagggtggccatctttgatttgcagcagcggcttgttcttggtgaactccaggcatctgctgttaagtatgtgatctggtcaaatgatatggagtctgttgcacttctcagcaaacatgctgtggtcattgcaaacaagaagcttgtccatcgctgcacacttcacgaaaccatacgtgtaaagagtggtgcctgggatgaaaatggtgtgttcatatattccactctgaaccatatcaagtactgccttcctaatggggacagtggcattatcaaaacacttgatgtgcctatttacataaccaaggttgcagggaacaccattgccttcctggaccgtgatggaaagaacaagattattacagttgatgcttctgaatacattttcaagctggcccttctacggaagcgctatgatcatgttatgagtatgattaagaactcacagctgtgtgggcaggcggtcatttcttatctgcaacagaaaggatttccagaagttgctctccactttgtgaaagatgaaaagaccagatttaacttggcccttgaaagcgggaacatccaaatcgccgttgcttccgcaaaggagcttgatgacaaggatcactggtacaggttgggaatcgaggctctgaggcagggaaatgttggtattgttgaatatgcataccagcggacaaagaattttgacaggcttgcttttctttatctcctaactggttacttggacaaggtgggctttatgtctaagatagctgggcagaataacaatttgatgggccagttccacaatgcattgtatcttggagatgctaagaaaagagttgagatcttggagaatgcaggacagctacctctagcatatgtgactgctgccactcatgggctcactgaaattgctgataggcttgctggtgagttaggtgaagatgtgccttctctacctgaagggaaaactagatcacttttaatccctccagcacctctcacatcctgtggtgattggccattgttgagggtgatgcgtggtatttttgagggtggactagatgctactgggagggcagagcaggaggaagattatgatgatgctggtggtgattggggtgatgaagacctggaaattgttgatgcaagtgctgtgatagaaaatggagatgctggccatgccgatgaaagtgaaacaaatgaagaggatggggaagaggaaggtggctgggacctggaagatctggaattgccgccggaggcagatacaccaaaagctactggtgcggcccgttctgctttgtttgtggctcccacacctggcatgcctgtcagtcaaatttggactcagaagtcatctcttgctggggagcatgctgcagctgggaattttgacacagcaatgcgtctgcttagccgccaattgggcatcaagaactttgctcctctgaaggccttgtttcttgatgcgcatatgggcagtcacacctttctgcgtgcatttgcaagtgctccagtaatacctgttgctgttgagaaaggctggagtgaatctgctagtcccaatgtgaggggcccacctgcacttgtgtttagcttcgcgcaaatggacgacaagctgaaggccgcatacaaagccacaaccgagggcaaattcccagaagcactgaggcagttcctcaacatcctatacaccatccctcttctcgtcgtcgactcgcggagagaggtcgatgaagtgaaggagcttatcgagatagtgagggagtacgtccttggtctcaggatggaagtcaagaggaaggagctgaaaaacgacgccacccggcaacaggagctggctgcctacttcaccaactgcaagctacagaaggtccacatgcgcctggtcctcaccagcgccatgggcctctgcttcaagggcgggaactacgccaccgcggcaaactttgcccgcatgctcctggacaatggcccgaacgaggcccaggcaaagaaggcccgacaggtcctgcaggcctgcggtgacaggaaggacgcccaccagctgaactacgacttcagaaacccgttcgtcgtctgcggggcaacctttgtcccgatctaccgcgggcagaaggacgtctcctgcccctactgcgcgtcccggttcgtgccctcagtcgagggtcagctgtgcagcatatgcgagctctcggtggtcggggcggacgcctcaggcctcctctgctcccctacacaatcgagataagataagtggcgacgacgactattgtggcttcacctccgtgttcatcatgtttgtatctccagttcgaagactgttgtgtcagttatattctacctaccagagattttttatcacccaacttgcgaggaataagtatagtataattggttccattgcgtcgtttcttcccccttttttttgcgtcatcgattgatctcggcctgatacggctgcggttggtcaatcatcaacaaacggtgtaggatttttggacagatccatatttttagggcacaatgatgatgtatttaatctggatctcattatatgatgtttgtgtatgcttggctgacgcacattctctttttttttatcctcctgtgctgtcattatatgatgtatttaatcctctactctcaggagctgatcttgtgtgcgtttggtttctttccttttttcctctcctgcttgtgctttgttagtctataagcaaagcctcttccagggcttgcaatcttcacaatgcatgtgcataaaagcttgtttcctttgagcaagaatagcatgtatccc

SEQ ID NO: 829 - DNA, 4221 bp, Secale cereale
cccctctcttgctcccgccggtgggctccgccgccggagagggagggcggcgagacgagatgctgaccaagttcgagaccaagagcaaccgcgtcaaggggctcgccttccacccgcggcggccatggatcctcgccagcctccacagcggggtcgtccagatgtgggactaccgcatgggcaccctcctcgaccgcttcgacgagcacgacggccccgtccgcggcgtccacttccacaagacccagccgctcttcgtatcaggaggtgacgattacaagatcaaggtgtggaactacaaaacccaccgctgcctcttcacactccatggccaccttgactacatccgcacggtccagttccacgacgagcacccgtggatcgtcagtgccagcgatgaccagacaatccgtgtctggaactggcagtcacgcacctgcgtggccgtcctgacggggcacaatcactatgtcatgtgtgcttccttccatcccaaggaggacctggtcgtgtcagcctctctggatcagaccgtccgggtgtgggatattggcgcgctcaggaagaagtcgtcgtccccagccgacgacatcatgcgtctcactcagatgaacactgatctgtttggaggcattgatgctgtggtcaagtatgtcttggagggtcacgaccgtggggtcaactgggcatcgtttcaccccacgctgccacttattgtttctggggcagacgaccggcaagtgaaactctggagaatgaatgatacaaaggcatgggaggttgatactcttagaggtcacatgaacaatgtctcttgtgtattgttccacgcgaagcaggacatcattgtatccaactcagaagacaagagcatccgtgtttgggatgccacaaagagaactggtatccagacattcaggcgggagcatgaccgcttctgggtccttgctgctcaccctgaaatgaatcttcttgcagctggtcatgatagtggcatgattgtgttcaagttggagagagagcgcccagctttcgcagttagtggtgatacagtgttctatgtgaaggaccgcttcctccgtttctatgagtactcaacccagaaggaggtccaggtggctccgataagaaggcctgggtcagtcagcttgaatcagtcaccaaggacattatcgtatagcccaactgagaatgctgtcttgatctgctctgatgtggatgggggctcatatgagcttttcattgttcctaaagattctgctggcagggctgattatttgcaggatgcaaagaagggatctggtggttctgcagttttcatagcccggaacaggtttgcagtcctggagaagagcagcaaccaggttttagtgaagagtcttaagaatgagatagtgaagaaaagtcctcttcctattgcaactgatgttatttactatgctggaactggtaacatattgtgcagagctgaagacagggtggccatctttgatctgcagcagcgtcttgttcttggtgaactccaggcatctgctgttaagtatgtgatctggtcgaatgatatggagtctgttgcactgctcagcaaacatgctgtagtcattgcaaacaagaagcttgtccatcgctgcacacttcacgaaaccatacgtgtgaagagtggtgcctgggatgaaaatggtgtgttcatatactccactctgaaccatatcaagtactgccttcctaacggggacagtggcattatcaaaacacttgatgttcctatttacataaccaaggttgctgggaacaccattgcctttctggaccgtgatggaaagaacaagatcattacagttgatgcgtctgaatacattttcaagctggctcttctacggaagcgctacgatcatgttatgagtatgattaagaactcacagctgtgcgggcaggcagtcatttcttatttgcagcagaaaggatttccagaagttgctctccactttgtgaaagatgaaaagaccagatttaacctggctcttgaaagcgggaacatccaaattgctgttgcttccgcaaaggagctcgatgacaaggatcactggtacaggttgggaatcgaggctctgaggcagggaaatgttggtattgttgaatatgcatatcagcggacaaagaattttgacaggcttgcttttctttatctgctaactggttacttggacaaggtcggcttcatgtctaagatagctgggcagaataacaatttgatgggccagttccacaatgcattgtatcttggagatgctaagaaaagagttgagatcttggagaatgcaggacagctacctctagcatatgtgactgctgccactcatgggctcactgaaattgccgataggcttgctggtgagttaggagaagatgtgccttctctacctgaagggaaaactagatcacttttaatccctccagcacctctcacagcttgtggtgattggccattgttgagggtgatgcgtggtatttttgagggtggactagatgctactgggagggcagagcaggaggaagattatgatgatgctggtggtgactggggtgatgaagacctggagattgttgatgcaagtaatgtgatagaaaatggagatgctggccacgccgatgaaagtgaaacaaatgaagaggatggggacgaggaaggtggctgggacctcgaagatctggaattgccgccggaggcagatacaccaaaagctagaggtccggaacgctctgctttgttcgtggctcccacaccaggcatgcctgtcagtcaaatttggactcagaagtcatctcttgctggggagcatgctgcagcagggaattttgacacagcaatgcgtctgcttagccgccagttgggcatcaagaactttgctcctttgaaggccttgtttcttgatgcacatatgggcagtcatacctttctgcgtgcatttgcaagtgctccagtgatccctgttgctgttgagaaaggctggagtgaatccgccagccccaatgtgaggggcccacctgcacttgtgtttagctttgcgcaaatggacgacaagctgaaggctgcatacaaagccacaaccgagggcaagttcccagaggcactgaggcagttcctcaacatcctatacaccatcccgctcctcgtcgtggactcacggagggaggtcgatgaagtgaaggagcttatcgagatagtgagggagtacgtccttggcctcaggatggaagtcaagaggaaggagctgaaaaacgacgccacccggcagcaggagctggcggcatacttcaccaactgcaagctgcagaaggtccacatgcgcctcgtcctcaccagcgccatgggcctgtgcttcaagggcgggaactacgccacggcggcaaactttgcccgcatgctcctggacaacggcccgaacgaggcccaggcgaagaaggcccggcaggtcctgcaggcctgcggcgacaggaaggacgcccaccagctcaactacgacttcagaaacccgttcgtcgtctgcggggccaccttcgtcccgatctaccgcgggcagaaggacgtctcctgcccctactgcgcgtcccggttcgtgccctcggtggagggtcagctgtgcagcatatgcgagctgtcggtggtcggggcggacgcctcgggcctcctctgctcccctacacaatcgagataagataagtggcgacgactctcgcctctgtgttgatcatgtttgtatctccagtcagttccaagactgttgtgtcagttatattctacctaccagagatttttatcagcaacttgcgaggaataagtatagtataattgcgtcgtttcttccccccttttttgtgtcatggatcgatcgtggggctgtggtcggtcaatcaacaaacggtgtaggatttttggacagacacattttttagggcacaatgatgatgtatttaaatcgggatttcgttatatgatgtactacctaccatgttttgtgtaatgtttggctggtgttcattgctttttaatcctcctttgcgctcaagagctgcttttttgtgcctttggttgctgttcacagtttctcctccgtcttatgccttgttagtgagatagcctcttccagggcttgcatcgtcacaatgcctgtatatgaaagcttatcttctttgagcaagaataacatggattccatagtc

SEQ ID NO: 830 - DNA, 3989 bp, Triticum aestivum
gatgctgaccaagttcgagaccaagagcaaccgcgtcaaggggctcgccttccacccgcgccgcccatggatcctcgccagcctccacagcggggtcgtccagatgtgggactaccgcatgggcaccctcctcgaccgcttcgacgagcacgacggccccgtccgcggcgtccacttccacaagacacagccgctcttcgtatccggaggtgacgattacaagatcaaggtgtggaactacaaaacccaccgctgcctcttcacgctccatggccaccttgactacatccgcacggtccagttccatgacgagcacccgtggatcgtcagtgccagtgatgaccagacaatccgtgtctggaactggcagtcacgcacctgcgtggccgtgctgacggggcacaatcactatgtcatgtgtgcttctttccatcccaaggaggacctggtcgtgtcagcctctctggatcagaccgtccgggtgtgggatattggcgcgctcaggaagaagtcgtcgtccccagccgacgacatcatgcgtctcactcagatgaacactgatctgtttggaggcattgatgctgtggtcaagtatgtcttggagggtcacgaccgtggggtcaactgggcatcgtttcatcccaccctgccacttattgtttctggggcagacgaccggcaagtgaaactctggagaatgaatgatacaaaggcatgggaggttgatactcttagaggtcacatgaacaatgtctcctgtgtattgttccatgcgaagcaggacatcattgtatcaaactcagaagacaagagcatccgtgtttgggatgccacaaagagaactggtatccagacattcaggcgggagcatgaccgcttctgggtccttgctgctcaccctgaaatgaatcttcttgcagctggtcatgatagtggcatgattgtgtttaagttggagagagagcgcccagctttcgccgttagtggcgatacagtgttctatgtgaaggaccgcttcctccgtttctatgagtactcaacccagaaggaggtccaggtggctccgataagaaggcctgggtcagtcagcttgaatcagtcaccaaggacattatcgtatagcccaactgagaatgctgtcttgatctgctctgatgtggatgggggctcatatgagcttttcattgttcctaaagattctgctggcagggctgattatttgcaggatgcaaagaagggatctggtggttctgcagttttcatagcccggaacaggtttgcagtcctggagaagagcagcaaccaggttttggtgaagagtcttaagaatgagattgtgaagaaaagccctcttcctattggaactgatgttatttactatgctggaactggtaacgtattgtgcagagctgaagacagggtggccatctttgatctgcagcagcggcttgttcttggtgaactccaggcatctgctgttaagtatgtgatctggtcgaatgatatggagtctgttgcactactcagcaaacatgctgtagtcattgcaaacaagaagcttgtccatcgctgcacacttcacgaaaccatacgtgtaaagagtggtgcctgggatgaaaatggtgtgttcatatattccactctgaaccatatcaagtactgccttcctaatggggacagtggcattatcaaaacacttgatgttcctatttacataaccaaggttgcggggaacaccattgcctttctggaccgtgatggaaagaacaagattattacagttgatgcttctgaatacattttcaagctggcccttctacggaagcgctacgatcatgttatgagtatgattaagaactcacagctgtgcgggcaggcagtcatttcttatttgcaacagaaaggatttccagaagttgctctccactttgtgaaagatgaaaagaccagatttaacctggctcttgaaagcgggaacatccaaattgctgttgcttccgcaaaggagctcgatgacaaggatcactggtacaggttgggaattgaggctctgaggcagggaaatgttggtattgttgaatatgcataccagcggacaaagaattttgacaggcttgcttttctttatctgctaactggttacttggacaaggtgggcttcatgtctaagatagctgggcagaataacaatttgatgggccagttccacaatgcattgtatcttggagatgctaagaaaagagttgagatcttggagaatgcaggacagctacctctagcatatgtgactgctgccactcatgggctcactgaaattgccgataggcttgctggtgagttaggagaagatgtgccttctctacctgaagggaaaactagatcacttttaatccctccagcacctctcacagcttgtggtgattggccattgttgagggtgatgcgtggtatttttgagggtggactagatgctactgggagggcagagcaggaggaagattatgatgatgctggtggtgattggggtgatgaagacctggaaattgttgatgcaagtaatgtgatagaaaatggagatgctggccatgccgatgaaagtgaaacaaatgaagaggatggggaagaggaaggtggctgggaccttgaagatctggaattgccgccggaggcagatacaccaaaagctagaggtccggaacgctctgctttgttcgtggctcccacaccaggcatgcctgtcagtcaaatttggactcagaagtcatctcttgctggggagcatgctgcagctgggaattttgacacagcaatgcgtctgcttagccgccagttgggcatcaagaactttgctcctttgaaggccttgtttcttgatgcgcatatgggcagtcatacctttctgcgtgcgtttgcaagtgctccagtgatacctattgctgttgagaaaggctggagtgaatctgccagtcccaatgtgaggggcccacctgcacttgtgtttagctttgcgcaaatggacgacaagctgaaggctgcatacaaagccacaaccgagggcaagttcccagaggcactgaggcagttcctcaacatcctatacaccatcccgctcctcgtcgtggactcacggagagaggtcgatgaagtgaaggagcttatcgagatcgtgagggagtacgtccttggtctcaggatggaagtcaagaggaaggagctgaaaaacgacgccacccggcagcaggagctggcggcatacttcaccaactgcaagctgcagaaggtccacatgcgcctcgtcctcaccagcgccatgggcctctgcttcaagggcgggaactacgccaccgcggcaaactttgcccgcatgctcctggacaacggcccgaacgaggcccaggcgaagaaggcccggcaggtcctgcaggcctgcggcgacaggaaggacgcccaccagctcaactacgacttcagaaacccgtttgtcgtctgcggggccaccttcgtcccgatctaccgcgggcagaaggacgtctcctgcccctactgcgcgtcccggttcgtgccctcggtcgagggtcagctgtgcagcatatgcgagctctcggtggtcggggcggacgcctcgggcctcctctgctcccctacacaatcgagataagataagtggcgacgacttcgcctctgtgttcatcatgtttgtatcatctccagttcgaagactgttgtgtcagttatattctacctaccagagatttttatcaccaacttgcgaggaataagtatagtataattgcgtcgtttcttccccctttttttctgtcatcgatcggtcgtggcctgatgcggctgtggtcggtcaatcaacaaacggtgtaggatttttggacagacacattttttagggcacaatgatgatgtatttaaatcgggatttcgttatatgatgtactgcctaccatgtttgtgtaatgtttggctggtattcattg

SEQ ID NO: 831 - DNA, 4063 bp, Avena sativa
caaactgacccaacccagatccacccacccacccggccttcccttctccctccctctccctcgctcccgccggtgggtttaggggccccgccgggccgccgtcctcgtcggcggcgtcgcgatgctgaccaagttcgagaccaagagcaaccgcgtcaaggggctcgccttccacccgcgcaggccatggatcctcgccagcctccacagcggggtcgtccagatgtgggactaccgcatgggcaccctcctcgaccgcttcgacgagcacgacgggcccgtacgcggcgtccacttccacaagacacagccgctcttcgtatcaggaggtgatgattacaagatcaaggtgtggaactacaagacgcaccgctgcctcttcacgctccatggccaccttgactacatccgcacggtgcagttccacgacgagcatccatggatcgtcagtgctagcgatgaccagacaatccgtgtatggaactggcagtcgcgcacttgtgtggcagttttgacagggcataatcactatgtcatgtgtgcctccttccatcccaaggaggacctggtcgtgtcggcatctctggatcagactgtccgggtgtgggatattggggcgctcaggaagaagtcatcgtctccagccgatgacattatgcgtctcactcagatgaacactgatctgtttggaggcattgatgctgtagtcaagtatgtcttggagggtcatgaccgtggggtcaactgggcctcgtttcatcccacgctgccacttattgtttctggggcagatgaccggcaagtgaaactctggagaatgaatgatacaaaggcatgggaggttgatactctgagaggtcacatgaataatgtgtcctgtgtactgttccacgcgaagcaggacatcatcgtgtccaactcagaagataaaagcattcgtgtttgggatgccacaaagagaactggtatccagacattcaggcgggagcatgatcgcttctgggtccttgctgctcacccggaaatgaatcttcttgcagctggtcatgatagtggcatgattgtgttcaaattggagagggaacgtccagctttctccgtcagtggtgataccgtgttctatgtgaaggaccggttcctccgtttttacgagtactcagcacagaaggaggttcaggtggctccgataagaaggcctggatcagtcaccttgaatcagtcaccaaggtcattatcatatagcccaactgagaatgctgtcttgatctgctctgatgtggatgggggctcgtatgagctttacattgtccccaaggattctgctggcagggctgattatttgcaggatgcaaagaagggagctggtggttctgcagttttcatagctcgaaaccggtttgcagtcctggagaagagcagtaaccaggttttggtgaagagtcttaagaatgagattgtgaagaaaagtcctcttccaattgcaactgatgctatttactatgctggaactggtaacatattgtgcaaagctgaagacagggtggccatctttgatctgcagcagcggcttgttcttggtgaactccaggcatctgctgttaagtatgtggtttggtcaagtgatatggagtcagttgcactgctcagcaagcatgctgtagtcattgcaaacaagaagcttgtccatcgctgcacacttcacgaaaccattcgtgtaaagagtggtgcctgggatgaaaatggcgtgttcatatattccactttgaaccatatcaagtactgccttcctaatggtgacaatggcatcatcaaaacacttgatgttcctatttacataaccagggttgcagggaacatcatctgctgtctggatcgcgatggaaagaacaagatgataacaattgatgcttctgaatacattttcaagctggcccttctacgtaagcgctatgatcatgttatgagcatgatcaagaactcgcagctgtgtggacaggcggtcatttcttatttacaacagaaaggatttccagaggttgctctccacttcgtgaaagatgagaagaccaggtttaacctggctcttgagagcgggaacatccaaattgctgttgcttctgcaaaggagcttgatgacaaggatcactggtacaggttgggaatcgaggctctgaggcagggaaatgttggtattgtagaatatgcttaccagcggacaaagaattttgacaggcttgcctttctttatctgataactggttacttggacaaggtgggctttatgtctaagatagctgggcagaataacaatttgatgggccagttccacaatgcactgtatcttggggatgttaggaagagagtcgagatcttggagaatgcggggcagctacctcttgcatatgtaactgctgccactcatggacttcctgaaatcgctgataggcttgctaatgaattgggagaaaatgtaccagctctacctgaaggaaaaaacagttcacttttgattcctcctgcacctctcatagctagcagtgactggccattattgagggtgatgcgtggtatttttgatggtggactagatgctactgggagggcagagcaggaggaagactatgaagatgctggtgctggtggtgattggggagacgaagacctagaaattgttgatgtaagtaatgtggtagagaatggagacgcgggccatggtgagggaagtgaagcaaatgaagaggatggagaagaagaaggtggctgggacctggaagatctggaattgccacctgaggcagatacaccaaaagctaccggtcctgcccgctctgctttgtttgtggctcccacaccaggcatgcctgtcagccaaatttggactcagaagtcatctcttgctggggagcatgctgcagcggggaatttcgacactgcaatgcggctgcttagccgccagttgggcatcaggaactttgctcctctgaagaccttgtttcttgatgcacatatgggaagtcatacctttctgcgtgcatttgcaagcgctccggtgatacctgttgctgttgagaaaggctggactgaaactgctagtcccaacgtgaggggcccacctgcacttgtgttcagcttctcgcagatggacgacaagcttaaggctgcatataaggctacaaccgagggtaaattcccagaagcactgaggcagttcctcaacatcctatacaccatcccgctccttgtcgtggactcgcggcgagaagttgatgaagtgaaggagctcattgagatagtgagggagtacgtccttggcctcaggatggaagtcaagaggaaggagctgaaaaacgacgccacccggcaacaggagctggctgcatacttcaccaactgcaagctacagaaggtccacatgcgtctggtcctcaccagcgccatgggtctctgcttcaagggcgggaactacgccaccgccgcaaacttcgcccgcatgctcctggagaacagcccgaacgaggcccaggcgaagaaggctcggcaggtcctgcaggcctgcggcgacaggaaagatgcccaccagctgaactacgacttcaggaacccgttcgttgtgtgcggagcaacctttgttccgatctaccgcgggcagaaggatgtctcctgcccctactgcacgtcccggttcatgccctccgtcgagggccagctctgcaccatctgtgagctctcggtggtcggagcggacgcctcgggcctcctctgctctcctacacagtcgagataagcggtgattgtgctggcttttcacccctgtgttcatgtttgtatctccagttcaaagaccgctgctgtgttgtcgttatattctaccagagatttgaattaccaaacttgtgaggaataagtatagtataattggttgttttcttccttcttgtcctcggttttagtctcatacgggctgcggtgaaacaaacgctgtaggattttggacagatccatttttaggaccaaatgatgatgatgtatttaattgagaattccattatatgatgtaccacca

SEQ ID NO: 832 - DNA, 4091 bp, Avena sativa
cagcagcagcagcagcttctcttctcttctccgagatccaaactgacccaacccaccagatccacccaacccacccacacgacccttctccctcccgccggtgggtttaggggcccccgccgggccgccgtcctcgtcggcggcgccgagatgctgaccaagttcgagaccaagagcaaccgcgtcaaggggctcgccttccacccgcgcaggccatggatcctcgccagcctccacagcggggtcgtccagatgtgggactaccgcatgggcaccctcctcgaccgcttcgacgagcacgacgggcccgtacgcggcgtccacttccacaagacacagccgctcttcgtatcaggaggtgatgattacaagatcaaggtgtggaactacaagacgcaccgctgcctcttcacgctccatggccaccttgactacatccgcacggtgcagttccacgacgagcatccatggatcgtcagtgctagcgatgaccagacaatccgtgtatggaactggcagtcgcgcacttgtgtggcagttttgacagggcataatcactatgtcatgtgtgcctccttccatcccaaggaggacctggtcgtgtcggcatctctggatcagactgtccgggtgtgggatattggggcgctcaggaagaagtcgtcgtccccagccgatgacattctgcgtctcactcagatgaacactgacctgtttggaggcattgatgctgtggtcaagtatgtcttggagggtcataaccgtggggtcaactgggcctcgtttcatcccacgctgccacttattgtttctggggcagatgaccggcaagtgaaactctggagaatgaatgatacaaaggcatgggaggttgatactctgagaggtcacatgaataatgtgtcctgtgtactgttccacgcgaagcaggacatcatcgtgtccaactcagaagataaaagcattcgtgtttgggatgccacaaagagaactggtatccagacattcaggcgggagcatgatcgcttctgggtccttgctgctcacccggaaatgaatcttcttgcagctggtcatgatagtggcatgattgtgttcaaattggagagggaacgtccagctttctccgtcagtggtgataccgtgttctatgtgaaggaccggttcctccgtttttacgagtactcagcacagaaggaggttcaggtggctccgataagaaggcctggatcagtcaccttgaatcagtcaccaaggtcattatcatatagcccaactgagaatgctgtcttgatctgctctgatgtggatgggggctcgtatgagctttacattgtccccaaggattctgctggcagggctgattatttgcaggatgcaaagaagggagctggtggttctgcagttttcatagctcgaaaccggtttgcagtcctggagaagagcagtaaccaggttttggtgaagagtcttaagaatgagattgtgaagaaaagtcctcttccaattgcaactgatgctatttactatgctggaactggtaacatattgtgcaaagctgaagacagggtggccatctttgatctgcagcagcggcttgttcttggtgaactccaggcatctgctgttaagtatgtggtttggtcaagtgatatggagtcagttgcactgctcagcaagcatgctgtagtcattgcaaacaagaagcttgtccatcgctgcacacttcatgaaaccatacgcgtaaagagtggtgcctgggatgaaaatggcgtgttcatatattccactttgaaccatatcaagtactgccttcctaatggtgacaatggcatcatcaaaacacttgatgttcctatttacataaccagggttgcagggaacatcatctgctgtctggatcgcgatggaaagaacaagatgataacaattgatgcttctgaatacattttcaagctggcccttctacgtaagcgctatgatcatgttatgagcatgatcaagaactcgcagctgtgtggacaggcggtcatttcttatttacaacagaaaggatttccagaggttgctctccacttcgtgaaagatgagaagaccaggtttaacctggctcttgagagcgggaacatccaaattgctgttgcttctgcaaaggagcttgatgacaaggatcactggtacaggttgggaattgaggctctgaggcagggaaatgttggtattgtagaatatgcttaccagcggacaaagaattttgacaggcttgcctttctttatctgataactggttacttggacaaggtgggctttatgtctaagatagcagggcagaataacaatttgatgggccagttccacaatgcactgtatcttggggatgtgaggaaaagagttgagatcttggaaaatgcgggacagctacctcttgcatatgtaactgctgccactcatggacttcctgaaatcgctgataggcttgctagtgaattgggagaaaatgtaccagctctacctgaagggaaaaatagttcacttttgattcctcctgcacctctcatagctagcagtgattggccattgttgagggtgatgcgtggtatttttgatggtggactagatgctactgggagggcagagcaggaggaagactatgaagatgctggtgctggtggtgattggggagacgaagacctagaaattgttgatgtaagtaatgtggtagaaaatggagatgctggtcatggtgagggaagtgaagcaaatgaagaggatggagaagaggaaggtggctgggacctggaagatctggaattgccaccagaggcagatacacccaaagctactggtcctgcccgctctgctttgtttgtggctcccacaccaggcatgcctgtcagccaaatttggactcagaagtcgtctcttgctggggagcatgctgcagcggggaatttcgacaccgcaatgcggctgcttagccgccagttgggcatcaggaactttgctcctctgaagaccttgtttcttgatgcacatatgggaagtcatacctttctgcgtgcatttgcaagcgctccagtgatacctgttgctgttgagaaaggctggactgaaactgctagtcccaacgtgaggggcccacctgcacttgtgttcagcttctcgcagatggacgacaagcttaaggctgcatataaggctacaaccgagggtaaattcccagaagcactgaggcagttcctcaacatcctatacaccatcccgctccttgtcgtggactcgcggcgagaagttgatgaagtgaaggagctcattgagatagtgagggagtacgtccttggcctcaggatggaagtcaagaggaaggagctgaaaaacgacgccacccggcaacaggagctggctgcatacttcaccaactgcaagctacagaaggtccacatgcgtctggtcctcaccagcgccatgggtctctgcttcaagggcgggaactacgccaccgccgcaaacttcgcccgcatgctcctggagaacagcccgaacgaggcccaagcgaagaaggcccgccaggtcctgcaggcctgtggcgacaggaaagatgcccatcaactgaactatgacttcaggaacccgttcgttgtgtgcggagcaacctttgttccgatctaccgcgggcagaaggatgtctcctgcccctactgcacgtcccggttcatgccctccgtcgagggccagctctgcaccatctgtgagctctcggtggtcggagcggacgcctcgggcctcctctgctctcctacacagtcaagataagcggtgattgtgctggctttcacccctgtgttcatgtttgtatctccagttggaaggccgctgctgtgttgtcgttatattctaccagagatttgaattaccaaacttgtgaggaataagtatagtataattggttgttttcttccttcttgtcctcggttttagtctcatacgggctgcggtgaaacaaacgctgtaggattttggacagatccatttttaggaccaaatgatgatgatgtatttaattgagaattccattatatgatgtaccacca

SEQ ID NO: 833 - DNA, 4043 bp, Secale cereale
ccccccgagccgccccagatccacccacctcactcccccctctcccccctctcttgctcccgccggtgggctccgccgccggagagggaggcggcgagacgagatgctgaccaagttcgagaccaagagcaaccgcgtcaaggggctcgccttccacccgcggcggccatggatcctcgccagcctccacagcgggtcgtccagatgtgggactaccgcatgggcaccctcctcgaccgcttcgacgagcacgacggccccgtccgcggcgtccacttccacaagacccagccgctcttcgtctccggaggtgacgattacaagatcaaggtgtggaactacaaaacgcaccgctgcctcttcacgctccacggacaccttgactacatccgcacggtccagttccacgacgagcacccgtggatcgtcagtgccagtgatgaccagacaatccgtgtctggaactggcagtcacgcacctgcgtggccgtgctgacggggcacaatcactatgtcatgtgtgcttccttccatcccaaggaggacctggtcgtgtctgcgtctctggatcagaccgtccgggtgtgggatattggcgctctcaggaagaagtcgtcgtccccagccgacgacatcatgcgtctcactcagatgaacactgatctgtttggaggcattgatgctgtggtcaagtatgtcttggaggtcacgaccgtggggtcaactgggcctcgtttcaccccacgctgccacttattgtttctggggcagatgaccggcaagtgaaactctggagaatgaatgatacaaaggcatgggaggttgatactcttagaggtcacatgaataatgtctcctgtgtgttgttccacgcgaagcaggacatcattgtatccaactcagaagacaagagcatccgtgtttgggatgccacaaagagaactggtatccagacattcaggcgggagcatgaccgcttctgggtccttgctgctcaccccgaaatgaatcttcttgcagctggtcatgatagtggcatgattgtgtttaagttggagagagagcgcccagcttttgccgttagtggcgatacagtgttctacgtgaaggaccgcttcctccgtttctatgagtactcaacccagaaggaggtccaggtggctcccataagaaggcctggatcagtcagcttgaatcagtcaccaaggacattatcgtatagcccaactgagaatgctgtcttgatctgctctgatgtggatgggggctcatatgagcttttcattgttcctaaagattctgctggcagggctgattatttgcaggatgcaaagaagggatctggtggttctgcagttttcatagcccggaacaggtttgcagtcctggagaagagcagcaaccaggttttagtgaagagtcttaagaatgagattgtgaagaaaagtcctcttcctattgcaactgatgttatttactatgctggaactggtaacatattgtgcagagctgaagacagggtggccatctttgatctgcagcagcggcttgttcttggtgaactccaggcatctgctgttaagtatgtgatctggtcgaatgatatggagtctgttgcactgctcagcaaacatgctgtagtcattgcaaacaagaagcttgtccatcgctgcacacttcatgaaaccattcgtgtaaagagtggtgcctgggatgaaaatggtgtgttcatatattccactctgaaccacatcaagtactgccttcctaatggggacagtggcattatcaaaacacttgatgttcctatttacataaccaaggttgcggggaacaccattgcctttctggaccgtgatggaaagaacaagattattacagttgatgcttctgaatacattttcaagctggcgcttctacggaagcgctacgatcatgttatgagtatgattaagaactcacagctgtgcgggcaggcagtcatttcttatttgcagcagaaaggatttccagaagttgctctccactttgtgaaagatgaaaagaccagatttaacctggctcttgaaagcgggaacatccaaattgctgttgcttccgcaaaggagctcgatgacaaggatcactggtacaggttgggaatcgaggctctgaggcagggaaatgttggtattgttgaatatgcataccagcggacaaagaattttgacaggcttgcttttctttacctgctaactggttacttggacaaggtgggcttcatgtctaagatagctgggcagaataacaatttgatgggccagttccacaatgcattgtatctgggagatgctaagaaaagagttgagatcttggagaatgcaggacagctacctctagcatatgtgactgctgccactcatgggctcactgaaattgccgataggcttgctggtgagttaggagaagatgtgccttctctacctgaagggaaaaccaggtcacttttaatccctccagcacctctcacagcttgtggtgattggccattgttgagggtgatgcgtggtatttttgagggtggactagatgctactgggagggcagagcaggaggaagattatgatgatgctggtggtgactggggtgatgaagacctggaaattgttgatgcaagtaatgtgatagaaaatggagatgctggccatgccgatgaaagtgagacaaatgaagaggatggggacgaggaaggtggctgggacctcgaagatctggaattgcctccggaggcagatacaccaaaagctagaggtccggaacgctctgctttgttcgtggctcccacaccaggcatgcctgtcagtcaaatttggactcagaagtcatctcttgctggggagcatgccgcagctgggaattttgacacagcaatgcgtctgcttagccgccagttgggcatcaagaactttgctcctttgaaggccttgtttcttgatgcacatatgggcagtcatacctttctgcgtgcatttgcaagtgctccagtgatccctgttgctgttgagaaaggctggagtgaatctgccagtcccaatgtgaggggcccacctgcacttgtgtttagctttgcgcaaatggacgacaagctgaaggctgcatacaaagccacaacggagggcaagttcccagaggcactgaggcagttcctcaacatcctatacaccatcccgctcctcgtcgtggactcacggagagaggttgatgaagtgaaggagcttatcgagatagtgagggagtacgtccttggcctcaggatggaagtcaagaggaaggagctgaaaaacgacgccacccggcagcaggagctggcagcatacttcaccaactgcaagctgcagaaggtccacatgcgcctcgtcctcaccagcgccatgggcctctgcttcaagggcgggaactacgcgacggcggcaaactttgcccgcatgctcctggacaacggcccgaacgaggcccaggcgaagaaggcccggcaggtcctgcaggcctgcggcgacaggaaggacgcccaccagctcaactacgacttcagaaacccgttcgtcgtctgtggggccaccttcgtcccgatctaccgcgggcagaaggacgtctcctgcccctactgcgcgtcccggttcgtgcccttggtggagggtcagctgtgcagcatatgcgagctgtcggtggtcggggcggacgcctcgggcctcctctgctcccctacacaatcgagataagataagtggcgacgactctcgcctctgtgttgatcatgtttgtatctccagtcagttccaagactgttgtgtcagttatattctacctaccagagattttttatcagcaacttgcgaggaataagtatagtataattgcgtcgtttcttccccccttttttgtgtcatggatcgatcgtggggctgtggtcggtcaatcaacaaacggtgtaggtattttggacagacactattttttagggctacaatgatgatgtatttaaatcgggatttcgtataataaag

SEQ ID NO: 834 - DNA, 4125 bp, Secale cereale
aagtaggaggaggaaagaaaaacccacccagcacagcacatctccccttctcctctccgagatccaaatcaccaaactgacagagcagcccagatccacccacctcaccaccccccctcccctctcttgctcccgccggtgggctccgccgccggagagggagggcggcgagacgagatgctgaccaagttcgagaccaagagcaaccgcgtcaaggggctcgccttccacccgcggcggccatggatcctcgccagcctccacagcggggtcgtccagatgtgggactaccgcatgggcaccctcctcgaccgcttcgacgagcacgacggccccgtccgcggcgtccacttccacaagacccagccgctcttcgtatcaggaggtgacgattacaagatcaaggtgtggaactacaaaacccaccgctgcctcttcacactccatggccaccttgactacatccgcacggtccagttccacgacgagcacccgtggatcgtcagtgccagcgatgaccagacaatccgtgtctggaactggcagtcacgcacctgcgtggccgtcctgacggggcacaatcactatgtcatgtgtgcttccttccatcccaaggaggacctggtcgtgtcagcctctctggatcagaccgtccgggtgtgggatattggcgcgctcaggaagaagtcgtcgtccccagccgacgacatcatgcgtctcactcagatgaacactgatctgtttggaggcattgatgctgtggtcaagtatgtcttggagggtcacgaccgtggggtcaactgggcatcgtttcaccccacgctgccacttattgtttctggggcagacgaccggcaagtgaaactctggagaatgaatgatacaaaggcatgggaggttgatactctcagaggtcacatgaacaatgtctcctgtgtgttgttccacgcgaagcaggacatcattgtatccaactcagaagacaagagcatccgtgtttgggatgccacaaagagaactggtatccagacattcaggcgggagcatgaccgcttctgggtccttgctgctcaccctgaaatgaatcttcttgcagctggtcatgacagtggcatgattgtgtttaagttggagagagagcgcccagctttcgccgtgagtggtgatacagtgttctatgtgaaggaccgcttcctccgtttctatgaatactcaacacagaaagaggtccaggtggctccgataagaaggcctgggtcagtcagcttgaatcagtcaccaaggacattatcgtatagcccaactgagaatgctgtcttgatctgctctgatgtggatgggggctcatatgagcttttcattgttcctaaagattctgctggcagggctgattatttgcaggatgcaaagaagggatctggtggttctgcagttttcattgcccggaacaggtttgcagtcctggagaagagcagcaaccaggttttagtgaagagtcttaagaatgagattgtaaagaaaagccctcttcctattgcaactgatgttatttactatgctggaactggtaacatattgtgcagagctgaagacagggtggccatctttgatctgcagcagcggcttgttcttggtgaactccaggcatctgctgttaagtatgtgatctggtcgaatgatatggagtctgttgcactgctcagcaaacatgctgtagtcattgcaaacaagaagcttgtccatcgctgcacacttcatgaaaccattcgtgtaaagagtggtgcctgggatgaaaatggtgtgttcatatattccactctgaaccacatcaagtactgccttcctaatggggacagtggcattatacaaacacttgatgttcctatttacataaccaaggttgcggggaacaccattgcctttctggaccgtgatggaaagaacaagattattacagttgatgcttctgaatacattttcaagctggcgcttctacggaagcgctacgatcatgttatgagtatgattaagaactcacagctgtgcgggcaggcagtcatttcttatttgcagcagaaaggatttccagaagttgctctccactttgtgaaagatgaaaagaccagatttaacctggctcttgaaagcgggaacatccaaattgctgttgcttccgcaaaggagctcgatgacaaggatcactggtacaggttgggaatcgaggctctgaggcagggaaatgttggtattgttgaatatgcataccagcggacaaagaattttgacaggcttgcttttcttacctgctaactggttacttgacaaggtgggcttcatgtctaagatagctgggcagaataacaatttgatgggccagttccacaatgcattgtatcttggagatgctaagaaaagagttgagatcttggagaatgcaggacagctacctctagcatatgtgactgctgccactcatgggctcactgaaattgccgataggcttgctggtgagttaggagaagatgtgccttctctacctgaagggaaaactagatcacttttaatccctccagcgcctctcacagcttgtggtgattggccattgttgagggtgatgcgtggtatttttgagggtggactagatgctactgggagggcagagcaggaggaagattatgatgatgctggtggtgactggggtgatgaagacctggagattgttgatgcaagtaatgtgatagaaaatggagatgctggccatgccgatgaaagtgaaacaaatgaagaggatggggacgaggaaggtggctgggacctcgaagatctggaattgccgccggaggcagatacaccaaaagctagaggtccggaacgctctgctttgttcgtggctcccacaccaggcatgcctgtcagtcaaatttggactcagaagtcatctcttgctggggagcatgctgcagcagggaattttgacacagcaatgcgtctgcttagccgccagttgggcatcaagaactttgctcctttgaaggccttgtttcttgatgcacatatgggcagtcatacctttctgcgtgcatttgcaagtgctccagtgatccctgttgctgttgagaaaggctggagtgaatctgccagtcccaatgtgaggggcccacctgcacttgtgtttagctttgctcaaatggacgacaagctgaaggctgcatacaaagccacgacggagggcaagttcccagaggcactgaggcagttcctcaacatcctatacaccatcccgctcctcgtcgtggactcacggagagaggtcgatgaagtgaaggagcttatcgagatagtgagggagtacgtccttggcctcaggatggaagtcaagaggaaggagctgaaaaacgcgccacccggcagcaggagctggcggcctacttcaccaactgcaagctgcagaaggtccacatgcgcctcgtcctcaccagcgccatgggcctctgcttcaagggcgggaactacgccacggcggcaaactttgcccgcatgctcctggataacggcccgaacgaggcccaggcgaagaaggcccggcaggtcctgcaggcctgcggcgacaggaaggacgcccaccagctcaactacgacttcagaaacccgttcgtcgtctgtggggccaccttcgtcccgatctaccgcgggcagaaggacgtctcctgcccctactgcgcgtcccggttcgtgcccttggtggagggtcagctgtgcagcatatgcgagctgtcggtggtcggggcggacgcctcgggcctcctctgctcccctacacaatcgagataagataagtggcgacgactctcgcctctgtgttgatcatgtttgtatctccagtcagttccaagactgttgtgtcagttatattctacctaccagagatttttatcagcaacttgcgaggaataagtatagtataattgcgtcgtttcttccccctttttttgtgtcatggatcgatcgtggggctgtggtcggtcaatcaacaaacggtgtaggatttttggacagacacattttttagggcacaatgatgatgtatttaaatcgggatttcgttatatgatgtactacctacca

SEQ ID NO: 835 - DNA, 3942 bp, Avena sativa
agatgctgaccaagttcgagaccaagagcaaccgcgtcaaggggctcgccttccacccgcgcaggccatggatcctcgccagcctccacagcggggtcgtccagatgtgggactaccgcatgggcaccctcctcgaccgcttcgacgagcacgacgggcccgtacgcggcgtccacttccacaagacacagccgctcttcgtatcaggaggtgatgattacaagatcaaggtgtggaactacaagacgcaccgctgcctcttcacgctccatggccaccttgactacatccgcacggtgcagtttcacgacgagcatccatggatcgtcagtgctagcgatgaccagacaatccgtgtatggaactggcagtcgcgcacttgtgtggcagttttgacagggcataatcactatgtcatgtgtgcctccttccatcccaaggaggacctggtcgtgtcggcatctctggatcagactgtccgggtgtgggatattggggcgctcaggaagaagtcatcgtctccagccgatgacattctgcgtctcactcagatgaacactgacctgtttggaggcattgatgctgtggtcaagtatgtcttggagggtcataaccgtggggtcaactgggcctcgtttcatcccacgctgccgcttattgtttctggggcagatgaccggcaagtgaaactctggagaatgaatgatacaaaggcatgggaggttgatactctgagaggtcacatgaataatgtgtcctgtgtactgttccacgcgaagcaggacatcatcgtgtccaactcagaagataaaagcattcgtgtttgggatgccacaaagagaactggtatccagacattcaggcgggagcatgatcgcttctgggtccttgctgctcacccggaaatgaatcttcttgcagctggtcatgatagtggcatgattgtgttcaaattggagagggaacgtccagctttctccgtcagtggtgataccgtgttctatgtgaaggaccggttcctccgtttttatgagtactcagcacagaaggaggtccaggtggctccgataagaaggcctggatcagtcaccttgaatcagtcaccaaggtcattatcatatagcccaactgagaatgctgtcttgatctgctctgatgtggatgggggctcgtatgagctttacattgtccccaaggattctgctggcagggctgattatttgcaggatgcaaagaagggagctggtggttctgcagttttcatagctcgaaaccggtttgcagtcctggagaagagcagtaaccaggttttggtgaagagtcttaagaatgagattgtgaagaaaagtcctcttccaattgcaactgatgctatttactatgctggaactggtaacatattgtgcaaagctgaagacagggtggccatctttgatctgcagcagcggcttgttcttggtgaactccaggcatctgctgttaagtatgtggtttggtcaagtgatatggagtcagttgcactgctcagcaaacatgctgtagtcattgcaaacaagaagcttgtccatcgctgcacacttcatgaaaccatacgcgtaaagagtggtgcctgggatgaaaatggcgtgtttatgtattccactttgaaccatatcaagtactgccttcctaatggtgacaatggcatcatcaaaacacttgatgttcctatttacataaccagggttgcagggaacatcatctgctgtctggatcgcgatggaaagaacaagatgataacaattgatgcttctgaatacattttcaagctggcccttctacgtaagcgctatgatcatgttatgagcatgatcaagaactcgcagctgtgtggacaggcggtcatttcttatttacaacagaaaggatttccagaggttgctctccatttcgtgaaagatgagaagaccaggtttaacctggctcttgagagcgggaacatccaaattgctgttgcttctgcaaaggagcttgatgacaaggatcactggtacaggttgggaatcgaggctctgaggcagggaaatgttggtattgtagaatatgcttaccagcggacaaagaattttgacaggcttgcctttctttatctgataactggttacttggacaaggtgggctttatgtctaagatagctggccagaataacaatttgatgggccagttccacaatgcgctgtatcttggggatgttaggaagagagttgagatcttggagaatgcggggcagctacctcttgcatatgtaactgctgccactcatggacttcctgaaatcgctgataggcttgctaatgaattgggagaaaatgtaccagctctacctgaagggaaaaatagttcacttttgattcctcctgcacctctcatagctagcagtgactggccattgttgagggtgatgcgtggtatttttgatggtggactagatgctactgggagggcagagcaggaggaagactatgaagatgctggtgctggtggtgattggggagacgaagacctagaaattgttgatgtaagtaatgtggtagagaatggagacgcgggccatggtgagggaagtgaagcaaatgaagaggatggagaagaagaaggtggctgggacctggaagatctggaattgccacctgaggcagatacaccaaaagctaccggtcctgcccgctctgctttgtttgtggctcccacaccaggcatgcccgtcagccaaatttggactcagaagtcatctcttgctggggagcatgctgcagcagggaatttcgacactgcaatgcggctgcttagccgccagttgggcatcaggaactttgctcctctgaagaccttgtttcttgatgcacatatgggaagtcatacctttctgcgtgcatttgcaagtgctccagtgatacctgttgctgttgagaaaggctggactgaaactgctagtcccaacgtgaggggcccacctgcacttgtgttcagcttctcgcagatggacgacaagcttaaggctgcatataaggccacgaccgagggtaaattcccagaagcactgaggcagttcctcaacatcctatacaccatcccgctccttgtcgtggactcgcggcgagaagtcgatgaagtgaaggagctcattgagatagtgagggagtacgtcctcggcctcaggatggaagtcaagaggaaggagctgaaaaacgacgccacccggcaacaggagctggctgcatacttcactaactgcaagctacagaaggtccacatgcgtctggtcctaaccagtgccatgggtctctgcttcaagggtgggaactatgccactgccgcaaacttcgcccgcatgctcctggagaacagcccgaacgaggcccaagcgaagaaggcccgccaggtcctgcaggcctgtggcgacaggaaagatgcccatcaactgaactatgacttcaggaacccgttcgttgtgtgcggagcaacctttgttccgatctaccgcgggcagaaggatgtctcctgcccctactgcacgtcccggttcatgccctccgtcgagggccagctctgcaccatctgtgagctctcggtggtcggagcggacgcctcgggcctcctctgctctcctacacagtcgagataagcggtgattgtgctggctttcacccctgtgttcatgtttgtatctccagttcaaagaccgctgctgtgttgtcgttatattctaccagagatttgaattaccaaacttgtgaggaataagtatagtataattggttgttttcttccttcttgtcctcggttttagtctcatacgggctgcggtgaaacaaacgctgtaggattttggacagatccatttttaggaccaaatgatgatgtatttaattgagaattccattatatgatgtaccaccatg

SEQ ID NO: 836 - DNA, 4006 bp, Avena sativa
ctcccgccggtgggtttaggggccccgccgggccgccgtcctcgtcggcggcgccgagatgctgaccaagttcgagaccaagagcaaccgcgtcaaggggctcgccttccacccgcgcaggccatggatcctcgccagcctccacagcggggtcgtccagatgtgggactaccgcatgggcaccctcctcgaccgcttcgacgagcacgacgggcccgtacgcggcgtccacttccacaagacgcagccgctcttcgtatcaggaggtgatgattacaagatcaaggtgtggaactacaagacgcaccgctgcctcttcacgctccatggccaccttgactacatccgcacggtccagttccacgacgagcatccatggatcgtcagtgctagcgatgaccagacaatccgtgtatggaactggcagtcgcgcacttgtgtggcagttttgacagggcataatcactatgtcatgtgtgcctccttccatcccaaggaggacctggtcgtgtcggcatctctggatcagactgtccgggtgtgggatattggggcgctcaggaagaagtcgtcgtccccagccgatgacattctgcgtctcactcagatgaacactgacctgtttggaggcattgatgctgtggtcaagtatgtcttggagggtcataaccgtggggtcaactgggcctcgtttcatcccacgctgccacttattgtttctggggcagatgaccggcaagtgaaactctggagaatgaatgatacaaaggcatgggaggttgatactctgagaggtcacatgaataatgtgtcctgtgtactgttccacgcaaagcaggacatcatcgtgtccaactcagaagataaaagcatccgtgtttgggatgccacaaagagaactggtatccagacatttaggcgggagcatgatcgcttctgggtccttgctgctcacccggaaatgaatcttcttgcagctggtcatgatagtggcatgattgtgttcaaattggagagggaacgtccagctttctccgtcagtggtgataccgtgttctatgtgaaggaccggttcctccgtttttacgagtactcagcacagaaggaggttcaggtggctccgataagaaggcctggatcagtcaccttgaatcagtcaccaaggtcattatcatatagcccaactgagaatgctgtcttgatctgctctgatgtggatgggggctcgtatgagctttacattgtccccaaggattctgctggcagggctgattatttgcaggatgcaaagaagggagctggtggttctgcagttttcatagctcgaaaccggtttgcagtcctggagaagagcagtaaccaggttttggtgaagagtcttaagaatgagattgtgaagaaaagtcctcttccaattgcaactgatgctatttactatgctggaactggtaacatattgtgcaaagctgaagacagggtggccatctttgatctgcagcagcggcttgttcttggtgaactccaggcatctgctgttaagtatgtggtttggtcaagtgatatggagtcagttgcactgctcagcaagcatgctgtagtcattgcaaacaagaagcttgtccatcgctgcacacttcacgaaaccatacgtgtaaagagtggtgcctgggatgaaaatggcgtgtttatgtattccactttgaaccatatcaagtactgccttcctaatggtgacaatggcatcatcaaaacacttgatgttcctatttacataaccagggttgcagggaacatcatctgctgtctggatcgcgatggaaagaacaagatgataacaattgatgcttctgaatacattttcaagctggcccttctacgtaagcgctatgatcatgttatgagcatgatcaagaactcgcagctgtgtggacaggcggtcatttcttatttacaacagaaaggatttccagaggttgctctccacttcgtgaaagatgagaagaccaggtttaacctggctcttgagagcgggaacatccaaattgctgttgcttctgcaaaggagcttgatgacaaggatcactggtacaggttgggaattgaggctctgaggcagggaaatgttggtattgtagaatatgcttaccagcggacaaagaattttgacaggcttgcctttctttatctgataactggttacttggacaaggtgggctttatgtctaagatagctgggcagaataacaatttgatgggccagttccacaatgcgctgtatcttggggatgttaggaagagagttgagatcttggagaatgcggggcagctacctcttgcatatgtaactgctgccactcatggacttcctgaaatcgctgataggcttgctaatgaattgggagaaaatgtaccagctctacctgaagggaaaaatagttcacttttgattcctcctgcacctctcatagctagcagtgattggccattattgagggtgatgcgtggtatttttgatggtggactagatgctactgggagggcagagcaggaggaagactatgaagatgctggtgctggtggtgattggggagacgaagacctagaaattgttgatgtaagtaatgtggtagaaaatggagatgctggtcatggtgagggaagtgaagcaaatgaagaggatggagaagaggaaggtggctgggacctggaagatctggaattgccaccagaggcagatacacccaaagctactggtcctgcccgctctgctttgtttgtggctcccacaccaggcatgcctgtcagccaaatttggactcagaagtcgtctcttgctggggagcatgctgcagcggggaatttcgacaccgcaatgcggctgcttagccgccagttgggcatcaggaactttgctcctctgaagaccttgtttcttgatgcacatatgggaagtcatacctttctgcgtgcatttgcaagcgctccagtgatacctgttgctgttgagaaaggctggactgaaactgctagtcccaatgtgaggggcccacctgcacttgtgttcagcttctcgcagatggacgacaagcttaaggctgcatataaggctacaaccgagggtaaattcccagaagcactgaggcagttcctcaacatcctatacaccatcccgctccttgtcgtggactcgcggcgagaagttgatgaagtgaaggagctcattgagatagtgagggagtacgtccttggcctcaggatggaagtcaagaggaaggagctgaaaaacgacgccacccggcaacaggagctggctgcatacttcaccaactgcaagctacagaaggtccacatgcgtctggtcctaaccagtgccatgggtctctgcttcaagggtgggaactatgccactgccgcaaacttcgcccgcatgctcctggagaacagcccgaacgaggcccaagcgaagaaggcccgccaggtcctgcaggcctgtggcgacaggaaagatgcccatcaactgaactatgacttcaggaacccgttcgttgtgtgcggagcaacctttgttccgatctaccgcgggcagaaggatgtctcctgcccctactgcacgtcccggttcatgccctccgtcgagggccagctctgcaccatctgtgagctctcggtggtcggagcggacgcctcgggcctcctctgctctcctacacagtcgagataagcggtgattgtgctggctttcacccctgtgttcatgtttgtatctccagttcaaagaccgctgctgtgttgtcgttatattctaccagagatttgaattaccaaacttgtgaggaataagtatagtataattggttgttttcttccttcttgtcctcggttttagtctcatacgggctgcggtgaaacaaacgctgtaggattttggacagatccatttttaggaccaaatgatgatgtatttaattgagaatttcattatatgatgtaccaccatgtttgtgtc

SEQ ID NO: 837 - DNA, 4169 bp, Brachypodium distachyon
ccttttctctcttcctgctcccggtttctcttgagatcttagccttgtaccgtcacaaatctgtggcgtcctcgccgtcggcaaggacattggacagtacgttaccctccttccttctccctctctcgagccggtgggtgggtttagggggtgtgccatcgccggagtggagaggaagggctggccgtccaaggcggcggcgggggcgagatgctgaccaagttcgagaccaagagcaaccgcgtcaagggcctcgccttccacccgcgccgcccatggatcctcgccagtctccacagcggggtcgtccagatgtgggactaccgcatgggcacgctcctcgaccgcttcgacgagcacgacgggcccgtacgcggtgtccacttccacaagacgcagccgctcttcgtatctggaggtgatgattacaagattaaggtgtggaactacaagacacaccgctgcctcttcacgctccatggtcaccttgattacatccgcactgtccagttccatgacgagcatccatggatcgtgagtgctagcgatgaccagacaatccgtatttggaattggcagtcacgtacatgtgtggcggtgttgacagggcataatcactatgtcatgtgtgcttccttccatcccaaggaggacctggtcgtgtcagcatctctggatcagactgtccgcgtgtgggatattggggcactcaggaagaagtcggcctccccagcggatgacattatgcgtctcacgcagatgaacactgatctgtttggaggcattgatgctgttgtcaagtatgtcttggagggtcatgaccgtggggtcaattgggcttcatttcatcccacactgccacttatcgtttctggggcagatgaccggcaagtgaaactgtggagaatgaatgatacaaaggcgtgggaggttgatactctgaggggtcacatgaataatgtgtcatgtgtattgttccacgcgaagcaagacatcatcgtatccaactcggaagacaaaagcattcgcgtgtgggatgcaacgaagagaactggtatccagacattcaggcgagagcatgaccgcttctggatccttgctgctcaccctgaaatgaatcttcttgccgctggtcatgatagtggcatgattgtgtttaagttggagagggaacgccctgctttctccgtaagtggcgatacagtgttctatgtgaaggatcgcttcctccgtttctatgagtactcgacacagaaagaggtccaggtggctccgataagaaggcctggatcagtcagcttgaatcagtcaccaaggacgttgtcacacagcccaactgagaatgctgtcttgatctgctctgatgtggatgggggctcatacgagctttatattgttccaaaggactctgctggtagggctgattacttgcaggacacgaagaaaggagctggtggttctgcagttttcatagcacgcaaccggtttgcagtcttggagaagagcagcaaccaggttttggtgaagagtcttaagaatgagattgtgaagaaaactccagtacctattgcaactgacgctatttactatgctggaactggtaacgtattgtgcaaagccgaagacagggtggccatctttgatctgcagcagcggcttgttattggtgaactccaggtatctgctgttaagtatgtggtttggtccagtgatatggagtctgttgcattgctcagcaagcatgccgtagtcattgcaaacaagaagcttgtccatcgctgcacacttcatgaaaccatacgtgtaaagagtggtgcctgggatgaaaatggtgtgttcatatattccactctgaaccatatcaagtattgccttcctaatggggacagtggtattatcagaactgttgatgttcctatttacataaccagagttgcggggaacaacatttgctctctggatcgtgatggaaagaacaagataattatggttgatgcatctgaatacattttcaagctggcccttctacggaaacgctacgatcatgttatgagcatgatcaagagctcgcagctgtgtgggcaagcggtcatttcttacctgcaacagaaagggtttccagaagttgctctacactttgtgaaagatgagaaaaccagatttaacctggctcttgagagcgggaacattcaaattgctgttgcttcagcaaaagagcttgatgacaaggatcactggtacaggttgggaattgaggctctgagacagggaaatgttggtattgttgaatatgcataccagagaacaaagaattttgacaggcttgcttttctttatctgctaactggttacttggacaaggtgggctttatgtctaagatagctggacagaacaacaatttgatgggccagtttcacaatgcattgtatcttggggatgttaggaaaagagttgagatattggagagtgctggacaggtacctcttgcctatgtaactgcagccactcatgggctcactgaaattgccgataggcttgctagtgaattgggagaaaatgtgccttctctgcctgaaggaaaaggtagatcacttttaattcctcccgcacctctcacggcttgtggtgattggccattgttgagggtgatgcgaggtatttttgagggtggactagatgctactggtagggcagagcaggatgaagactatgaagatgctggtggtgactggggggatgaagaccttgaaattgttgatgtaagtaatgtggttgaaaatggagatataactgtccatgttgaggaaaatgggacaaatgaagaggatggagaagaggaaggtggctgggaccttgaggacctggaattaccacctgaggcagagacaccaaaagctacaggtccgtcccgttctgctttgtttgtggttcctacaccaggcatgcctgtcagccaaatttggactcagaaatcatctcttgctggagagcatgctgcagctgggaattatgacactgcaatgcgattgcttagccgccagttgggcataaggaactttgctcctctgaaagccttgtttcttgatgcacatatgggcagtcatacctttctgcgtgcatttgcaagtgctccagttatacctgttgctgttgagaagggctggagtgaatctgctagtcccaatgtgaggggcccacctgcactcgtgtttagcttctcacaaatggacgacaagcttaaggctgcatataaagccacaaccgagggtaaattcccagaagcactgaggcagtttcttaacatcctctacaccattccactccttgttgtggactcgcggagagaagttgatgaagtgaaggagctcattgagatagtgagagaatatgttcttggtcttaagatggaagtcaaaaggaaggagctgaaagatgacgcgacacgccaacaggagttggctgcatacttcactaactgcaagctgcagaaggttcatatgcgtcttgtcctcaccagtgccatgggtctttgcttcaagggtggaaactacgccacggcagcgaactttgcgcgaatgcttctggagaacagcccaaatgaggcccaggcaaagaaggctcggcaagttctgcaggcttgcggtgacaggaaagatgggcatcagctgaactatgacttcagaaatccatttgttgtgtgtggagcaacctttgttccaatataccgtgggcagaaggatgtttcctgcccatattgtgcgtctcggtttgtgccctccgtagaaggtcagctttgcagcatatgtgagctttcggtggttggagcagatgcttcaggactcctatgctctcctacacaatcgagatgagtggtgatggtggcttcaccttgtgaccaagtttgtaagtccagtgcgaagactgttgtcgttatactctaccagggatttaattaccaagttgtgaggaataagtatagtaattggttgtcttgcgtcgtttattcgtctttgtccttattttagtgtcatgcggcggtggtaaaatgctgtaggattttgaacagttcctattaggacaaaatgatgtatttaattgagattgcactatatcttgtaccatatttgcgtacgtatggctgatctttattgtttctcctttactgaga

SEQ ID NO: 838 - DNA, 4184 bp, Brachypodium distachyon
atccccttttctctcttcctgctcccggtttctcttgagatcttagccttgtaccgtcacaaatctgtggcgtcctcgccgtcggcaaggacattggacagtacgttaccctccttccttctccctctctcgagccggtgggtgggtttagggggtgtgccatcgccggagtggagaggaagggctggccgtccaaggcggcggcgggggcgagatgctgaccaagttcgagaccaagagcaaccgcgtcaagggcctcgccttccacccgcgccgcccatggatcctcgccagtctccacagcggggtcgtccagatgtgggactaccgcatgggcacgctcctcgaccgcttcgacgagcacgacgggcccgtacgcggtgtccacttccacaagacgcagccgctcttcgtatctggaggtgatgattacaagattaaggtgtggaactacaagacacaccgctgcctcttcacgctccatggtcaccttgattacatccgcactgtccagttccatgacgagcatccatggatcgtgagtgctagcgatgaccagacaatccgtatttggaattggcagtcacgtacatgtgtggcggtgttgacagggcataatcactatgtcatgtgtgcttccttccatcccaaggaggacctggtcgtgtcagcatctctggatcagactgtccgcgtgtgggatattggggcactcaggaagaagtcggcctccccagcggatgacattatgcgtctcacgcagatgaacactgatctgtttggaggcattgatgctgttgtcaagtatgtcttggagggtcatgaccgtggggtcaattgggcttcatttcatcccacactgccacttatcgtttctggggcagatgaccggcaagtgaaactgtggagaatgaatgatacaaaggcgtgggaggttgatactctgaggggtcacatgaataatgtgtcatgtgtattgttccacgcgaagcaagacatcatcgtatccaactcggaagacaaaagcattcgcgtgtgggatgcaacgaagagaactggtatccagacattcaggcgagagcatgaccgcttctggatccttgctgctcaccctgaaatgaatcttcttgccgctggtcatgatagtggcatgattgtgtttaagttggagagggaacgccctgctttctccgtaagtggcgatacagtgttctatgtgaaggatcgcttcctccgtttctatgagtactcgacacagaaagaggtccaggtggctccgataagaaggcctggatcagtcagcttgaatcagtcaccaaggacgttgtcacacagcccaactgagaatgctgtcttgatctgctctgatgtggatgggggctcatacgagctttatattgttccaaaggactctgctggtagggctgattacttgcaggacacgaagaaaggagctggtggttctgcagttttcatagcacgcaaccggtttgcagtcttggagaagagcagcaaccaggttttggtgaagagtcttaagaatgagattgtgaagaaaactccagtacctattgcaactgacgctatttactatgctggaactggtaacgtattgtgcaaagccgaagacagggtggccatctttgatctgcagcagcggcttgttattggtgaactccaggtatctgctgttaagtatgtggtttggtccagtgatatggagtctgttgcattgctcagcaagcatgccgtagtcattgcaaacaagaagcttgtccatcgctgcacacttcatgaaaccatacgtgtaaagagtggtgcctgggatgaaaatggtgtgttcatatattccactctgaaccatatcaagtattgccttcctaatggggacagtggtattatcagaactgttgatgttcctatttacataaccagagttgcggggaacaacatttgctctctggatcgtgatggaaagaacaagataattatggttgatgcatctgaatacattttcaagctggcccttctacggaaacgctacgatcatgttatgagcatgatcaagagctcgcagctgtgtgggcaagcggtcatttcttacctgcaacagaaagggtttccagaagttgctctacactttgtgaaagatgagaaaaccagatttaacctggctcttgagagcgggaacattcaaattgctgttgcttcagcaaaagagcttgatgacaaggatcactggtacaggttgggaattgaggctctgagacagggaaatgttggtattgttgaatatgcataccagagaacaaagaattttgacaggcttgcttttctttatctgctaactggttacttggacaaggtgggctttatgtctaagatagctggacagaacaacaatttgatgggccagtttcacaatgcattgtatcttggggatgttaggaaaagagttgagatattggagagtgctggacaggtacctcttgcctatgtaactgcagccactcatgggctcactgaaattgccgataggcttgctagtgaattgggagaaaatgtgccttctctgcctgaaggaaaaggtagatcacttttaattcctcccgcacctctcacggcttgtggtgattggccattgttgagggtgatgcgaggtatttttgagggtggactagatgctactggtagggcagagcaggatgaagactatgaagatgctggtggtgactggggggatgaagaccttgaaattgttgatgtaagtaatgtggttgaaaatggagatataactgtccatgttgaggaaaatgggacaaatgaagaggatggagaagaggaaggtggctgggaccttgaggacctggaattaccacctgaggcagagacaccaaaagctacaggtccgtcccgttctgctttgtttgtggttcctacaccaggcatgcctgtcagccaaatttggactcagaaatcatctcttgctggagagcatgctgcagctgggaattatgacactgcaatgcgattgcttagccgccagttgggcataaggaactttgctcctctgaaagccttgtttcttgatgcacatatgggcagtcatacctttctgcgtgcatttgcaagtgctccagttatacctgttgctgttgagaagggctggagtgaatctgctagtcccaatgtgaggggcccacctgcactcgtgtttagcttctcacaaatggacgacaagcttaaggctgcatataaagccacaaccgagggtaaattcccagaagcactgaggcagtttcttaacatcctctacaccattccactccttgttgtggactcgcggagagaagttgatgaagtgaaggagctcattgagatagtgagagaatatgttcttggtcttaagatggaagtcaaaaggaaggagctgaaagatgacgcgacacgccaacaggagttggctgcatacttcactaactgcaagctgcagaaggttcatatgcgtcttgtcctcaccagtgccatgggtctttgcttcaagggtggaaactacgccacggcagcgaactttgcgcgaatgcttctggagaacagcccaaatgaggcccaggcaaagaaggctcggcaagttctgcaggcttgcggtgacaggaaagatgggcatcagctgaactatgacttcagaaatccatttgttgtgtgtggagcaacctttgttccaatataccgtgggcagaaggatgtttcctgcccatattgtgcgtctcggtttgtgccctccgtagaaggtcagctttgcagcatatgtgagctttcggtggttggagcagatgcttcaggactcctatgctctcctacacaatcgagatgagtggtgatggtggcttcaccttgtgaccaagtttgtaagtccagtgcgaagactgttgtcgttatactctaccagggatttaattaccaagttgtgaggaataagtatagtaattggttgtcttgcgtcgtttattcgtctttgtccttattttagtgtcatgcggcggtggtaaaatgctgtaggattttgaacagttcctattaggacaaaatgatgtatttaattgagattgcactatatcttgtaccatatttgcgtacgtatggctgatctttattgtttctcctttactgagagttgctttgtg

SEQ ID NO: 839 - DNA, 4525 bp, Setaria italica
cgtaatcgtcacgccttcacggccaagcaaggctttgcccgtcagatccccttggccgaggagatcaacaccttccgcttcctccctcgtccacctgcattctcttcctcctccctctccccgctccagatccaacacctcctcctccgccaggccgccaccgccgagattagatcctcctctcttccgactcccctgctgactgatcgtctccgggggagctaggaagatgctcaccaagttcgagaccaagagcaaccgggtcaagggcttggccttccacccgcggcggccatggatcctggcgagcctccacagcggcgtcatccagatgtgggactaccggatgggcaccctgctcgaccgcttcgacgagcacgacgggcccgtcaggggcgtccacttccacgccacgcagccgctcttcgtctccggaggtgatgattacaaaataaaggtgtggaactacaagactcaccgctgcctcttcacgctccacggccacctcgactacattcgcaccgtgcagttccatgccgagtatccttggattgtcagtgctagtgacgaccagacaatccggatctggaactggcagtcgcgcacctgtgtcgccgtgctcacgggtcataatcattatgtcatgtgtgcctccttccatcccaaggaggaccttgtggtgtcagcgtctttggaccagactgtgcgggtatgggatattggggcactcaggaagaaagcagtctcaccagcagatgacattatgcgcctcacccaaatgaacaccgatctgttcggaggcatcgatgctgttgtcaagtatgtgttggaaggccatgaccgcggggttaactgggcctcatttcatcccacattacctcttattgtttctggggctgatgaccgccaaatcaaactgtggagaatgaatgacacaaaggcatgggaggttgatactctcaggggccacatgaacaatgtgtcatgtgtcatgttccacgcgaagcaggacatcattgtgtccaactcagaagataaaagcatccgcatttgggatgccactaagagaaccggcatccagacattcaggcgggagcatgaccgcttctggattcttgctgcgcaccctgaaatgaatcttcttgctgctggtcatgacagtggcatgattgtttttaagttggagagggaacgcccggctttcagtgtgagtggtgatacagtgttctatgttaaggaccggttcctccggtattacgaatactccacacagaaggaggttcaggtagctccaatcagaaggcccggaacagtcagcttgaatcagtcaccaagaacattgtcatatagtccaactgagaacgcaatcttgatatgttctgatgtggatgggggctcgtatgagctgtacattgtgcccaaggactctgccgggaggtctgattatttgcaggaggcaaggaagggagctggtagttctgcagttttcatagcccgcaatcggtttgcagtgctggagaagagcagcaacaatgttttggttaagaaccttaagaatgagattgtgaagaaaacctctcttcctattgcaacagatggaatttattacgctgggactggcaacatattgtgcaaagctgaagacagggtggtaatctttgatctgcagcagaggcttgttctcggcgaactccaggcaccttctgttaagtatgtagtttggtccagtgatatggagtgtgttgcactgctgagcaagcatgccattatcattgcaaacaagaagcttgtccaccgctgcacgcttcatgaaaccatacgtgtgaagagtggtgcctgggatgaaaatggtgtattcatatacaccactctgaaccatatcaagtattgtcttcctaatggtgatagtggcatcatcagaacacttgatgtcccaatttacataaccaaagttattgggaataacatcttctgtatagaccgtgatggaaagaacaagttgataacggttgatgcttctgaatacattttcaagcttgcccttttccggaaacgctatgaccatgtcatgagcatgattaagaactcgcagctatgtgggcaagctgtgatttcttatttgcaacagaaagggtttccagaagtcgccctccactttgtaaaagatgagaagacaagatttaacctggctcttgaaagtggaaatatccagattgctgttgcttcagcaaaggagcttgatgacaaggatcactggtacaggttgggaattgaggctctgaggcagggaaatgttggtatagttgagtatgcataccagcggactaagaattttgacaggcttgcttttctgtatctcataacaggttatttggacaaggtgggctttatgtgtaagatagctgggcagaataacaatttcatgggccagttccacaacgcactttatctcggggatgtacggaagcgagttgaaatcttggagaatgcagggcagctagctcttgcgtatgtaacagctgtcactcatgggctcacggaaatcgctgataggctttctgctgagttgggggagaatgtcccttctgtatcagatgggaaaactagctcactgttgattccgcctgctcctcttatgtcttgtggtgactggcctttgttgagggtgatgcgtggtatatttgatgctggtctagatgctactgggagggcagatcaggaggaagactatgatgatgctggtggtgattggggtgatgaagatcttgagattgttgatgtgaacaatgtggtggagaatggagatgtcgttgaccacaatgaggaagaggaggtgaacgaagaggaaggtggctgggaccttgaagatctggaattgccaccagaggcagaaacaccaaaggctgttggtgtggcccgctccactttgtttgtggctccaacgccaggtatgcctgtcagccaaatttggacgcagaagtcttcccttgctggggagcatgctgcagctggcaactttgacactgcgatgcggctgcttagccgccagcttggaataaaaaattttgctcctctgaagccattgttcctcgatgcactcatgggcagccataccttcctgcgtgcatttgcaagtgctccggttatacctgttgctgttgagaaaggatggagtgaatctgctagtcctaatgtgaggggcccacctgcacttgtgtttaccttctcacaaatggatgacaagcttaaggctgcatataaagccacaaccgagggtaaattcccggaggcactgaggcagttcctgagcatcctgcacacgatcccgctccttgtggtggactcgcggagagaagtggatgaggtgaaggaattgattcagatagcgagggagtatgtccttggtcttaagatggaagttaaaaggaaggagctgaaagaagaccccatcaggcagcaggagctggctgcctacttcactaattgcaacctgcagaaggtccacacgcggcttgtcctgactagcgctatggggctttgcttcaagggtgggaactatgctactgcagcgaattttgcgcggatgcttctggagaacaaccctaatgaggcccaggcaaagaaggctcggcaggttgtgcaggcctgtggggataggaaagatgggcgccagctgaactatgactttagaaatccatttgtggtgtgtggggcaacctttgttccaatataccgtggacagaaggatgtttcttgtccgtactgtggatctcggttcatgccctcggtggaaggtgagctgtgtagcatatgcgagctctcagtggttggtgcggatgcttcaggcctcctctgctctcctacacaatcgagataagtggccttcagtcttgacaggttggtggcagctaccgcaagcctgatattaccaagccagctgtgattgtgttttttgtatggtgatggtgatgcaatatgccaagatcaaaggactgggtcaacaagtcgctaaaggaacaaatttttgtatttagttgagaattcctccaaattatatgatgatgtgctatgttggatgggataatttcttcctctttggtaactgcttatttggttttcttgctacacgtgtacgttgtaacagtatttcggtaggtcttgggccgctctggcttgcaagtgcagacttgcagttgcagggcatattcattcccaatgacttggactaatagtatgtatactcagcttcctgttagctagccagtgtgtgatttgtgtttcagctatctcagagcatcgtggcatactggcatggatgcttggagggtggaatgctgcaacgcactgcacttctttagccgggctcgatgctcaatgctcctgtattcaatgcatcgtgtgtggaatcaactgtacatacaggggcaggcttcaatagtccctgaaaaatgtgtccaacctttgttatctcagagcatagcatcagaagcagaaaattatcttaattggcataggcgcctgatca

SEQ ID NO: 840 - DNA, 4503 bp, Setaria italica
tcacgccttcacggccaagcaaggctttgcccgtcagatccccttggccgaggagatcaacaccttccgcttcctccctcgtccacctgcattctcttcctcctccctctccccgctccagatccaacacctcctcctccgccaggccgccaccgccgagattagatcctcctctcttccgactcccctgctgactgatcgtctccgggggagctaggaagatgctcaccaagttcgagaccaagagcaaccgggtcaagggcttggccttccacccgcggcggccatggatcctggcgagcctccacagcggcgtcatccagatgtgggactaccggatgggcaccctgctcgaccgcttcgacgagcacgacgggcccgtcaggggcgtccacttccacgccacgcagccgctcttcgtctccggaggtgatgattacaaaataaaggtgtggaactacaagactcaccgctgcctcttcacgctccacggccacctcgactacattcgcaccgtgcagttccatgccgagtatccttggattgtcagtgctagtgacgaccagacaatccggatctggaactggcagtcgcgcacctgtgtcgccgtgctcacgggtcataatcattatgtcatgtgtgcctccttccatcccaaggaggaccttgtggtgtcagcgtctttggaccagactgtgcgggtatgggatattggggcactcaggaagaaagcagtctcaccagcagatgacattatgcgcctcacccaaatgaacaccgatctgttcggaggcatcgatgctgttgtcaagtatgtgttggaaggccatgaccgcggggttaactgggcctcatttcatcccacattacctcttattgtttctggggctgatgaccgccaaatcaaactgtggagaatgaatgacacaaaggcatgggaggttgatactctcaggggccacatgaacaatgtgtcatgtgtcatgttccacgcgaagcaggacatcattgtgtccaactcagaagataaaagcatccgcatttgggatgccactaagagaaccggcatccagacattcaggcgggagcatgaccgcttctggattcttgctgcgcaccctgaaatgaatcttcttgctgctggtcatgacagtggcatgattgtttttaagttggagagggaacgcccggctttcagtgtgagtggtgatacagtgttctatgttaaggaccggttcctccggtattacgaatactccacacagaaggaggttcaggtagctccaatcagaaggcccggaacagtcagcttgaatcagtcaccaagaacattgtcatatagtccaactgagaacgcaatcttgatatgttctgatgtggatgggggctcgtatgagctgtacattgtgcccaaggactctgccgggaggtctgattatttgcaggaggcaaggaagggagctggtagttctgcagttttcatagcccgcaatcggtttgcagtgctggagaagagcagcaacaatgttttggttaagaaccttaagaatgagattgtgaagaaaacctctcttcctattgcaacagatggaatttattacgctgggactggcaacatattgtgcaaagctgaagacagggtggtaatctttgatctgcagcagaggcttgttctcggcgaactccaggcaccttctgttaagtatgtagtttggtccagtgatatggagtgtgttgcactgctgagcaagcatgccattatcattgcaaacaagaagcttgtccaccgctgcacgcttcatgaaaccatacgtgtgaagagtggtgcctgggatgaaaatggtgtattcatatacaccactctgaaccatatcaagtattgtcttcctaatggtgatagtggcatcatcagaacacttgatgtcccaatttacataaccaaagttattgggaataacatcttctgtatagaccgtgatggaaagaacaagttgataacggttgatgcttctgaatacattttcaagcttgcccttttccggaaacgctatgaccatgtcatgagcatgattaagaactcgcagctatgtgggcaagctgtgatttcttatttgcaacagaaagggtttccagaagtcgccctccactttgtaaaagatgagaagacaagatttaacctggctcttgaaagtggaaatatccagattgctgttgcttcagcaaaggagcttgatgacaaggatcactggtacaggttgggaattgaggctctgaggcagggaaatgttggtatagttgagtatgcataccagcggactaagaattttgacaggcttgcttttctgtatctcataacaggttatttggacaaggtgggctttatgtgtaagatagctgggcagaataacaatttcatgggccagttccacaacgcactttatctcggggatgtacggaagcgagttgaaatcttggagaatgcagggcagctagctcttgcgtatgtaacagctgtcactcatgggctcacggaaatcgctgataggctttctgctgagttgggggagaatgtcccttctgtatcagatgggaaaactagctcactgttgattccgcctgctcctcttatgtcttgtggtgactggcctttgttgagggtgatgcgtggtatatttgatgctggtctagatgctactgggagggcagatcaggaggaagactatgatgatgctggtggtgattggggtgatgaagatcttgagattgttgatgtgaacaatgtggtggagaatggagatgtcgttgaccacaatgaggaagaggaggtgaacgaagaggaaggtggctgggaccttgaagatctggaattgccaccagaggcagaaacaccaaaggctgttggtgtggcccgctccactttgtttgtggctccaacgccaggtatgcctgtcagccaaatttggacgcagaagtcttcccttgctggggagcatgctgcagctggcaactttgacactgcgatgcggctgcttagccgccagcttggaataaaaaattttgctcctctgaagccattgttcctcgatgcactcatgggcagccataccttcctgcgtgcatttgcaagtgctccggttatacctgttgctgttgagaaaggatggagtgaatctgctagtcctaatgtgaggggcccacctgcacttgtgtttaccttctcacaaatggatgacaagcttaaggctgcatataaagccacaaccgagggtaaattcccggaggcactgaggcagttcctgagcatcctgcacacgatcccgctccttgtggtggactcgcggagagaagtggatgaggtgaaggaattgattcagatagcgagggagtatgtccttggtcttaagatggaagttaaaaggaaggagctgaaagaagaccccatcaggcagcaggagctggctgcctacttcactaattgcaacctgcagaaggtccacacgcggcttgtcctgactagcgctatggggctttgcttcaagggtgggaactatgctactgcagcgaattttgcgcggatgcttctggagaacaaccctaatgaggcccaggcaaagaaggctcggcaggttgtgcaggcctgtggggataggaaagatgggcgccagctgaactatgactttagaaatccatttgtggtgtgtggggcaacctttgttccaatataccgtggacagaaggatgtttcttgtccgtactgtggatctcggttcatgccctcggtggaaggtgagctgtgtagcatatgcgagctctcagtggttggtgcggatgcttcaggcctcctctgctctcctacacaatcgagataagtggccttcagtcttgacaggttggtggcagctaccgcaagcctgatattaccaagccagctgtgattgtgttttttgtatggtgatggtgatgcaatatgccaagatcaaaggactgggtcaacaagtcgctaaaggaacaaatttttgtatttagttgagaattcctccaaattatatgatgatgtgctatgttggatgggataatttcttcctctttggtaactgcttatttggttttcttgctacacgtgtacgttgtaacagtatttcggtaggtcttgggccgctctggcttgcaagtgcagacttgcagttgcagggcatattcattcccaatgacttggactaatagtatgtatactcagcttcctgttagctagccagtgtgtgatttgtgtttcagctatctcagagcatcgtggcatactggcatggatgcttggagggtggaatgctgcaacgcactgcacttctttagccgggctcgatgctcaatgctcctgtattcaatgcatcgtgtgtggaatcaactgtacatacaggggcaggcttcaatagtccctgaaaaatgtgtccaacctttgttatctcagagcatagcatcagaagcagaaaattatcttaattggca

SEQ ID NO: 841 - DNA, 3857 bp, Secale cereale
cacagcggggtcgtccagatgtgggactaccgcatgggcaccctcctcgaccgcttcgacgagcacgacggccccgtccgcggcgtccacttccacaagacccagccgctcttcgtctccggaggtgacgattacaagatcaaggtgtggaactacaaaacgcaccgctgcctcttcacgctccatggccaccttgactacatccgcacggtccagttccacgacgagcacccgtggatcgtcagtgccagcgatgaccagacaatccgtgtctggaactggcagtcacgcacctgcgtggccgtgctgacggggcacaatcactatgtcatgtgtgcttccttccatcccaaggaggacctggtcgtgtcagcctctctggatcagaccgtccgggtgtgggatattggcgcgctcaggaagaagtcgtcgtccccagccgacgacatcatgcgtctcactcagatgaacactgatctctttggaggcattgatgctgtggtcaagtacgtcttggagggtcacgaccgtggggtcaactgggcatcgtttcatcccacgctgccacttattgtttctggggcagatgatcggcaagtaaaactctggaggatgaatgatacaaaggcatgggaggttgatactcttagaggtcacatgaacaatgtctcctgtgtgttgttccacgcgaagcaggacatcattgtatccaactcagaagacaagagcatccgtgtttgggatgccacaaagagaactggtatccagacattcaggcgggagcatgaccgcttctgggtccttgctgctcaccccgaaatgaatcttcttgcagctggtcatgatagtggcatgattgtgtttaagttggagagagagcgcccagcttttgccgttagtggcgatacagtgttctatgtgaaggaccgcttcctccgtttctatgagtactcaacccagaaggaggtccaggtggctcccataagaaggcctgggtcagtcagcttgaatcagtcaccaaggacattatcatatagcccaactgagaatgctgtcttgatctgctctgatgtggatgggggctcatatgagcttttcattgttcctaaagattctgctggcagggctgattatttgcaggatgcaaagaagggatctggtggttctgcagttttcatagcccggaacaggtttgcagtcctggagaagagcagcaaccaggttttagtgaagagtcttaagaatgagattgtgaagaaaagtcctcttcctattgcaactgatgttatttactatgctggaactggtaacatactgtgcagagctgaagacagggtggccatctttgatctgcagcagcggcttgttcttggtgaactccaggcatctgctgttaagtatgtgatctggtcgaatgatatggagtctgttgcactactcagcaaacatgctgtagtcattgcaaacaagaagcttgtccatcgctgcacacttcacgaaaccatacgtgtgaagagtggtgcctgggatgaaaatggtgtgttcatatactccactctgaaccatatcaagtactgccttcctaatggggacagtggcattatcaaaacacttgatgttcctatttacataaccaaggttgccgggaacaccattgcctttctggaccgtgatggaaagaacaagattattacagttgatgcttctgaatacattttcaagctggcccttctacggaagcgctacgatcatgttatgagtatgattaagaactcgcagctgtgcgggcaggcagtcatttcttatttgcagcagaaaggatttccagaagttgctctccactttgtgaaagatgaaaaaaccagatttaacctggctcttgaaagcgggaacatccaaattgctgttgcttccgcaaaggagctcgatgacaaggatcactggtacaggttgggaatagaggctctgaggcagggaaatgttggtattgttgaatatgcctaccagcggacaaagaattttgacaggcttgcttttctttatctgctaactggttacttggacaaggtgggcttcatgtctaagatagctgggcagaataacaatctgatgggccagttccacaatgcattgtatcttggagatgctaagaaaagagttgagatcttggagaatgcaggacagttacctctagcatatgtgactgctgccactcatgggctcactgaaattgcagataggcttgctggtgagttaggagaagatgtgccttctctacctgaagggaaaactagatcacttttaatccctcctgcacctctcacagcatgtggtgattggccattgttgagggtgatgcgtggtatttttgagggtggactagatgctactgggagggcagagcaggaggaagattatgatgatgctggtggtgactggggtgatgaagacctggaaattgttgatgcaagtaatgtgatagaaaatggagatgctggccatgccgatgaaagtgaaacaaatgaagaggatggggacgaggaaggtggctgggacctcgaagatctggaattgccaccggaggcagatacaccaaaagctagaggtccggaacgctctgctctgttcgtggctcccacaccaggcatgcctgtcagtcaaatttggactcagaagtcatctcttgctggggagcatgccgcagctgggaattttgacacagcaatgcgtctgcttagccgccagttgggcatcaagaactttgctcctttgaaggccttgtttcttgatgcacatatgggcagtcatacctttctgcgtgcatttgcaagtgctccagtgatccctgttgctgttgagaaaggctggagtgaatctgccagtcccaatgtgaggggcccacctgcacttgtgtttagctttgcgcaaatggacgacaagctgaaggctgcatacaaagccacgacagagggcaagttcccagaggcactgaggcagttcctcaacatcctatacaccatcccgctcctcgtcgtggactcacggagagaggtcgatgaagtgaaggagcttatcgagatagtgagggagtacgtccttggcctcaggatggaagtcaagaggaaggagctgaaaaacgacgccacccggcagcaggagctggcagcatacttcaccaactgcaagctgcagaaggtccacatgcgcctcgtcctcaccagcgccatgggcctctgcttcaagggcgggaactacgccacggcggcaaactttgcccgcatgctcctggacaacggcccgaacgaggcccaggcgaagaaggcccggcaggtgctgcaggcctgcggcgacaggaaggacgcccaccagctcaactacgacttcagaaacccgttcgtcgtctgcggggccagcttcgtcccgatctaccgcgggcagaaggacgtctcctgcccctactgcgcgtcccggttcgtgccctcggtggagggtcagctgtgcagcatatgcgagctgtcggtggtcggggcggacgcctcgggcctcctctgctcccctacacaatcgagataagataagtggcgacgactctcgcctctgtgttgatcatgtttgtatctcgagtcagttccaagactgttgtgtcagttatattctacctaccagagatttttatcagcaacttgcgaggaataagtatagtataattgcgtcgtttcttccccctttttttgtgtcatggatcgatcgtggggctgtggtcggtcaatcaacaaacggtgtaggatttttggacagacacattttttagggctcaatgatgatgtatttaaatcgggatttcgttatatgatgta

SEQ ID NO: 842 - DNA, 3999 bp, Avena sativa
ctcccgccggtgggtttaggggccccgccgggccgccgtcctcgtcggcggcgtcgcgatgctgaccaagttcgagaccaagagcaaccgcgtcaaggggctcgccttccacccgcgcaggccatggatcctcgccagcctccacagcggggtcgtccagatgtgggactaccgcatgggcaccctcctcgaccgcttcgacgagcacgacgggcccgtacgcggcgtccacttccacaagacacagccgctcttcgtatcaggaggtgatgattacaagatcaaggtgtggaactacaagacgcaccgctgcctcttcacgctccatggccaccttgactacatccgcacggtccagttccacgacgagcatccatggatcgtcagtgctagcgatgaccagacaatccgtgtatggaactggcagtcgcgcacttgtgtggcagttttgacagggcataatcactatgtcatgtgtgcctccttccatcccaaggaggacctggtcgtgtcggcatctctggatcagactgtccgggtgtgggatattggggcgctcaggaagaagtcatcgtctccagccgatgacattatgcgtctcactcagatgaacactgatctgtttggaggcattgatgctgtagtcaagtatgtcttggagggtcatgaccgtggggtcaactgggcctcgtttcatcccacgctgccacttattgtttctggggcagatgaccggcaagtgaaactctggagaatgaatgatacaaaggcatgggaggttgatactctgagaggtcacatgaataatgtgtcctgtgtactgttccacgcgaagcaggacatcatcgtgtccaactcagaagataaaagcattcgtgtttgggatgccacaaagagaactggtatccagacattcaggcgggagcatgatcgcttctgggtccttgctgctcacccggaaatgaatcttcttgcagctggtcatgatagtggcatgattgtgttcaaattggagagggaacgtccagctttctccgtcagtggtgataccgtgttctatgtgaaggaccggttcctccgtttttatgagtactcagcacagaaggaggtccaggtggctccgataagaaggcctggatcagtcaccttgaatcagtcaccaaggtcattatcatatagcccaactgagaatgctgtcttgatctgctctgatgtggatgggggctcgtatgagctttacattgtccccaaggattctgctggcagggctgattatttgcaggatgcaaagaagggagctggtggttctgcagttttcatagctcgaaaccggtttgcagtcctggagaagagcagtaaccaggttttggtgaagagtcttaagaacgagattgtgaagaaaagtcctcttccaattgcaactgatgctatttactatgctggaactggtaacatattgtgcaaagctgaagacagggtggccatctttgatctgcagcagcggcttgttcttggtgaactccaggcatctgctgttaagtatgtggtttggtcaagtgatatggagtcagttgcactgctcagcaagcatgctgtagtcattgcaaacaagaagcttgtccatcgctgcacacttcacgaaaccatacgtgtaaagagtggtgcctgggatgaaaatggcgtgttcatatattccactttgaaccatatcaagtactgccttcctaatggtgacaatggcatcatcaaaacacttgatgttcctatttacataaccagggttgcagggaacatcatctgctgtctggatcgcgatggaaagaacaagatgataacaattgatgcttctgaatacattttcaagctggcccttctacgtaagcgctatgatcatgttatgagcatgatcaagaactcgcagctgtgtggacaggcggtcatttcttatttacaacagaaaggatttccagaggttgctctccatttcgtgaaagatgagaagaccaggtttaacctggctcttgagagtggaaatatccaaattgctgttgcttctgcaaaggagcttgatgacaaggatcactggtacaggttgggaatcgaggctctgaggcagggaaatgttggtattgtagaatatgcttaccagcggacaaagaattttgacaggcttgcctttctttatctgataactggttacttggacaaggtgggctttatgtctaagatagctgggcagaataacaatttgatgggccagttccacaatgcgctgtatcttggggatgttaggaagagagttgagatcttggagaatgcggggcagctacctcttgcatatgtaactgctgccactcatggacttcctgaaatcgctgataggcttgctaatgaattgggagaaaatgtgccagctctacctgaaggaaaaaacagttcacttttgattcctcctgcacctctcatagctagcagtgattggccattattgagggtgatgcgtggtatttttgatggtggactagatgctactgggagggcagagcaggaggaagactatgaagatgctggtgctggtggtgattggggagacgaagacctagaaattgttgatgtaagtaatgtggtagagaatggagacgcgggccatggtgagggaagtgaagcaaatgaagaggatggagaagaagaaggtggctgggacctggaagatctggaattgccacctgaggcagatacaccaaaagctaccggtcctgcccgctctgctttgtttgtggctcccacaccaggcatgcccgtcagccaaatttggactcagaagtcatctcttgctggggagcatgctgcagcggggaatttcgacaccgcaatgcggctgcttagccgccagttgggcatcaggaactttgctcctctgaagaccttgtttcttgatgcacatatggggagtcatacctttctgcgtgcatttgcaagcgctccggtgatacctgttgctgttgagaaaggctggactgaaactgctagtcccaacgtgaggggcccacctgcacttgtgttcagcttctcgcagatggacgacaagcttaaggctgcatataaggctacaaccgagggtaaattcccagaagcactgaggcagttcctcaacatcctatacaccatcccgctccttgtcgtggactcgcggcgagaagttgatgaagtgaaggagctcattgagatagtgagggagtacgtccttggcctcaggatggaagtcaagaggaaggagctgaaaaacgacgccacccggcaacaggagctggctgcatacttcaccaactgcaagctgcagaaggtccacatgcgcctcgtcctcaccagcgccatgggtctctgcttcaagggcgggaactatgccaccgcggcaaactttgcccgcatgctcctggagaacagccccaacgaggcccaggcgaagaaggcccgccaggtcctgcaggcctgtggcgacaggaaagatgcccatcaactgaactatgacttcaggaacccgttcgttgtgtgcggagcaacctttgttccgatctaccgcgggcagaaggatgtctcctgcccctactgcacgtcccggttccatgccctccgtcgagggccagctctgcaccatctgtgagctctcggtggtcggagcggacgcctcgggcctcctctgctctcctacacagtcgagataagcggtgattgtgctggctttcacccctgtgttccatgtttgtatctccagttcaaagaccgctgctgtgttgtcgttatattctaccagagatttgaattaccaaacttgtgaggaataagtatagtataattggttgttttcttccttcttgtcctcggttgtagtctcatacgggctgcggtgaaacaaacgctgtaggattttggacagatccatttttaggaccaaatgatgatgatgtatttaattgagaattccattatatgatgtaccac

SEQ ID NO: 843 - DNA, 3477 bp, Triticum aestivum
aggtgacgattacaagatcaaggtgtggaactacaaaacccaccgctgcctcttcacgctccatggccaccttgactacatccgcacggtccagttccacgacgagcacccgtggatcgtcagtgccagcgatgaccagacaatccgtgtctggaactggcagtcacgcacctgcgtggccgtgctgacggggcacaatcactatgtcatgtgtgcttccttccatcccaaggaggacctggtcgtctcagcgtctctggaccagaccgtccgggtgtgggatattggcgcgctcaggaagaagtcgtcgtccccagccgacgacatcatgcgtctcactcagatgaacactgatctgtttggaggcatcgatgctgtggtcaagtatgtcttggagggtcatgaccgtggggtcaactgggcctcgtttcatcccacgctgccacttattgtttctggggcagatgatcggcaagtgaaactctggagaatgaatgatacaaaggcatgggaggttgatactcttagaggtcacatgaacaatgtctcctgtgtattgttccacgcgaagcaggacatcattgtatccaactcagaagacaagagcatccgtgtctgggatgccacaaagagaactggtatccagacattcaggcgggagcatgaccgcttctgggtccttgctgctcaccctgaaatgaatcttcttgcagctggtcatgacagtggcatgattgtgtttaagctggagagagagcgcccagctttcgccgttagtggtgatacagtgttctatgtgaaggaccgcttcctccgtttctatgagtactcaacacagaaagaggtccaggtggctccgataagaaggcctgggtcagtcagcttgaatcagtcaccaaggacattatcatatagcccaactgagaatgctgtcttgatctgctctgatgtggatgggggctcatatgagcttttcattgttcctaaagattctgctggcagggctgattatttgcaggatgcaaagaagggatctggtggttctgcagttttcatagcccggaacaggtttgcagtcctggagaagagcagcaaccaggttttagtgaagagtcttaagaatgagattgtgaagaaaagtcctcttcctattggaactgatgttatttactatgctggaactggtaatgtattgtgcagagctgaagacagggtggccatctttgatctgcagcagcggcttgttcttggtgaactccaggcatctgctgttaagtatgtgatctggtcgaatgatatggagtctgttgcgctactcagcaaacatgctgtggtcattgcaaacaagaagcttgtccatcgctgcacccttcatgaaaccattcgtgtaaagagtggtgcctgggatgaaaatggtgtgttcatatattccactctgaaccacatcaaatactgccttcctaatggggacagtggcattatcaaaacacttgatgttcctatttacataaccaaggttgcggggaacaccattgccttcctggaccgtgatggaaagaacaagattattacagttgatgcttctgaatacattttcaagctggcgcttctacggaagcgctacgatcatgttatgagtatgattaagaactcacagctgtgcgggcaggcagtcatttcttatttgcaacagaaaggatttccagaagttgctctccactttgtgaaagatgaaaagaccagattcaacctggctcttgaaagcgggaacatccaaattgctgttgcttccgcaaaggagctcgatgacaaggatcactggtacaggttgggaattgaggctctgaggcagggaaatgttggtattgttgaatatgcataccagcggacaaagaattttgacaggcttgcttttctttatctgctaactggttacttggacaaggtgggcttcatgtctaagatagctggccagaataacaatttgatgggccagttccacaatgcattgtatcttggggatgctaggaagcgagctgagatcctggagaatgctggacagcttcctcttgcctatgtcactgccgccactcatgggctcactgaaattgctgaaaggcttgctgctgagttgggtgagaatgttccttctctacctgaaggaaaaactcgctcacttttgattccgcccgcacctctcatatccagcgttgattggccattgctccgggtgatgcgtggcatatttgagggtggactggatgctactgggagagcagaagttgaggaagatgatgaagctgctggtgctgactggggtgatgaggacttggatattgtggatgcaagtgatgcagtggcaaatggaggtgatggttttgatcccgaggaaggtgaagcgaacgaggaggatggtgaggaaggtggttgggatcttgaagatctggaattgcctgaaccagagaccccaaaagctgctggaaatgctcgctccactgtgtttgttgctcctacaccaggaatgcctgtcagccaaatttggactcagaaatcttctcttgctggggagcatgcagcagcaggcaactttgacactgcaatgaggttgctcagccgccagttgggcatcaagaactttgctcccctgaaacccatgtttctcgatcttcatatgggcagtcattcatatcttcgcgcacttgcaactgctcccgttatatcaattgctgttgagaaaggttggagtgagtcctcaagtcctaacgtgaggggccctccttcactagttttcaccttctcacaaatggaagacagactcaaggcagcctacaaagccacaaccgaggggaagttcccagaagcgctgagacagttcctcagcatcttgcataccattcccttgatcgtggtggactcgcggagagaagttgatgaagtgaaggagttgatcgagatagtgagggaatatgttcttggtctaagaatggaactcaagaggaaggaattgaaggacaacgtcaaccggcaacaggaactggcggcctacttcaccaactgcaagctccagagggttcacatgaggcttgtgctctcaaacgccatggctctatgctacaagcagaagaacttcgcgaccgcagagcactttgcaaggctgctcctcgagaacagccccaacgaggtccaagcgaagaaggctcggcaggtgcagcagcagtgcaacggcaagcaggacagccatgagctcaactacgactacagaaatccgttcgtcgtctgtggctcgacgtatgttcccatctaccgcggccaaaagaacatctcgtgcccatactgcggatcccggtttgttccttccattgaagggcagctttgtaccatatgcgagctggctgtggtcggcgcggacgcctcgggcctcctgtgctcccctacacagatgagatgagcggaagaggctagtcgttagagctcccc

SEQ ID NO: 844 - DNA, 3423 bp, Secale cereale
ccaccatgagtacccatggatcgtaagtgccagtgatgaccagacaatccggatctggaactggcagtcacgtacttgtgtggctgtgctcaccgggcataatcactatgtcatgtgcgcgtccttccaccccaaggaggacctggttgtgtcagcgtcgctagatcagactgtccgtgtttgggatattggcgctctgaggaagaagacggtgtcacctgcagatgacatcatgcgtctcactcagatgaacactgatctgtttgggggtgtcgatgcggttgtgaaatatgtcttggaaggccatgaccgtggtgtcaactgggcatcatttcaccccacattgccactcattgtttctggagcagatgaccggcaagtgaagctgtggagaatgaatgataccaaggcttgggaagttgatactttgagggggcacatgaataatgtgtcctgtgtgatgttccatgcgaagcaagacatcattgtgtccaactcagaagacaaaagcattcgcatttgggatgccacaaagcgaaccggtattcagacatttaggcgggaacatgaccgtttctggatccttgctgcccaccctgaaatgaatcttcttgctgctggtcatgacagtggcatgattgtgtttaaattagagagggaacgcccagctttcagcgtgagtgctgatactgtgttctatgtgaaggacagattcctccggttctttgagtattccacccagaaggaagttcaggtggctccaataagaagaccaggatccgtcagcttgaaccagtctcccaggacgctatcttatagtccaactgaaaatgctgtgttgatttgctctgatgtggatgggggctcatatgatctgtacattgttcccaaggattctgctggcagggctgattatttgcaagaggcaaagaagggagctggtggctcggctgtttttgtggcacggaataggtttgctgtccttgagaagagtagcaatcaagttttggtaaagaatcttaagaatgaaattgtgaagaagagtcctcttcctattgcgactgatgcaatttattatgctgggactggtaatttgttatgcaaagctgaagatcgtgtgaccatctttgatctacaacaaaggctagttcttggtgaactccagtcagctggtgttaaatatgtagtctggtccagtgacatggagcatgttgcactactgagcaagcatgcagtagttatagctagcaagaagcttgtccatcgctctacactgcatgagaccattcgtgtgaaaagtggtgcctgggatgagaacggtatttttatttactctactctgaaccatatcaaatactgtcttcctaatggagatagtgggatcataaagacccttgatgttcctgtttacataacaagggttattgggaacaacatcttttgtctagatcgtgatggaaagaacaagctgataacagttgatgcttctgaatacattttcaagctcgcccttctccggaaacgttatgaccatgttatgagtatgattaagagctcacagctgtgtgggcaggcagtgatttcatatttgcaacagaaagggtttccagaagttgctctccactttgtgaaagatgagaagacaagattcaatctagctcttgaaagtggtaacatccaaatcgcagtggcttctgcaaaagagattgatgacaaggatcactggtacagattgggaattgaggccctgaggcaggggaatgttggtattgtggaatatgcataccagcggacaaagaattttgagaggctgacttttctgtatcttattactggttacatggacaaggtgggcttcatgtgcaaaattgctggacagaataacaatttgatgggtcagttccacaatgcattgtatcttggcgatgctaggaagcgagctgagatcctggagaatgctggacagcttcctcttgcctatgttactgctgccactcatgggctcactgaaattgctgaaaggcttgctgctgagttgggtgagaatgttccttctctacctgaaggaaaaactcgctcacttttaattccgcccgcacctctaatatccagcgttgattggccattgctccgggtgatgcgtggcatatttgagggtggactggatgctaccgggagagcagaagttgaggaagatgatgaagctgctggtgctgactggggtgatgaggacttggatattgtggatgcaagtgatgcagtggcaaatgggggtgatggttttgatcccgaggaaggtgaagcgaacgaggaggatggtgaggaaggtggctgggatcttgaagatctggaattacctgaatcagagaccccaaaagctgctggaaatgctcgctccactgtgtttgttgctcctacactaggaatgcctgtcagccaaatttggactcagaaatcttctcttgctggggagcatgcagcagcaggcaattttgacactgcaatgaggttgctcagccgccagttgggcatcaaaaactttgctcccctgaaacccatgtttctcgatcttcatatgggcagtcattcatatcttcgcgcacttgcaactgctcccgttatatcaattgctgttgagaaaggttggagtgagtcctcaagtcctaacgtaaggggccctccttcactagttttcaccttctcacaaatggaagacagactcaaggcagcctacaaagccacaaccgaggggaagttcccagaagcgctgagacagttcctcagcatcttgcataccattcccctgatcgtggtggactcacggagagaagttgatgaggtgaaggagttggtcgagatagtgagggagtatgttcttggtctaagaatggaactcaagaggaaggaattgaaggacaacgtcaaccggcaacaggaactggcggcctacttcaccaactgcaagctccagagggttcacatgaggcttgtgctctcgaacgccatggctctatgctacaagcagaagaacttcgcgaccgcagagcacttcgcgaggctgctcctcgagaacagccctaacgaggtccaagcgaagaaggctcggcaggtgcagcagcagtgcaacggcaagcaggacagccatgagctcaactacgactacagaaatccgttcgtcgtctgcggctcgacgtatgttcccatctaccgcggccaaaaggacatctcgtgcccgtactgcggatcccggtttgttcctgccattgaagggcagctttgtaccatatgcgagctggctgtggtcggcgcggacgcctcgggcctcctgtgctcccctacacagacgagatgagcggaagaggctagtcgttagagctcccctatattctttctagtctcgtaaagtctatcttatactttacc

SEQ ID NO: 845 - DNA, 4079 bp, Elaeis guineensis
acttcttgtggtagttagggtttccggagatccggtgggttaaggaggcggcggaagcgaagaagcaagggagggagacatgctgaccaagttcgagacgaagagcaatcgggtgaaggggctgagctttcacagcaagcggccctggatcctcgccagcctccacagtggcgtgatccagctatgggactaccggatgggcaccctcatcgaccgattcgacgagcacgatggacccgtgcgtggcgttcacttccataaatctcagccccttttcgtctcgggaggagatgattacaagatcaaggtctggaattacaagacccatcggtgcctatttacccttcttgggcatcttgattacattcgtacagttcaatttcacgatgagtatccatggattgttagtgctagtgatgaccagactattagaatctggaactggcagtctcggacatgcatttcagtgttaacagggcataaccactatgttatgtgtgcctctttccatccaaaggaggacctggttgtatcggcttccctggatcagacagtccgggtatgggatattggtgcattgaggaagaaaacagtgtcaccagctgatgacatcttgcgcctgagccagatgaacacggatctgtttggtggcgttgatgctgttgtcaagtatgtcttggaaggtcatgatcgtggagtcaattgggcatcgtttcatcctagcctgcctctcattgtgtcaggagcagatgatagacaagtgaaactatggcgaatgaatgatacaaaggcttgggaagtggacacgctgagagggcacatgaataatgtctcttgtgtaatgttccatgcgaagcaggatattatcgtgtcaaactcagaggacaaaagtattcgcatttgggatgccacgaaacgcactggaattcagacatttcgccgtgaacatgaccgtttctggattctcactgcacatccagaaatgaaccttcttgcagctggtcatgacagcggtatgattgtttttaagttggaaagagagcgccctgccttctctgtgagtggagatactctcttctatgtcaaagatcggttcttgcggttctatgagttttcatcccagaaggataatcaagtggttccaatcagaaggcctggttctgtcagcttgaatcagggacccagaacactgtcctacagccctacagaaaatgctgtcttgctctgctctgatgtggatggtggttcatatgaactttatattgttcccaaagattctgctggaaggggtgattatatgcaggaagcaaagaagggagctgggggctcagctgtttttgtagctcgcaacaggtttgcagttctcgacaagagtaacaatcaagcattggtgaagaatcttaagaatgagattgtgaagaagagtcttcttcctgttgttactgatgcgatattttatgccgggacaggcaatctgttgtgcagggcggaggatagagtggtcatatttgatctccaacagaggcttattcttggggaacttcagaccccatctgtcaagtacattgtttggtctagcgacatggagtctattgccttgttgagcaaacatgcaatagttattgctagcaagaaacttgtacaccgctgcacacttcatgagacaatccgtgtgaaaagtggtgcctgggatgagaatggcgtctttctttatacaaccttaaaccatattaagtactgtcttcctaatggggacagcggaatagtaagaacccttgatgttcctgtttacataaccaaggtttctgggagcaatatctattgcttggatcgtgatggtaggaatagggttatatcaattgatgctacagaatacatattcaagcttgcccttctgcgaaaaagatatgaccatgtgatgagcatgatcaggaattcacagttatgcggacaggctgtgatcgcatatctgcaacagaaaggtttccctgaagtagctctccattttgtcaaagatgagagaacccgattcaaccttgctcttgagagtggtaacatccagattgctgttgcttccgcaaaggagatagatgagaaagactactggtacaggttaggcattgaggctcttcgacagggaaacaccagtattgtggaatatgcataccagaggacgaagaactttgagaggctgtcttttctctatcttgtaacgggaaacatggaaaagctgtccaaaatgttgaggatagctgagattaaaaatgatgtgatgggccagttccacaatgccatgtatctaggtgacattgaggaacgtgtcaagatcttggagaatgctggccatttgcctcttgcatatgtcacagctgccactcatgggcttactgacgtagcggacaggcttgcagctgaattgggagataatatcccctctatacctgaaggaaaagtcagttctctccttatgccacctcgaccgcttatgtgcagtggggattggccattattaagggtcatgagaggtatttttgaaggtggattggatagtcttgggaggacaggcaatgaggaagaagaagaagctagtggtgctgactggggtgatgaggatttggacattgttgatgttgaaggtgtgattcagaatggcgatattgtagcagaagttgaggatggtgaagccaatgaagagaatgatgaggaaggaggttgggaccttgaagatttggagctaccgccggatgtggatacaccgaaagctaaccccaatgctcgttcatctttgtttgttgctcctacaccaggcatgccagtaagtcaaatatggattcagaaatcatctctggcaggggagcatgtggctgctggaaattttgatactgccatgcgcctgcttagccggcaattgggaataaagaactttgctcccttaaagccattgtttatggatctttacgtgggtagccacacatatcttcgtgcttttgctacggtgcctgtgatatcaactgctgttgagaagggatggaacgagtctgccagccctaatgtgaggggtccaccagcacttgtttttaagttttctcagatggatgagaagcttaaggctgcttaccgtgtcacaacagagggaaagtttccagaggctttgcggcagtttctcagtatcctgcatactatcccacttatggtggtggactcaaggagggaagttgatgaagtgaaggagcttattgagatagccagagaatatgtcctgggcttgaagattgaagtcaaaagaaaggaaatgaaggataatgcaattcggcagcaggagttagcagcttacttcaccaactgtaaacttcaaaagattcatatgagacttgtgcttgcaagtgcaatgagtagctgttacaggggagggagcttcgctacagcagcgaattttgctaggatgcttttggagaatagcccacctgaagcccaagcgaagaaggctaggcaggtgttgcaggcctgtggtgataagaaggatactaatcagctgaattatgatttcaggaacccatttgtggtttgtggggctacttttgttccgatctaccgtgggcagaaggatgtttcctgcccatattgtggggctcgctttgtgccagccatagaggggcagatttgtgctgtttgtgagcttgcggtggtgggtgcagatgcatcaggcctgctctgttctcctacacagacaagatagaaaggtactaggtttatattatggcatctttctttttcgtgttcgttagcttaagaatgtcatgttatatctttgcctgggaacagactgattgtgtgagaggtaaatcaataaaaataggaaatgttgcttcatagcattttgctcagttcattgaaccagatgggcactttttaaatgttggaattttgattagtccatgcagatcatgtttattggagaatgtaagatgcttatttacttcagaaaagcgatgaggctttcatttgctttgtatttgtttaaagatgtgctgagttctgtgtcttgttatgctaatgcatcatgcatcttcctgagtttg

SEQ ID NO: 846 - DNA, 4190 bp, Ananas comosus
agatgttgacgaagttcgagacgaagagcaaccgggtgaaggggctcagcttccacagcaagcgaccgtggatcctcgcgagcctccacagcggcgtgatccagctatgggactaccggatgggaaccctaatcgaccgcttcgacgagcacgacgggcccgtgcgcggcgtccatttccacaagacgcagcccctcttcgtctctggaggagatgactacaagatcaaggtctggaactataagacccaccggtgcctttttacgcttcttggccacctcgattacatccgcactgtgcaattccatgacgaatacccgtggatagttagtgcaagtgatgatcaaacaattaggatctggaattggcaatctcgaacttgcatctcagtactaactggccacaatcactatgtcatgtgtgcttctttccatccaaaggaggacttggtcgtctctgcttccttggatcaaactgttagggtttgggatattggggctttaagaaaaaagacggtttcgccagctgatgatatgttgaaattgagccaaatgaatgctgatttgtttgggggagttgatgtggttgttaaatatgtactggaaggtcacgatcgtggcgtcaattgggcttctttccaccccaccttgcctcttattgtatctggagctgatgaccggcaagtgaagttgtggcgcatgaatgatacgaaggcttgggaagtggacacactgcgtggccacatgaataatgtgtcctgtgtaatgttccacgctaagcaagatatcatcgtatccaattctgaagacaaatccatccgcatatgggatgcaacaaaacgaacaggtatacaaactttccgccgcgaacatgatcgtttctggattcttgctgcccaccctgaaatgaaccttcttgctgccggtcacgacagcggcatgatcgtatttaaattggaaagagagcgccctgctttttcgttgagtggtgatactttatattatgtaaaagatcggttcttgagggtatatgagttttcaactcaaaaggacacacaagtggttcctataagaaggcctgggtcggtctgcttgaaccaggcaccgaggacattgtcatacagccctacagaaaatgctgttttaatctgttctgatgttgatggaggatcatatgagctctatattgtacctaaagaagtggcggggagagctgattatatccaagaagctaaaaaaggagctggtgcttcagctgtgtttgtagctcgaaataggtttgctgttctcgaaaagagcaataatcaagtgttggtgaaaaatttaaagaatgaaattgtgaagaagagtgcacttccctttgcgaccgatgcaattttttatgctggaacaggaagcttgctgtgtagggcggaggatagggtgttaatttttgatcttcagcaaagaatggttcttggtgaacttcagacaccagcagtcaagtatgtagtttggtccagtgatatggaatctgttgctcttttgagcaaacatgctatagttattactaataagaaattagtacaccggtgcacacttcatgagactattcgagttaaaagtggtgcctgggatgaaaatggtgtctttatttacacaaccttaaaccatatcaagtattgccttcctaatggggacagtgggatcataaaaactctagatgtccctatttacctaactagggtctctgggaatgttatctattgcctggatcgagatgggaagagtagggttatctcaattgatgcttcggagtacattttcaagcttgcccttctaaggaaaagatatgatcatgtgatgggtatgataaagaactctcaactatgtggacaggctgttattgcttatcttcaacagaaagggtttcctgaagtggctctccatttcgtcaaagacgagaggactcgattcaatctggctgttgaaagtggtaatatacagattgccgttgcttccgcaaaagaaatagatgagaaggactattggtacaggcttggtattgaggctctaaggcaggggaacactagcattgtggaatatgcttatcaaaggacaaagaactttgagagactatctttcttgtatcttgtgaccggtaacatggataagctatccaagatgcttaagatagcggagattaagaatgatgtaatgggccagtttcacaatgccatgtatttgggtgatattcgtgaacgggttaaaatcttggaaaatgttggtcattttcctcttgcttatgtcactgctgccactcacgggcttaatgaagaagccgagcggcttaaagctgaattgggtgataatgtcccctctatacctgaaggaaaaacctcttcgcttttaatgccaccactacctctcatgtgtagtggggattggccattactaagagtgatgcgtggtatttttgaaggtggattggatactttaggaagggcgggacatgacgaagaagaagaggaagctgatggtgctgagtggggtgatgctgaactggatattgctgatgtggaaggcatgatacagaatggtgatgtaacagcagaagccgatgaggatgaagtgaacgaagagaatgatgaggaaggaggatgggatctagaggatttggaattaccgcctgagctagaaacaccaaaagcttctgctaattctcgttctactttgttcgtggcccccacacctggcatgcctgtgagccaaatctggacccagaaatcctccttggcaggtgagcatgctgctgctggaaattacgacactgccatgtgcttacttagccgccaattgggtattaagaattttgcccctttgaaaccactatttttggatctatacacgggcagccacacataccttcaagcttttgctactgctccagttttctctcttcctgttgaaaaaggatggactgaatctgctagccctaatgttaggaacccgccagcacttccgttcaaattctcacaaatggacgaaaagcttaagttagcttatcgagccaccactgagggaaaatttccagaggctcttaggcagttccttaatattttacacactatgccactcattgtggtggattcaagaagggaagttgatgaagtgaaggaattgattgagatagcgcgagaatatgttcttggattgaagattgaagtgaaaagaaaggaaatcaaagacaatgtgatcaggcaacaagagttggcagcttatttcaccaattgtaaacttcaaaagattcatatgaggctcgttcttacgagtgctatgaccatatgcttcaaaggagggaattatgcgactgcagctaatttcgcgagaatgcttctagagaatagtccaagtgaggcccaagcgaagaaggcaaggcaggtgcttcaggcttgtggagataagaaagatgctaatcagctcaattacgattatagaaatccctttgttgtttgtggggctactttcgttccaatctaccgcggccaaaaggacatttcctgcccatattgtgggtcccgcttcatgccagccattgaggggcaaatctgcaccgtttgtgagctggcagtggtgggtgctgatgcgtcgggtcttctctgttccccttcccagtcaagatagttgtgaggaggtactcattttatctcatgatccatctttccttttattgataattaggataaagactattatgttatatcttgttccgtaccttaatgattgtgtggttaaaggtaaagcaataataagaataggaaatgttatagttgggtgttttttgctcggtttatttttggcgcctattaaatgtagggtttcggttaattcttgcagatctttttgtcacatgagacagtgtaagagattctatttgcttcagaattcgcagttttatatttatttatagagttgtgcagggttctttctggagccttcattggttggcaaaatcttgtttcttttatgcatcttgaacctgaaccataaaagtgttgtttgagtcatcgtattcattatcattaagtctaatctgtgccactgctacagtaatttgtttgagaaaatataaatgctatttgacaaagtgtagagctactatgctttagtgttttcaatgttttggccattggatcaaggattgtcaggctg

SEQ ID NO: 847 - DNA, 4207 bp, Ananas comosus
agatgttgacgaagttcgagacgaagagcaaccgggtgaaggggctcagcttccacagcaagcgaccgtggatcctcgcgagcctccacagcggcgtgatccagctatgggactaccggatgggaaccctaatcgaccgcttcgacgagcacgacgggcccgtgcgcggcgtccatttccacaagacgcagcccctcttcgtctctggaggagatgactacaagatcaaggtctggaactataagacccaccggtgcctttttacgcttcttggccacctcgattacatccgcactgtgcaattccatgacgaatacccgtggatagttagtgcaagtgatgatcaaacaattaggatctggaattggcaatctcgaacttgcatctcagtactaactggccacaatcactatgtcatgtgtgcttctttccatccaaaggaggacttggtcgtctctgcttccttggatcaaactgttagggtttgggatattggggctttaagaaaaaagacggtttcgccagctgatgatatgttgaaattgagccaaatgaatgctgatttgtttgggggagttgatgtggttgttaaatatgtactggaaggtcatgatcgtggcgtcaattgggcttctttccaccccaccttgcctcttattgtatctggagctgatgaccggcaagtgaagttgtggcgcatgaatgatacgaaggcttgggaagtggacacactgcgtggccacatgaataatgtgtcctgtgtaatgttccacgctaagcaagatatcatcgtatccaattctgaagacaaatccatccgcatatgggatgcaacaaaacgaacaggtatacaaactttccgccgcgaacatgatcgtttctggattcttgctgcccaccctgaaatgaaccttcttgctgccggtcacgacagcggcatgatcgtatttaaattggaaagagagcgccctgctttttcgttgagtggtgatactttatattatgtaaaagatcggttcttgagggtatatgagttttcaactcaaaaggacacacaagtggttcctataagaaggcctgggtcggtctgcttgaaccaggcaccgaggacattgtcatacagccctacagaaaatgctgttttaatctgttctgatgttgatggaggatcatatgagctctatattgtacctaaagaagctgcgggaagagctgattatatccaagaagctaaaaaaggagctggtgcttcagctgtgtttgtagctcgaaataggtttgctgttctcgaaaagagcaataatcaagtgttggtgaaaaatttaaagaatgaaattgtgaagaagagtgcacttccctttgcgaccgatgcaattttttatgctggaacaggaagcttgctgtgtagggcggaggatagggtgttaatttttgatcttcagcaaagaatggttcttggtgaacttcagacaccagcagtcaagtatgtagtttggtccagtgatatggaatctgttgctcttttgagcaaacatgctatagttattactaataagaaattagtacaccggtgcacacttcatgagactattcgagttaaaagtggtgcctgggatgaaaatggtgtctttatttacacaaccttaaaccatatcaagtattgccttcctaatggggacagtgggatcataaaaactctagatgtccctatttacctaactagggtctctgggaatgttatctattgcctggatcgagatgggaagagtagggttatctcaattgatgcttcggagtacattttcaagcttgcccttctaaggaaaagatatgatcatgtgatgggtatgataaagaactctcaactatgtggacaggctgttattgcttatcttcaacagaaagggtttcctgaagtggctctccatttcgtcaaagacgagaggactcgattcaatctggctgttgaaagtggtaatatacagattgccgttgcttccgcaaaagaaatagatgagaaggactattggtacaggcttggtattgaggctctaaggcaggggaacactagcattgtggaatatgcttatcaaaggacaaagaactttgagagactatctttcttgtatcttgtgaccggtaacatggataagctatccaagatgcttaagatagcggagattaagaatgatgtaatgggtcagtttcacaatgccatgtatttgggtgatattcgtgaacgggttaaaatcttggaaaatgttggtcattttcctcttgcttatgtcactgctgccactcacaggcttaatgaagaagccgagcggcttaaagctgaattgggtgataatgtcccctctatacctgaaggaaaaacctcttcgcttttaatgccaccactacctctcatgtgtagtggggattggccattactaagagtgatgcgtggtatttttgaaggtggattggatactttaggaagggcgggacatgacgaagaagaagaggaagctgatggtgctgagtggggtgatgctgaactggatattgctgacgtggaaggcatgatacagaatggtgatgtaacagcagaagccgatgaggatgaagtgaacgaagagaatgatgaggaaggaggatgggatctagaggatttggaattaccgcctgagctagaaacaccaaaagcttctgctaattctcgttctactttgtttgtggcccccacacctggcatgcctgtgagccaaatctggacccagaaatcctccttggcaggtgagcatgctgctgctggaaattacgacactgccatgtgcttacttagccgccaattgggtattaagaattttgcccctttgaaaccactatttttggatctatacacgggcagccacacataccttcaagcttttgctactgctccagttttctctcttcctgttgaaaaaggatggactgaatctgctagccctaatgttaggaacccgccagcacttccgttcaaattctcacaaatggacgaaaagcttaagttagcttatcgagccaccactgagggaaaatttccagaggctcttaggcagttccttaatattttacacactatgccactcattgtggtggattcaagaagggaagttgatgaagtgaaggaattgattgagatagcgcgagaatatgttcttggattgaagattgaagtgaaaagaaaggaaatcaaagacaatgtggtcaggcaacaagagttggcagcttatttcaccaattgtaagcttcaaaagattcatatgaggctcgttcttacgagtgctgtgaccatatgcttcaaaggagggaattatgcgactgcagctaatttcgcgagaatgcttctagagaatagtccgagtgaggcccaagcgaagaaggcaaggcaggtgcttcaggcttgtggagataagaaagatgctaatcagctcaattacgattatagaaatccctttgttgtttgtggggctactttcgttccaatctaccgcggccaaaaggacatttcctgcccatattgtgggtcccgcttcatgccagccattgaggggcaaatctgcactgtttgtgagctggcggtggtgggtgctgatgcgtcgggtcttctctgttccccttcccagtcaagatagttgtgaggaggtactcattttatctcatgatccatctttccttttattgataattaggataaagactattatgttatatcttgttccgtaccttaatgattgtgtggttaaaggtaaagcaataataagaataggaaatgttatagttgggtgttttttgctcggtttatttttggcgcctattaaatgtagggtttcggttaattcttgcagatctttttgtcacatgagacagtgtaagagattctatttgcttcagaattcgcagttttatatttatttatagagttgtgcagggttctttctggagcctttattggttggcaaaatcttgtttcttttatgcatcttgcacctgaaccataaaagtgttgtttgagtcatcgtattcattatcattaagtctaatctgtgccactgctacagtaatttgtttgagaaaatataaatgctatttgacaaagtgtagagctactatgctttagtgttttcaatgttttggccattggatcaaggattgtaatggatcaagattttaagtgccc

SEQ ID NO: 848 - DNA, 4307 bp, Musa acuminata
gagagagagagagagagagcacaagacgaggagagtggctgtgtgagagggagagacctcgttgtggcgcgatctcttttccccctccctcggcggcgacagctatcccatctacggcggctgaggcggcgccgggcgcctctccgaatcccttttcgtgttcttctgcttcccttgtctctctagatctggatccgagattctgagtttatttggacggatctctgaccttgcaagctcttggtgaagagggttcgaagagcggaagcccgcgatgctgaccaagttcgagaccaagagcaaccgggtgaaggggctgagcttccacagcaagcgcccctgggtccttgccagccttcacagcggtgtgatccagctatgggactaccggatgggcacgctcatcgaccgattcgacgagcacgacggtcctgttcgcggcgtccacttccataagtcgcagccccttttcgtctctggaggggatgattacaaaatcaaggtctggaattataagacccaccgctgtttgtttacccttcttgggcaccttgattacatccgcacggtccaattccatgatgagcacccctggattgttagtgctagtgatgatcaaacaattaggatttggaactggcaatcacgaacctgcatttctgtattgactgggcacaatcactatgtcatgtgtgcctcattccatccgaaggaagacctggttgtatcggcttcccttgatcagactattcgtgtctgggatattggtgctctgaggaagaaggtggcaccagctgatgacattctgcgtctgagtcagatgaacacagatttgtttgggggaattgatgcagttgtcaagtatgtcttggaaggtcatgatcgtggggttaattgggcatcgttccatcctactttgccccttattgtatctggtgctgatgatcggcaagtgaaactgtggagaatgaatgattcaaaggcttgggaggtggacacactgagagggcacacaaacaacgtctcttgcgtgatgttccatgcaaagatggaagtcattgtatccaactcggaggacaaaagcattcgcatttgggatgctaacaaacgcacaggtattcagacaattagacgtgaacatgaccgcttctggattctttctgcgcatccagaaatgaaccttcttgcggccggtcatgatagcggcatgatcgtcttcaagttggagagagaacgccctgctttctctgtcagtggtgatactctattctatgtcaaagatcgcttcttgcgcttatatgagttctcaacccagaaggataatcaggttgttcctataagaaagcctggttctgtcagcttaaaccagggacctagaacattgtcttatagccctaccgagaacgctgtcttgatatgttcagatgtggatggtggaacttatgagctatatattgttcctaaagatgcatctggcaggagtgactatatgcaggaagcaaaaaaaggagctggtggatcagcggtttttatagcccgcaataggtttgctgttctggacaggagtagtaatcaagtggtagtgaaaaacctgaaaaacgagattgtaaagaagggtcttcttccagttgctagtgatgcaatattttatgctgggacaggtaatgtattgtgcagggctgaggacagggtggccatctttgatcttcagcagagggttgtccttggggagctgcagactccatctgtcaagtacgttatttggtcaagtgacatggagtctgttgcgttgctcagtaaacatgctatagtcattgctaataagaaacttgtgcatcgttgcacactgcatgagactattcgtataaaaagtggtgcctgggatgataatggtgtcttcatttacacgactttaaatcacatcaagtactgcctgcctaatggggacagtggaatcataagaactctggaaattcctatttacataaccaaggtatctggaagcaatatctattgcttggatcgtgatgggaagaaccaggttatatcaattgatgctacggagtacatcttcaagctttccctgctgcgaaaaagatatgatcttgtcatgagtatgatcaggaattcacagttatgtgggcaggctgtaattgcgtatctgcaacagaaaggctttcctgaagttgctctccattttgtcaaggatgagaagacccggtttaacctggctcttgagagtggtaatattcaaattgctgttgcttcagcaaaagagattgatgataaagaccattggtacaagttgggcattgaggcccttcgacaaggaaacactagcattgtggaatatgcatatcagaggacaaagaactttgagagactatcatttctttatcttataacagggaacacagaaaagctctccaaaatgctgaaaatagctgaaattaagaatgatatcatgggtcagttccataatgcactgtatcttggcgacattcaggaacgtgtcaaaatattggagaatgctggtcatttgcctcttgcatatgttacagcagccactcatggactgaaggaggttgctgataggcttgccactgagttgggagagaatgttccatcactacccgaaggaaaaccacgatctcttctactgcctcccgcaccgctcatgtgctgtggggattggccattactaagggtaatgagaggtatatttgataatggtttggatttggggagggcaggacaggaggaagaggaggatgctcctggtgctgactggggtgatgaggaactggacattgttgacatcgagggagcaatgcagaatggtgacatagttgcagatattgaggatggcgaagcaattgaagagaatgaagaggaaggagggtgggacttggaagatctggaattaccagctgatgtggatacaccaaaagctgcaggcaattctcgctcttctttatttgttgctcctacacctgggatgccagttagtcagatctggatccagaaatcatcacttgctggggaacacgtggcagctggaaactttgacactgctatgcgcttgctcagccggcagttggctataaagaactttgcaccattgaagccatcattcatggatcttcatgcaggcagtcatacctatctgcgtgctctttccactgcaccggttatttcgtttgctgttgaaaaagggtggagtgagtctgctagtcctaacgtaaggggtccaccagcacttgtattcaagttctcacagatggatgagaaacttaaggcagcttatcgagccacgacagaaggaaagttccctgatgctttgcgtcaatttcttaatattttgcacactatcccccttattgttgttgactcaaggagggaagttgatgaagtgaaggagctgattgagatagccagagagtatgttctaggtttgaaaattgagcttcaaagaaaggaaatcaaagacaatttggttcgacagcaagagctggcagcctattttacaaattgtaagcttcagaagatccacatgaggcttgtcctcacaagcgctatgactatctgctacaagggagggaactgctctacagcagccaattttgccaggatgcttctggagaacagcccaacagaagtccaagcaaaaaaggctaggcaattgctgcaacattgtggtgacaagaaagatgttaaccaacttaattatgattacaggaacccattcgtggtttgtggggctacttttgttccaatctaccgtgggcagaaggatgtttcttgcccttattgtggggctcggtttgtgccaaccatcgaagggcagctttgtgctgtttgtgagcttgcagtggtaggggcggatgcatctggcctgctctgctctcctacacagataagataaattggcagaaggtacttcttttgttccttgttatctttgcctcttttctgttatttttcttgttgctgttatattatatcttgcctgggacgcattgattatgtgcaaggtcaagcaataatagtagggaaagttgtttttgagtatcttgcccagttctttggaccagttggggagatttcaagggcaggttttttttactacatcttgcagtgtgttagaacaacattgtagaaggtacatttgattacaatatgcagtatggattttcgtgtatttctttcaggccttaatgacttttgtagatggttaataattttattgttgcatgcacttaattatttttgtggttctttacaagtgatggctcattgtggaatgc

SEQ ID NO: 849 - DNA, 4237 bp, Cocos nucifera
tctctctctcttagatccagatctcagatccgggggtcagagcccttcttcccttgccgtttctcggttccagatcccgctcatagatccgagccctaatcctaacgctgacatctgattgcttccaatctaatctgaatttttccgattggtttgtttcgatctcgcagacttcttgtggtagttagcgtttccagagatccggtggtttaaggaggcggccgaagggaagaagcaagagagggagacatgctgaccaagttcgagacgaagagcaatcgggtgaaggggctgagctttcacagcaagcggccctggatcctcgccagcctccacagtggcgtgatccagctatgggactaccggatgggcaccctcatcgaccgattcgacgagcacgacggcccggtgcgcggcgttcacttccataaatctcagccccttttcgtctcgggaggagatgattacaagatcaaggtctggaattacaagacccatcggtgcctatttacccttcttgggcatcttgattacattcgcacagtccaatttcatgatgagtatccatggattgttagtgctagtgacgatcagactattagaatctggaactggcagtctcggacatgtatttcggtgttaacagggcataaccactatgttatgtgtgcctctttccatccaaaggaggacctggttgtatcggcttccctggatcagacagtcagggtttgggacattggtgcattgaggaagaaaacagtgtcaccagctgatgacatcttgcgcctgagccagatgaacaccgatctgtttggtggcgttgatgctgttgtcaagtatgtcttggaaggtcatgatcgtggagtcaattgggcatcatttcatcctagcctgcctctcattgtgtcgggagcagatgatagacaagtgaaactatggcgaatgaatgatacaaaggcttgggaagtggacacgctgagaggccacatgaataatgtctcttgtgtaatgttccatgcaaagcaggatattattgtgtcaaactcagaggacaaaagtattcgcatttgggatgctacaaaacgcactggaattcagacatttcgccgtgaacatgaccgtttctggattctcactgcgcatccagaaatgaaccttcttgcagctggtcatgacagcggtatgattgtttttaagttggaaagagagcgccctgccttctctgtgagtggagatactctcttctatgtcaaagatcggttcttgcggttctatgagttttcatcccagaaagataatcaagtggttccaatcagaaggcctggttctgtcagcttgaatcagggacccagaacactgtcttacagccccacggaaaatgctgtcttgctctgctccgatgtggatgggggttcatatgaactttatattgttcccaaggattctgccggaaggggtgattatatgcaggaagcaaagaagggagctgggggctcagctgtttttgtagctcggaacaggtttgcagttctcgacaagagtaacaatcaagcattggtgaagaaccttaagaatgagattgtgaagaagagtcttcttcctattgctactgatgcgatattttatgccgggacaggcaatctgttgtgcagggcggaggatagagtggtcatatttgatctccaacagaggctaattcttggggaacttcagaccccatctgtcaagtacattgtttggtcaagcgacatggagtctgttgccttgttgagcaagcatgcaatagttattgctagcaagaaacttgtgcaccgctgcacacttcatgagaccatccgtgtgaaaagtggtgcctgggatgagaatggcatctttctttatacaaccttaaaccatattaagtactgtcttcctaatggggacagcggaatcgtaagaacccttgatgttcctgtttacataaccaaggtttctgggagcaatatctattgcttggatcgtgatggtaggaatagggttatatcaattgatgctacagaatacatattcaagcttgcccttttgcggaaaagatatgaccatgtgatgagcatgatcaggaattcacagttatgcggacaggctgtgattgcatacctgcaacagaaaggtttccctgaagtagctctccattttgtcaaagatgagaggccccgattcaacctggctcttgagagtggtaccatccagattgccgttgcttctgcaaaggagatagatgagaaagactactggtacagattaggcattgaggctcttcgacagggaaacaccagtattggggaatatgcataccagaggactaaaaactttgagaggctatcttttctctatcttgtaacagggaacgtggaacaactgtccaaaatgttgaggatagctgagattaaaaatgatgtgatgggccagttccacaatgccatgtatctaggtgacgttgaggaacgtgtcaagatcttagagaatgctggccatttgcctgttgcatatgtcacagctgcccctcatgggcttgctgaagttgctgacaggcttgcagctgaattgggagataatgttccctctatacctgaaggaaaagacagttctcttctgatgccacctcaaccactcatgtgcagtggcgattggccattattaagggtgatgcaaggtatttttgaaggtgagttggataatcttgggagggcaggacatgaggaagaagaagctaccggtgctgactggggtgatgaggatttggatattgttgatgttgaaagcatgattccgaatggcgacatcgtagcagaggttgaggatggtgaagtaaatgaagagaatgatgaggaaggtgggtgggacctcgaagatttggaattaccaccagatatggaaacaccaaaagctagcaccaatgttcattcacctttgtttgttgctccgacaccaggcatgccagtaagccagatttggattcagaaatcctctctggcaggggagcatgttgcagctgggaatttcgacactgccatgcacctgcttaaccggcaactgggcataaagaactttgctcccttgaagccattgtttgtggatctttacgaaggtagccacacatatcttcgtgcttttgctacagcaccagtgatatcaattgctgttgagaagggttggaccgagtctgccggtcctaatgtaaggggcccaccagcacttgtttttaagttttcacagatggatgagaagcttaaggctgcttaccgagtcacaacagagggaaaatttccggaggctttgcggcaatttctcggaatcctgtacactatcccactcttggtggtggactcgaggagggaagttgatgaagtgaaggagcttattgagatagcgagagaatatgtcctgggcttgaagatggaagtcaaaagaaaggaaatcaaggacaatgcaattcgtcaacaggagttggcagcatacttcaccaactgtaagcttcaaaagattcacatgagactggtgctcgcaagcgcaatgagtagctgctacaagggagggaactttgctacagcagccaattttgctaggatgcttctggagaacagtcctactgaagcccaatcgaagaaggctaggcaggtgttgcaggcttgcagtgataaaaaggatgccaaccagctgaattttgattacaggaatccatttgtagtttgtggggccacttttgttccaatctatcgtgggcagaaggatatttcctgcccgtattgtggggctcgctttgtgcaagctacagaggggcagatttgtgctgtttgtgagcttgcggtggtgggtgcagatgcatcgggtctgctctgttctcccattcaggcaagataaaagggtacaaggtttatattttggctttcttttttgtgttctttagtttaagaacgtcatgttatatctttgccttggaacagactgattgtgtgaaaggtgaaacaataaaaataggaaatgttgctttagagcattttgctctgtcctttgggccagataggacttattaaatgtacaattttgattagttcatgcagattttgtttagaggagcaatgtgagaggttcatttgcttcagaaatgtggtgaggcttttattttctttgtatttgtttaaagatgtgcagggttctttgtgcttgttattctaatacataatgtatcttcctg

SEQ ID NO: 850 - DNA, 4127 bp, Elaeis guineensis
aggcttcttggggtagttagggtttccggagatcaggtggaaagggaggaaggaaggaggagagatgctgacgaagttcgagaccaagagcaatcgtgtgaaggggctgaccttccacagcaagcggccatggatcctcgccagcctccacagcggcgtcatccagctatgggactaccggatgggcaccctcatcgaccgattcgacgagcacgacgggcctgtgcgcggcgttcacttccataaatctcagcccctcttcgtctccggaggagatgattacaagatcaaggtctggaattataagacccatcggtgcctatttacccttcttgggcatctcgattacattcggacagtccaatttcatgatgagtatccatggattgtcagtgccagcgatgatcaaactattagaatctggaactggcagtctcgcacctgcatttcagtgttaacagggcacaatcactatgtcatgtgtgcctcattccatccaaaggaggacctggttgtatcagcttccctggatcagacggttcgggtttgggatattggtgcgctgaggaagaagactgtgtcaccagctgatgacatcttgcggctgagccagatgaacactgatctgtttggtggagttgatgctgttgtcaagtatgtcttggaaggtcatgatcgtggagtcaactgggcatcatttcatccaagcctgcctcttatcgtgtctggagcagatgatcgacagttgaaactatggcgaatgaatgatacaaaggcttgggaagtggacacattgagagggcatatgaataatgtctcttgtgtaatgttccacgcaaagcaggatgttattgtgtcaaactcggaggacaaaagcattcgcatttgggatgctacaaaacgcactggtattcagacatttcgccgtgaacatgaccgtttctggattcttgctgcacatccagaactgaaccttcttgcagctggtcatgacagtggtatgattgtttttaaattggagagagagcgccctgctttctctgtgagtggagatactctctactatgttaaagatcggtttttgcggttctacgagttttcagcccaaaaggataatcaagtggttccaattagaaggcctggttctgtcagcttgaatcagggacccagaacactgtcttacagccctacagagaatgctgtcttgctctgctctgatgcagatgggggttcatatgaactctatattgttcccagggattctgccggaagggctgattatgtgcaggaagcaaggaagggatctgggggctcagctgtttttgtagctcgcaacaggtttgctgttctcgacaagagtaacaatcaagcattggtgaagaaccttaagaatgagattgttaaaaagagccctcttcctgttgctactgatgcgatattttatgctgggacaggcaatctgctgtgtagggctgaggatagggtggtcatctttgatcttcaacagaggctggttcttggggaacttcagaccccatctgtcaaatatgttgtttggtcaagtgacatggagtctattgccttgttgagcaaacatgctatagtcattgctagcaagaaacttacgcaccgctgcacgcttcatgagaccatccgtgtgaaaagtggtgcctgggatgagaatggtgtttttatttatacaaccttaaaccatattaagtactgccttcctaatggggacagtggaattgtaagaacccttgatgttcctatttacatcaccaaggtttctggtagcagtatctactgcttggatcgtgatgggaagaatcgggttatatcaattgatgctacagaatacattttcaagcttgcccttttgcgaaaaagatacgaccatgtgatgagcatgataaggcattcacagctatgcggacaggccgtgatcgcatatctgcaacagaaaggtttccctgaagtagctctccattttgtcaaagatgagaggacccggttcaacctggctcttgaaagtggtaacattcagattgccgttgcttcagctaaggagatagatgagaaagattattggtataggttgggcattgaggcactccgacagggaaacaccagtattatggaatatgcataccagaggactaaaaactttgagaggctatcgtttctctatcttgtaacagggaacatggaaaaactgtccaaaatgttgaggatagctgagattaaaaatgatgtgatgggccagttccacaatgccatgtatctaggtgatgttcaggaacgtgtcacgatcttggagagagctggccagttgcctcttgcatatgtcacagctgccactcatgggcttgctgaagttgctgacagacttgcagctgaattgggagataatgttccctttatacctgaaggaaaagtcagttctcttctgatgccttcaaagccactcatgtgcagtggtgattggccattgttaagggtgatgcgaggtatttttgaaggtgagttggataaccttgggagggcagaacatgaggaagaagaagctactggtgctgactggggtgatgaggatttggatattgttgatgttgaaggcgtgattcagaatggcgatgtagttgcagaggttgaggacggtgaagcaaatgaagagaatgatgaggaaggagggtgggaccttgaagatttggaattaccaccagatatggaaacacccaaagctagcaccaatgctcgttcatctttgtttgttgctcccactcctggcatgccagtaagccaaatttggattcagaaatcctctctggcgggggagcatgtggcagctggaaatttcgacaccgctgtgcgcctgcttagcaggcaattgggcataaagaactttgctcccttaaggccattgtttgtggatctttatgaaggtagccacacatatcttcatgcttttgcgacagcaccggtgatatcaattgctgttgagaaggggtggaccgagtctgccagtcctaatgtcaggggcccaccagcccttgtttttaagttttcacagatggatgagaagcttaaggctgcttaccgagtcacaacagaaggaaagtttccagaggctttgcggcaatttctcaatattttgcacactatcccacttttggtcgtggactcgaggagggaagttgatgaagtgaaggaacttattcagatagcgagagagtatgtcctgggcttgaagatggaagtcaaaagaaaggaaatcaaagacaatgcaattcgtcagcaggagttggcagcctacttcaccaattgtaagcttcaaaagattcacatgagacttgtggtcgcaagcgcaatgagtagctgttacaggggagggaactttgctacagcagccaattttgctaggatgcttcttgagaacagtcctactgaagcccaagcgaagaaggctaggcaagtgttgcaggcttgcggtgataaaaaggataccagccagctgaattatgattacaggaatccatttgtagtttgtggggctacttttgttccaatctaccgtgggcagaaggatatttcctgcccttattgtgcggctcgctttatgccagctacggaggggcagatttgtgcggtttgtgagctttcggtggtgggtgcagatgcatcaggtcttctctgttctcccacacagacaagataaaaagacatgctgttggttcatgaagaaagctatccgtggctgactgtggcatcttggtggcgtcttactacccttgagataaccaaatagccaatgggcttatggccggcctctctaaaatccattctttcttcttggtttccggacactgctgcttcggtgctcttttgtgtttttaaatttatgcactgtcctcagcagcatacaattatctattcccaattatttgcttctctagctgtacttgcccctatcaaaaaatttcataattgatatgcatgatttcctatcagctccatgtttttccctatttatcaagatcagatggcagattgagctgcagtgagttttatatcattcctgatgctgattcgtgttggtggaggactccgggggagagctgctactc

SEQ ID NO: 851 - DNA, 4250 bp, Cocos nucifera
cgccgaacaagcgaacgctgcgaatccagaggaccggccgtcgccatccaacgatctaaaaatttcgacgagtcaaccctcccaaatctcgacgtctttcaagttttctgatgcaagcgtgctacaactcaccgttccgggggggggggggggggggggggggggggggggggggggggggggggggggggggggggggggggggggggggggggggggggggggggggggggggggggggggggaaaaaagggaagaaaattgagaaataaaaacaaagcaacggcagaagcggaagagagaggggtagcagtgggtaacgacgggagagatctcattgtggtgcgtttgcccctactcctctctcgcggcgacggcgatctcgtacccggcggaggtcgtttcttctcgacctctctccgtgttctttctcttcatcctcatttccgccttctctctagatccagatctgagttcccgaggcttcttggggtagttagggtttccggacatcaggtggcttaaggaggcggcgaaagggaggaaggaaggaggggagagatgctgaccaagttcgagacgaagagcaatcgggtgaaggggcttagcttccacagcaagcggccatggatcctcgccagccttcacagcggcgtgatccagctatgggactaccggatgggcaccctcatcgaccgattcgacgagcacgacggcccggtgcgcggcgttcacttccataaatctcagccgctcttcgtctccggaggagatgattacaagatcaaggtctggaattacaagacccatcggtgcctatttacccttcttgggcatctcgattacattcggacagtccaatttcatgatgagtatccatggattgtcagtgcaagcgatgatcaaacaattagaatctggaactggcagtctcgcacctgcatttcagtgttaacagggcacaaccactatgtcatgtgtgcctcgtttcatccaaaggaggatctggttgtatcagcttccctggatcagacgatccgggtttgggatattggtgcgctgaggaagaagacggtgtcaccagctgatgacatcttgcggctgagccagatgaacaccgatctgtttggtggagttgatgctgttgtcaagtatgtcttggaaggtcatgatcgtggagtcaactgggcgtcatttcatccgagcctacctcttatcgtgtctggggcagatgatcgacagttgaaaatatggcgaatgaatgatacgaaggcttgggaagtggacacattgagagggcacatgaataatgtctcttgtgtaatgttccatgcaaagcaggatattattgtgtcaaactcggaggacaaaagcatccgcatttgggatgctacaaaacgcactggtattcagacatttcgccgtgatcatgaccgtttctggattcttgctgcacatccagaactgaaccttcttgcagctggtcatgatggtggtatgattgtttttaaattggagagagagcggcctgcattctctgtgagtggagatactctctactatgtcaaagatcggtttttgcggttctatgagttttcaacccaaaaagataatcaagtggttccaattagaaggcctggttctgtcaacttgaatcagggacccagaacactgtcttacagccccacagagaatgctgtcttgctctgctctgatgcagatgggggttcatatgaactctatattgttcccagggattctgccggaaggggtgattatatgcaggaagcaaggaagggatctgggggctcagctgtttttgtggctcgtaacaggtttgcagttctcgacaagagtaacaatcaagcattggtgaagaaccttaagaatgagattgttaaaaaagccctcttcctgttgctactgatgcgatattctatgccgggacaggcaatctgctgtgtagggctgatgatagggtggtcatctttgatctccaacagaggctggttcttggggaacttcagaccccatctgtgaaatatgttgtttggtcaagtgacatggagtctgttgccttgttgagcaaacatgccatagtcattgctagcaagaaacttatgcaccgctgcacgcttcatgagaccattcatgtgaaaagtggtgcctgggatgagaatggagtctttgtttatacaaccttgaaccatattaagtactgccttcctaatggtgatagcggaatcgtaagaaccctcgatgttcccatttacataaccaaggtttctggtagcaatatctactgcttggatcgtgatgggaagaatcgggttatccccattgatgctacagaatacattttcaagcttgcccttttgcgaaaaagatacgaccatgtgatgagcatgatcaggcattcacagctatgcggacaggctgtgattgcgtatctgcaacagaaaggtttccctgaagtagctctccattttgtcaaagatgagaggacccgattcaacctggctcttgagagtggtaacatccagattgccgttgcttcagcaaaggaaatagatgagaaagactactggtaccggttgggcattgaggctctccgacagggaaacaccagtattatggaatatgcataccagaggactaaaaactttgagaggctatcttttctctatcttgtaacagggaacgtggaaaaactgtccaaaatgttgaggatagctgagattaaaaatgatgtgatgggccagttccacaatgccatgtatctaggtgacattcgggaacgtgtcatgatcttggagagagctggccaattgcctcttgcatatgttacagctgccactcatgggcttgctgaagttgctgacaggcttgcagctgaattgggagataatgttccctctttacctgaaggaaaagctagttctcttctgatgccacctcagccagtcatgtgcagtggtgattggccattattaagggtgatgcgaggtatttttgaaggtgagttggataatcttgggagggcggaacatgaggaagaagaagctaccggtgctgactggggtgatgaggatttggatgttgttgatgttgaaggcgtgattcagaatggcgatacggtagcagaggttgaggatggtgaagcaaatgaagagaatgatgaggaaggagggtgggacctcgaagatttggaattaccaccagatatggaaacaccaaaagctagcaccaatgctcgttcatctttatttgttgctcccactcctggcatgccagtaagccaaatttggattcagaaatcctctctggcaggggagcatgtggcagctggaaatttcgacactgccgtccgcctgcttagccggcaactgggcataaagaactttgctcccttaaagccattgtttgtggatatttatgaaggtagccacacatatcttcgtgcttttgcgacagcatcggtgatatcaattgctgttgagaaggggtggactgagtctgccagtcctaatgtgaggggcccgccagcccttgcttttaagttttcacagatggatgagaagcttaaggctgcttaccgagtcacgacagaaggaaagtttccagaggctttgcggcaatttcttggtatcctgcacactatcccacttttggttgtggactcgaggagggaagttgatgaagtgaaggaacttattcagatagcgagagagtatgtcctgggcttgaagattgaagtcaaaagaaaggaaatcaaggacaatgcaattcggcagcaggagttggcagcctacttcaccaactgtaagcttcaaaagattcacatgagacttgtgatcacaagcgcaatgagtagctgctacaggggagggaactttgctacagcagccaattttgctaggatgcttctggagaacagtcctactgaagcccaagcaaagaaggctaggcaggtgttgcaggcttgcggtgataaaaaggataccaaccagctgaattatgattacaggaatccatttgtagtttgtggggctacttttgttccaatctaccgtgggcagaaagatatttcctgtccgtattgtggggctcgctttgtgccagctacacagtggcagatttgtgctgtttgtgagctttcggtggtgggtgcagatgcatcaggtctcctctgttctcccacacagacaagataaaaaggtcctaggtttatataatggcatgtttctttt

SEQ ID NO: 852 - DNA, 4032 bp, Elaeis guineensis
aggcttcttggggtagttagggtttccggagatcaggtggtttaaggaggcggcgaaagggaggaaggaaggaggggggagatgctgaccaagttcgagacgaagagcaatcgggtgaaggggctgagtttccacagcaagcggccatggatcctcgccagcctacacagcggcgtcatccagctatgggactaccggatgggcaccctcatcgaccgattcgacgagcacgacggccctgtgcgcggtgttcattttcataaatctcagccgctcttcgtctccggaggagatgattacaagatcaaggtctggaattacaagacccatcggtgcctatttacccttcttgggcatctcgattacattcggacagtccaatttcatgatgagtatccatggattgtcagtgcaagcgatgatcaaacaattagaatctggaactggcagtctcgcacctgcatttcagtgttaacagggcacaaccactatgtcatgtgtgcctcgttccatccaaaggaggacctggttgtatcagcttccctggatcagacggtccgggtttgggatattggtgcgctgaggaagaagacggtctctccagctgatgacatcttgcgcctaagccagatgaacaccgatctgtttggtggagttgatgctgttgtcaagtatgtcttggaaggtcatgatcgtggagtcaactgggcctcatttcatccaagcttgcctcttattgtgtctggagcagatgatcggcagctgaagctatggcgaatgaatgatacgaaggcttgggaagtggacacattgagagggcacatgaataatgtctcttgtgtaatgttccatgcaaagcaggatattattgtgtcaaactcagaggacaaaagcatccgcatttgggatgctacaaaacgcactggtattcagacatttcgccgtgagcatgaccgtttctggattcttgctgcacatccagaaatgaaccttctggcagctggtcatgacagtggtttgattgtttttaaattggagagagagcgccctgctttctctgtgagtggagatactctctactatgtcaaagatcggtttttgcggttctatgagttttcagcccacaaggataatcaagtggttccaattagaaggcctggttctgttagcttgaatcaggggcccagaacactgtcttacagccccacagagaatgctgttttgctctgctctgatgtggatgggggttcatatgaactctatattgttcccaaggattctgccggaaggggtgattgtgtgctggaagcaaggaagggatctggggcctcagctgttttcatagctcgcaacaggtttgcagttctcgacaagagtaacaatcaagcattggtgaagaaccttaagaatgagattgttaaaaagagttctcttcctgttgctactgatgcaatattttatgccgggacaggcaacctattgtgtagggccgaggatagggtggtcatctttgatctccaacagaggctggttcttggggaacttcagaccccatctgtcaaatatgttgtttggtcaagtgacatggagtctgttgccttgttgagcaaacatgctatagtcattgctagcaagaaacttacacaccgctgcatgcttcatgagaccatccgtgtgaaaagtggtgcctgggatgagaatggcgtctttatttatacaaccttaaaccatattaagtactgccttcctaatggggacagtggaatcgtgagaaccatcgatgttcctatttacataaccaatgtttctggtagcagtatctactgcttggatcgtgatgggaagaatcgggttatatcaattgatgctacagaatacattttcaagcttgcccttttgcgaaaaagatacgaccatgtgatgagcatgataaggcattcacagctatgtggacaggcagtgatcgcgtatctgcaacagaaaggtttcccggaagtagctctccattttgtcaaagatgagagaacccgattcaacctggctcttgaaagtggtaacattcagattgccgttgcttcagcaaaggagatagatgagaaagattactggtacaggttgggcattgaggctctccgacagggaaacaccagtattatggaatatgcataccagaagactaaaaactttgagaggctatcttttctctatcttgtaacagggaacatggaaaaactgtccaaaatgttgaggatagctgagattaaaaatgatgtgatgggccagttccacaatgccatgtatctaggtgacgttcaggaacgtgtcacgatcttggagagaactggccatttgcctcttgcatatgtcacggctgccactcatgggcttgctgaagttgctgacaggcttgcagctgaattgggagataatgttccctctgtacctgaaggaaaagtcagttctcttctgatgccacctcagccactcatgtgcagtggcgattggccattattaagggttatgcgaggtatctttgaaggtgagttggagaatcttgggagggcaggacatgaggaagaagaagctactggtgctgactggggtgatgaggatttggatattgttgatgttgaaggcttgattccgaatggtgatatagtagcagaggttgaggatggtgaagcacatgaagagaatgatgaggaaggagggtgggacctcgaagaattggaattaccaccagatatggaaacaccaaaagctagcaccaatgctcgttcacctttgtttgttgctcctacaccaggcatgccagtaagccagatttgggttcagaaatcctctctggcaggggaccatgtggcagctgggaatttcgacactgccatgcgcctgcttagcagacaactgggcataaagaactttgctcccttaaagccatcgtttgtggatctttatgaaggtagccacacatatcttcgtgcttttcctacagcaccagtgatattaattgctgttgagaagggttggactgagtctgccagtcctaatgttaggggcccaccagaacttgtttttaagttttcacagatggatgagaagcttaaggctgcttaccgagtcacaacagagggaaaatttccagaggctttgcggcaatttctcggtatcctgcacactatcccacttttggtggtggactcgaggagggaagttgatgaagtgaaggagcttattgagatagtgagagagtatgtcctgggcttgaagatggaagtccaaagaaaggaaatcaaggacgatgcaattcgtcagcaggagttggcagcctacttcaccaactgtaagcttcaaaagattcacatgagactggtgcttgcaagcgcaatgagtagctgctataggggagggaactttgctacagcagccaattttgctaggatgcttttggagaacagtcctactgaagcccaatcaaagaaggctaggcaggtgttgcaggcttgcagcgataaaaaggataccaaccagctgaattatgattacaggaatccatttgtagtttgtggggctacttttgttccaatctaccgtgggcagaaggatatttgctgcccgtattgtggggctcgctttgtgccagctacggaggggcagatttgtgctgtttgtgagctggcagtggtgggtgcagatgcgtcgggtctactctgttctcccatgcagacaagataaaaaggtactaggtttatattatggctttcttttttgtgttctttagtttaagaacgtcatgttatatctttgccttggaacagactgtgaaaggtgaaacaataaaaataggaagtgttgctttagagcattttgctcagttctttgggccagatagtgacttattaaatgtacaattttgattagttcatgcagattttttttagaggggcaatgtgagaggttcctttacttcagaaatgtggtgaggcttttatttctttgtatttgtttaaagatgtgctagggtttctttgt

SEQ ID NO: 853 - DNA, 4322 bp, Cocos nucifera
aaaaaatcgagaaataaacgcaaaacgacagcataagcataagacggaagagggaggagtggcggtatgtaacgggagggatctcattgtggtgcgttcccctctactctcctctctcgcggcgacggcgatctcctgcctggcggagatcgtttcttctcgacctctctccgtcttttttctccccattctcatttcctcctcctctctagatccagatctaagatcccgaggcttcttggggtagttagggtttccggacatcaggtggcttaaggaggcggcgaaagggaggaaggaaggaggggagagatgctgaccaagttcgagacgaagagcaatcgggtgaaggggcttagcttccacagcaagcggccatggatcctcgccagccttcacagcggcgtgatccagctatgggactaccggatgggcaccctcatcgaccgattcgacgagcacgacggcccggtgcgcggcgttcacttccataaatctcagcccctcttcgtctctggaggggatgattacaagatcaaggtctggaattacaagacccatcggtgcctatttacccttcttgggcatctcgattacattcggacagtccaatttcatgatgagtatccatggattgtcagtgcaagcgatgatcaaacaattagaatctggaactggcagtctcgcacctgcatttcagtgttaacagggcacaaccactatgtcatgtgtgcctcgtttcatccaaaggaggatctggttgtatcagcttccctggatcagacgatccgggtttgggatattggtgcactgaggaagaagacggtgtcaccagctgatgacatcttgcggctgagccagatgaacaccgatctgtttggtggagttgatgctgttgtcaagtatgtcttggaaggtcatgatcgtggagtcaactgggcgtcatttcatccgagcctacctcttatcgtgtctggggcagatgatcgacagttgaaaatatggcgaatgaatgatacgaaggcttgggaagtggacacattgagagggcacatgaataatgtctcttgtgtaatgttccatgcaaagcaggatattattgtgtcaaactcggaggacaaaagcatccgcatttgggatgctacaaaacgcactggtattcagacatttcgccgtgatcatgaccgtttctggattcttgctgcacatccagaactgaaccttcttgcagctggtcatgatggtggtatgattgtttttaaattggagagagagcggcctgcattctctgtgagtggagatactctctactatgtcaaagatcggtttttgcggttctatgagttttcaacccaaaaagataatcaagtggttccaattagaaggcctggttctgtcaacttgaatcagggacccagaacactgtcttacagccccacagagaatgctgtcttgctctgctctgatgcagatgggggttcatatgaactctatattgttcccagggattctgccggaaggggtgattatatgcaggaagcaaggaagggatctgggggctcagctgtttttgtggctcgcaacaggtttgcagttctcgacaagagtaacaatcaagcattggtgaagaaccttaagaatgagattgttaaaaaagccctcttcctgttgctactgatgcgatattctatgccgggacaggcaatctgctgtgtagggctgatgatagggtggtcatctttgatctccaacagaggctggttcttggggaacttcagaccccatctgtgaaatatgttgtttggtcaagtgacatggagtctgttgccttgttgagcaaacatgccatagtcattgctagcaagaaacttatgcaccgctgcacgcttcatgagaccattcatgtgaaaagtggtgcctgggatgagaatggagtctttgtttatacaaccttgaaccatattaagtactgccttcctaatggtgatagcggaatcgtaagaaccctcgatgttcccatttacataaccaaggtttctggtagcaatatctactgcttggatcgtgatgggaagaatcgggttataccaattgatgctacagaatacattttcaagcttgcccttttgcgaaaaagatacgaccatgtgatgagcatgatcaggcattcacagctatgcggacaggctgtgattgcgtatctgcaacagaaaggtttccctgaagtagctctccattttgtcaaagatgagaggacccgattcaacctggctcttgagagtggtaacatccagattgccattgcttcagcaaaggatatagatgagaaagactactggtaccggttgggcattgaggctctccgacagggaaacaccagtattatggaatatgcataccagaggactaaaaactttgagaggctatcttttctctatcttgtaacagggaacgtggaaaaactgtccaaaatgttgaggatagctgagattaaaaatgatgtgataggccagttccacaatgccatgtatctaggggacattcgggaacgtgtcatgatcttgaagcgagctggccaattgcctcttgcatatgttgcagctgccactcatgggcttgctgaagttgctgacaggcttgcagctgaattgggagataatgttccctctttacctgaaggaaaagctagttctcttctgatgccacctcagccagtcatgtgcagtggtgattggccattattaagggtgatgcgaggtatttttgaaggtgagttggataatcttgggagggcggaacatgaggaagaagaagctaccggtgctgactggggtgatgaggatttggatgttgttgatgttgaaggcgtgattcagaatggcgatacggtagcagaggttgaggatggtgaagcaaatgaagagaatgatgaggaaggagggtgggacctcgaagatttggaattaccaccagatatggaaacaccaaaagctagcaccaatgctcattcacctttgtttgttgctccgacaccaggcatgccagtaagccagatttggattcagaaatcctctctggcaggggagcatgtggcagctgggaatttcgacactgccatgcacctgcttaaccggcaactgggcataaagaactttgctcccttgaagccattgtttgtggatctttacgaaggtagccacacatatcttcgtgcttttgctacagcaccagtgatatcaattgctgttgagaagggttggaccgagtctgccggtcctaatgtaaggggcccaccagcacttgtttttaagttttcacagatggatgagaagcttaaggctgcttaccgaatcacaacagagggaaaatttccggaggctttgcggcaatttctcggaatcctgtacactatcccactcttggtggtggactcaaggagggaagttgatgaagtgaaggagcttattgagatagcgagagaatatgtcctgggcttgaagatggaagtcaaaagaaaggaaatcaaggacaatgcaattcgtcaacaggagttggcagcatacttcaccaactgtaagcttcaaaagattcacatgagactggtgctcgcaagcgcaatgagtagctgctacaagggagggaactttgctacagcagccaattttgctaggatgcttctggagaacagtcctactgaagcccaatcgaagaaggctaggcaggtgttgcaggcttgcagtgataaaaaggatgccaaccagctgaattttgattacaggaatccatttgtagtttgtggggccacttttgttccaatctatcgtgggcagaaggatatttcctgcccgtattgtggggctcgctttgtgcaagctacagaggggcagatttgtgctgtttgtgagcttgcggtggtgggtgcagatgcatcgggtctgctctgttctcccattcaggcaagataaaagggtacaaggtttatattttggctttcttttttgtgttctttagtttaagaacgtcatgttatatctttgccttggaacagactgattgtgtgaaaggtgaaacaataaaaaataggaaatgttgctttagagcattttgctcggttctttgggccagataggacttattaaatgtacaattttgcctagttcctgcagattttgtttagaggggcaatgtgagagggtacatgtacttcagaaatgtggtgaggcttttatttgctctgtatttgtttaaagatgtgcagggttctctgtgcttgttattctaatacattatgcatcttcctgagtttgtgatgaccctcggga

SEQ ID NO: 854 - DNA, 4224 bp, Musa acuminata
cgggcgaagaacagattacctcgtgtcgtcgcgcgacccccccgtcggacatctctcggtcttctccgtctcccccacccccatcttctctccctcggcggcgatctccacttctctcgatctagtcgctcgagatccagatctgatatccccaggtcggaggccctttcctcagatccgaggcgcgcgcgtggcggcgatgctgaccaagttcgagacgaagagcaaccgggtgaagggcctgagcttccacagcaagcggccttggatcctcgccagcctccacagcggcgtcatccagctatgggactaccggatgggcaccctcatcgaccgctttgacgagcacgatggccccgtccgcggcgtccacttccacaagtcacagccccttttcgtctccggaggagacgactacaagattaaggtttggaattataagactcaccggtgcctgttcacccttcttgggcatcttgactacatccgcactgttcaattccatgacgagcacccatggattgtcagtgcaagcgatgaccaaactattaggatctggaactggcaatctcgtacctgcatttccgtgttgaccgggcacaaccactatgtcatgtgcgccttattccatccaaaggaggacctggttgtatctgcatctctggatcagacggtccgtgtttgggatattagtgcactgaggaaaagagtttctccagctgaagatatcctgcgtctgagccagatgaacactgatttgtttgggggtaccgatgctgttgtcaaatatgtcttggaaggtcatgatcgtggagtcaattgggcatctttccatccaaccctgcctcttattgtatctggagcagatgatcggcaagtgaaattgtggagaatgaatgattccaaagcttgggaggtcgacacattgagaggccacatgaataacgtctcttgtgtaatgttccatgcaaagcaggacatcattgtatccaactcagaagacaaaagcattcgcatatgggatgctactaagcggacaggtattcagacattccgccgggaacatgaccgtttctggattcttgctgcacatccagaaatgaaccttcttgcagctggtcatgatagtggcatgattgttttcaaattggagagggaacgccctgctttctctgttagtggagatgctctatactatgtgaaagatcgattcctgcgattctatgagttctcatcccagaaggatagtcaggtggttccgataaggagacctggttctgtcagcttgaatcagggacctagaacgctgtcttttagtcccacagagaatgctgtcttgatctgttctgatgcggatgggggttcttacgagctttatattgttcctaaggacacttctggaaggggtgactatatgcaggatgcaaggaagggagctggagcatcagctgtttttgtagctcgtaatagatttgctgttcttgacaagagtaacaaccaggccatagttaagaaccttaaaaatgagattgtaaagaagagtcctcttccagttggtacggatgcaatattttatgctggcaccggtaacttgttgtgcagggctgaggacagggtggccatttttgatctccaacagaggattgttcttggagaacttcaaaccccatctatcaaatacattgtctggtcaagtgacatggaatctgttgctttgctggctaaacatgctatagtgattgctaataagaaacttgtgcaccgttacacattgcacgagacaatccgtgtgaaaagcggtgcctgggatgacaatggtgtcttcatatatactacactaaatcatatcaagtattgccttcctaatggggacagtggtattataaaaactcttgatgttctgatttacataaccaaggtttctggaagcaatatctattgcctggatcgtgatgggaagaatcgtgtgatatcgattgattcaacagaatacatctttaagctatccctgtttcggaaaagatatgatcatgtgatgagtatgatcaggaactcacaactatgtggacaggctgtcatctcatatctacaacagaaaggttttcctgaagtagctctccattttgtaaaagatgaaaagactagattcaacttggctctagagagcggtaacattcagatagctgttgctgcagcaaaagagattgatgataaggatcattggtacaggttgggtattgaagcccttcggcaaggaaacactagtatagtggaatatgcatatcagaggacaaagaactttgagaggctatcttttctttatcttgtaacaggtaacatggagaagctgtccaaaatgctgaaaatagctgaaatgaagaatgatgttatgggtcagtttcataatgctatgtatcttggtgacgttcaggaacgtgttaatattttggaaaattctggtcatttgcctcttgcatatgttacagctgtcactcatggactaaaggaagttgctgacaggctttctgctgaactgggagaaaatgttccctctttacctgaaggaaaagtgcgctctcttctgatgccacctgcatcacttatgtgctgtggggattggccattattaagggtcatgagaggtatatttgacaatgggctggacactgtgagggcagggaacgaggaagaggaggaagcaactggtgctgattggggtgatgaagaattggacattgttgacatggaggccgtgatgcagaatgctgatgatgtagttgctgaacttgaagagggggtagcaaatgaagataatgaggagggaggatgggaccttgaggatttggaattaccaccagatgcagatacgccaaaagctgctggaaatgctcgttcttcactatttgttgcccctacacctggcatgcctgttagtcaaatctggattcagaagtcatctcttgcaggagagcatgtggcagctggaaattttgatactgccatgcgcttgctcagccggcaattgggtataaggaatttcgcacctatgaagccattgttcatggatgtttttgtgggcagtcatacctatatgcatgcctttgctactaccccagccatatcaactgctgttgagaagggttggagtgagtctgacagtcctaatgtgaggggcccaccagcacttgtattcaagttttcgcagatggatgagaagctaaaggcagcttatcgagccactacagatggaaagtttccagaggctttacgacaatttctcaacatcttgcacactatcccacttattgtagtggagtcaaggagggaagttgatgaagtgaaggagttgattgagattgctagagagtatgttctgggcttgaaaatggaggttcaaagaaaggaaatcaaggtcaattcagttcaacagcaggagctggcagcttatttcaccaactgtaagcttcagaagattcatatgaggctcgtcctcactaatgctatgactatctgctataaaggagggaactatgcaacagcagctaactttgccaggatgctcctggagaatagaccaactgaaatccaagcaaagaaagctaggcaggtgctgcaacatgctggtgataaaaatgatgctaatcaactcaattatgattacaggaatccttttgtggtttgtggggcaacttttgttccaatctatcgtgggcagaaggatgtttcctgcccttattgtggggctaggtttgtgcctgccatcgaggggcagctttgttctgtttgtgagcttgcagtggtgggatcagacgcctcgggtctactttgttctcctacccaggcgagataattgcaaacaggtacaactatgaactacctgctgtgtctttatatcccttgttgaatgaaactgcacaagctggattttttcccatcaaggcactggagttagcatcttccctcgagcgcacaattcaatgttagccggcggtagcttggaaatgtcatcgatcatgggtcttctgtcatcacatccaacaattcggtcaaatatctggggaaattacaggttataaagttatgccctggcagcacttccttctctccttttcttttagaaaggattcccggtcgttggtctttgtaatttctccatgagacaacaaatggtcgatggcgcactatctcaatcttgagattattttttttacaagaatatctaga

SEQ ID NO: 855 - DNA, 3918 bp, Musa acuminata
ggcgaagaacagattacctcgtgtcgtcgcgcgacccccccgtcggacatctctcggtcttctccgtctcccccacccccatcttctctccctcggcggcgatctccacttctctcgatctagtcgctcgagatccagatctgatatccccaggtcggaggccctttcctcagatccgaggcgcgcgcgtggcggcgatgctgaccaagttcgagacgaagagcaaccgggtgaagggcctgagcttccacagcaagcggccttggatcctcgccagcctccacagcggcgtcatccagctatgggactaccggatgggcaccctcatcgaccgctttgacgagcacgatggccccgtccgcggcgtccacttccacaagtcacagccccttttcgtctccggaggagacgactacaagattaaggtttggaattataagactcaccggtgcctgttcacccttcttgggcatcttgactacatccgcactgttcaattccatgacgagcacccatggattgtcagtgcaagcgatgaccaaactattaggatctggaactggcaatctcgtacctgcatttccgtgttgaccgggcacaaccactatgtcatgtgcgccttattccatccaaaggaggacctggttgtatctgcatctctggatcagacggtccgtgtttgggatattagtgcactgaggaaaagagtttctccagctgaagatatcctgcgtctgagccagatgaacactgatttgtttgggggtaccgatgctgttgtcaaatatgtcttggaaggtcatgatcgtggagtcaattgggcatctttccatccaaccctgcctcttattgtatctggagcagatgatcggcaagtgaaattgtggagaatgaatgattccaaagcttgggaggtcgacacattgagaggccacatgaataacgtctcttgtgtaatgttccatgcaaagcaggacatcattgtatccaactcagaagacaaaagcattcgcatatgggatgctactaagcggacaggtattcagacattccgccgggaacatgaccgtttctggattcttgctgcacatccagaaatgaaccttcttgcagctggtcatgatagtggcatgattgttttcaaattggagagggaacgccctgctttctctgttagtggagatgctctatactatgtgaaagatcgattcctgcgattctatgagttctcatcccagaaggatagtcaggtggttccgataaggagacctggttctgtcagcttgaatcagggacctagaacgctgtcttttagtcccacagagaatgctgtcttgatctgttctgatgcggatgggggttcttacgagctttatattgttcctaaggacacttctggaaggggtgactatatgcaggatgcaaggaagggagctggagcatcagctgtttttgtagctcgtaatagatttgctgttcttgacaagagtaacaaccaggccatagttaagaaccttaaaaatgagattgtaaagaagagtcctcttccagttggtacggatgcaatattttatgctggcaccggtaacttgttgtgcagggctgaggacagggtggccatttttgatctccaacagcggattgttcttggagaacttcaaaccccatctatcaaatacattgtctggtcaagtgacatggaatctgttgctttgctggctaaacatgctatagtgattgctaataagaaacttgtgcaccgttacacattgcacgagacaatccgtgtgaaaagcggtgcctgggatgacaatggtgtcttcatatatactacactaaatcatatcaagtattgccttcctaatggggacagtggtattataaaaactcttgatgttctgatttacataaccaaggtttctggaagcaatatctattgcctggatcgtgatgggaagaatcgtgtgatatcgattgattcaacagaatacatctttaagctatccctgtttcggaaaagatatgatcatgtgatgagtatgatcaggaactcacaactatgtggacaggctgtcatctcatatctacaacagaaaggttttcctgaagtagctctccattttgtaaaagatgaaaagactagattcaacttggctctagagagcggtaacattcagatagctgttgctgcagcaaaagagattgatgataaggatcattggtacaggttgggtattgaagcccttcggcaaggaaacactagtatagtggaatatgcatatcagaggacaaagaactttgagaggctatcttttctttatcttgtaacaggtaacatggagaagctctccaaaatgctgaaaatagctgaaatgaagaatgatgttatgggtcagtttcataatgctatgtatcttggtgacgttcaggaacgtgttaatattttggaaaattctggtcatttgcctcttgcatatgttacagctgtcactcatggactaaaggaagttgctgacaggctttctgctgaactgggagaaaatgttccctctttacctgaaggaaaagtgcgctctcttctgatgccacctgcatcacttatgtgctgtggggattggccattattaagggtcatgagaggtatatttgacaatgggctggacactgtgagggcagggaacgaggaagaggaggaagcaactggtgctgattggggtgatgaagaattggacattgttgacatggaggccgtgatgcagaatgctgatgatgtagttgctgaacttgaagagggggtagcaaatgaagataatgaggagggaggatgggaccttgaggatttggaattaccaccagatgcagatacgccaaaagctgctggaaatgctcgttcttcactatttgttgcccctacacctggcattcctgttagtcaaatctggattcagaagtcatctcttgcaggagagcatgtggcagctggaaattttgatactgccatgcgcttgctcagccggcaattgggtataaggaatttcgcacctatgaagccattgttcatggatgtttttgtgggcagtcatacctatatgcatgcctttgctactaccccagccatatcaactgctgttgagaagggttggagtgagtctgacagtcctaatgtgaggggcccaccagcacttgtattcaagttttcgcagatggatgagaagctaaaggcagcttatcgagccactacagatggaaagtttccagaggctttacgacaatttctcaacatcttgcacactatcccacttattgtagtggagtcaaggagggaagttgatgaagtgaaggagttgattgagattgctagagagtatgttctgggcttgaaaatggaagttcaaagaaaggaaatcaaggtcaattcagttcaacagcaggagctggcagcttatttcaccaactgtaagcttcaaaagattcatatgaggctcgtcctcactaatgctatgactatctgctataaaggagggaactatgcaacagcagctaactttgccaggatgctcctggagaatagaccaactgaaatccaagcaaagaaagctaggcaggtgctgcaacatgctggtgataaaaatgatgctaatcaactcaattatgattacaggaatccttttgtggtttgtggggcaacttttgttccaatctatcgtgggcagaaggatgtttcctgcccttattgtggggctaggtttgtgcctgccattgaggggcagctttgttctgtttgtgagcttgcagtggtgggatcagacgcctcgggtctactttgttctcctacccaggcgagataattgcaaacaggtactttgttatatgctacatgtcctttttgccgtagttgagtttatcatgttatatctt

SEQ ID NO: 856 - DNA, 4135 bp, Amorphophallus konjac
agtgaagagaggtgttcgaagatgctgacaaagttcgagacgaagagcaaccgggtgaaggggctgagcttccacaacaagcggccatggatcctggcgagccttcacagcggcgtgatccagctgtgggactaccgcatgggcacgctgattgaccgattcgacgaacatgatggccccgtccgcggtgtccacttccacaaatctcagcctctattcgtctccggaggagatgattataagatcaaagtttggaattataagactcataggtgtctatttactcttcttggacaccttgactatatccgtactgtccattttcatcacgaatacccttggattgttagtgcaagtgatgatcaaaccattagaatatggaactggcagtcacggatttgcatttccgtgttgactggacacaatcactatgtcatgtgtgcctcattccatcctaaagaagacctagttgtttcagcttccttggatcaaacagttcgtgtctgggatataggtgctttgagaaagaaaactgtctccccggctgatgatatttcacgtcttagccagatgaatacagatttatttggaggagttgatgctgtggtgaagtatgttctggagggtcatgaccgtggtgttaattgggcctccttccatcccagccttcctctgatagtgtctggagcagatgatcgccaaataaaactatggagaatgaatgacacaaaagcttgggaagtagacacattgagggggcatatgaataatgtttcctgtgtaatgttccatgctaagcaggatataattgtttcaaattcagaggacaaaagtatacgcgtctgggatgttacaaaacgcactggggttcagaccttccgtcgtgagcatgaccgcttctggattcttgcggcacaccctgagatgaatcttctggcagctggtcatgacagtggtatgattgtttttaagttggagagagaacgtcctgcattttcagtgagcggagattctttatattatgtcaaggatcgtttccttcgcttttatgagttctcatctcagaaagataaccaagtgattcccgtacgaaggcctggttcagtcagcttaaatcagggccccaaaacattatcttatagtcctacagagaatgctgttctgatctgttctgatgcagattgtgggtcttatgagctctatattatatccaaggatgttattggaaggagtgattctgtgcaagatgccaggaaagggccaggtgcttcagctatttttgtggctcgaaataggtttgctgtgcttgacaaggcaactaaccaggccatagtgaaaaacttgaagaatgagatagtaaagaagagtgctcttccaattgctgctgatgcaattttttatgctgggacaggcaatgtgttgtgcagggcagaggatagagttgccatttttgatctccagcagaggcttgttcttggggaactacaggctccttctgttaagtacgtggtttggtcaagtgacatggagtctgttgctttacttagcaaacatgcaattgttattgccagcaaaaagcttgttcacagatgtactcttcatgagacgatccgagtgaaaagtggtgcctgggatgacaatggtgttttcatttatactactctgaatcacattaaatattgtcttccaaatggtgacagtggaattatcagaactctggatgttccaatatacataacaaaggtgtctggtaataacatttattgcctggatcgggatggaaagaaccgtctgataacgattgatgccactgagtacattttcaaactatccctcatgaggaagaggtacgaccaggtcatgagtatgatcaagaactcacagctatgtgggcaggctgtgattgcttaccttcagcagaaggggttcccagaagttgccctacattttgttaaagatgagaggactagattcaacttggcccttgagagtggtaacatccagatagcagtggcttctgccaaggagattgatgagaaggactactggtacaagcttgggattgaggcccttcggcaagggaatacaagcattgtggaatatgcatatcagaggactaagaactttgaaaggttatccttcctctatctcattacgggaaacatggaaaagctttctaaaatgttgaggatagcagaaattaagaatgatgtaatgggccagttccacaatgcactatatttgggtgatatacaggaacgtgtcaaaatcctggagaatgctggccaattgccccttgcatatatcacagcttctattcatggcctcacagatgttgctgataggcttgcagttgagctgggagataatgtgcctgctgtaccacaggggaaggttcctagtcttctgatcccacatcctccccttgtttgcagtggtgactggccgttattgcgagtcatgaggggcatctttgaaggtggtttggatggtgtgggaagggctggccatgatgaagatgaagaggctactgccccagattggggtgatgaggatttggacattgttgatgttgaacgtgcattgcagaatggagatattggagcagcaggtgaggagggtgaagtgaatgaagaggatgatgaggaaggtggatgggacgtggaagatcttgaactacctcctgatgttgatactccgaaggctgctgttgtttcccgtagttcattgtttgttgcaccgacccctggtatgcctgtgagccagatatggattcagaaatcatccctggcaggtgagcatgcggcagctgggaattttgatactgcaatgcgtttactcagccgtcaactgggaatcaagaactttaccccactgaagtcatcgttcatggatttgtatgtgggcagccactcatatttgcgtgcatttgcttcagctacagttatatctcttgcagtggagaaagggtggagtgagtctgccagtcccaatgtgaggggtcctccagcacttgtgtttaaattctctcagctggaggagaaactcaaacttgcttacaaggccactacagaggggaagtttcctgaagccttgcgattgttcctcagtatattacacactatccctcttgtggttgtggaccagagaagggaggttgatgaagtgaaggagctcatagagatagcaagggagtatgtgcttggcttgaagatggaggtaaagagaaaggagactaaagacaacttggtccgccagcaagagttggcggcatacttcaccaattgcaaattgcagaagggtcacttgaggctggttctaatcaatgccatgacagtttgcttcaagggcagtaatttcagtacagcagccaattttgcaagaatgttgttggacaccaacccaactagtgaagcacatgcaaagaaagcaaggcaagttctgcaggcttgtagcgataagcaagattccactcagctaaactatgattttaggaatccttttgtggtttgtggtgcaacatttgtgcctatataccgggggcagagagatgtgtcctgccctttttgtggggcacgctttgtgccagcaatagaagggcagatttgtgcagtttgtgagattgcagttgtcggggcagatgcttctgggcttttgtgctccccttcccagacaagatgagggatgtcctttaccatttttcatggacaagatgagggatatgcttcttttctctttccattttcttcgttctttagtatcctctttttgtttcttcaggtgagtagattaagactgtaattcgttatatgctgccctagggaaattattctttagttggtcgtgtgtgtgaagtttatgacggcctctgcagtttgggtttttagctttcatgtttgaaatccctaattttttgatgtcaagtgtcatcttgactttgctgttaacttgttagctaaaacagcaaaagcaactgtcaaggaaaaagttgtttttctcttcgtgtgggataatcatctaatcacctcttgcacgggcaaccttccgtggggtcatcttaccatttgtgtcatgttggttgttggacatccatgaatttaaggtcttgataatcaaataaccggttgtggtacta

SEQ ID NO: 857 - DNA, 3455 bp, Triticum aestivum
actgtccgtgtttgggatattggtgccctgaggaagaagacggtgtcacctgcggatgacatcctgcgtctcactcagatgaacactgatctgtttgggggtgtcgatgcggttgtgaaatatgtcttggaaggccatgaccgtggtgtcaactgggcatcatttcaccccacattgccactcattgtttctggggcagatgaccggcaagtgaagctgtggagaatgaatgataccaaggcttgggaagttgatactttgagggggcacatgaataatgtgtcgtgtgtgatgttccatgcgaagcaagacatcattgtgtccaactcagaggacaaaagcattcgcatttgggatgccacaaagcgaactggtattcagacatttaggcgggaacatgaccgtttctggatccttgctgcccaccctgaaatgaatcttcttgctgctggtcatgacagtggcatgattgtgtttaaattagagagggaacgcccagctttcagcgtgagtgctgatactgtgttctatgtgaaggacagattcctccggttctttgagtactccacccagaaggaagttcaggtggctccaataagaagaccaggatccgtcagcttgaaccaggcacccaggacactatcttatagtccaactgaaaatgctgtgttgatttgctcggatgtggacgggggctcatatgatctgtacattgttcccaaggattctgctggcagggctgattatttgcaagaggcaaagaagggagctggtggctcggctgtttttgtggcacggaataggtttgctgtccttgagaagagtagcaatcaagttttggtgaagaatcttaagaatgaaattgtgaagaagagtcctcttcctattgcgactgatgcaatttattatgctgggactggtaatttgttgtgcaaagctgaagatcgtgtgaccatctttgatctacaacaaaggctagttcttggtgaactccagtcagctggtgttaaatatgtagtttggtccagtgacatggagtatgttgcactgctgagcaagcatgcagtagttatagctagcaagaagcttgtccatcgctctacactgcatgaaaccattcgtgtgaaaagtggtgcctgggatgagaacggtgtttttatttactctactttgaaccatatcaaatactgtcttcccaatggagatagtgggatcataaagacccttgatgtccctgtttacataacaagggttattgggaacaacattttctgtcttgatcgtgatggaaagaacaagctgataacagttgatgcttctgaatacattttcaagctcgcccttctccggaaacgttatgaccatgttatgagtatgattaagagctcacagctgtgtgggcaggcagtgatttcatatttgcaacagaaagggtttccagaagttgctctccactttgtgaaagatgaaaagacaagattcaatctagctcttgaaagtggtaacatccaaatcgcagtggcttctgcaaaagagattgatgacaaggatcactggtacagattgggaattgaggccctgaggcaggggaatgttggtattgtggaatacgcataccagcggacaaagaattttgagaggctgacatttctgtatcttattactggttacatggacaaggttggcttcatgtgcaaaattgccggacagaataacaatttgatgggtcagttccacaatgcattgtatcttggcgatgctaggaagcgagctgagatcctggagaatgctggacagcttcctcttgcctacgtcactgctgccactcatggtctcactgaaattgctgaaaggcttgctgctgagttgggtgagaatgttccttctctacctgaaggaaaaactcgctcactcttgattccgcccgcacccctcatatccagcgttgattggccattgctccgggtgatgcgtggcatatttgagggtggactggatgctactgggagagcagaagttgaggaagatgatgaagctgctggtgctgactggggtgatgaggacttggatattgtggatgcaagtgatgcagtggcaaatggaggtgatggttttgatcccgaggaaggtgaagcgaacgaggaggatggtgaggaaggtggttgggatcttgaagatctggaattgcctgaagctgagaccccaaaagctgctggaaatgctcgctccactgtgtttgttgctcctacaccaggaatgcctgtcagccaaatttggactcagaaatcttctcttgctggggagcatgcagcagcaggcaacttcgacactgcaatgaggttgctcagccgccagttgggcatcaagaactttgctcccctgaaacccatgtttctcgatcttcatatgggcagtcattcatatcttcgcgcacttgcaactgctcccgttatatcaattgctgttgagaaaggttggagtgagtcctcaagtcctaacgtgaggggccctccttcactagttttcaccttctcacaaatggaagacagactcaaggcagcctacaaagccacaaccgagggaaagttcccagaagcgctgagacagttcctcagcatcttgcataccattcccttgatcgtggtggactcgcggagagaagttgatgaagtgaaggagttgatcgagatagtgagggaatatgttcttggtctaagaatggaactcaagaggaaggaattgaaggacaacgtcaaccggcaacaggaactggcggcctacttcaccaactgcaagctccagagggttcacatgcgccttgtgctctcgaacgccatggctctatgctacaagcagaagaactttgcgaccgcagagcactttgcgaggctgctccttgagaacagccctaatgaggtccaagcgaagaaggctcggcaggtgcagcagcagtgcaacggcaagaaggacagccatgagctcaactatgactacagaaatccgttcgtcgtctgtggctcgacgtatgttcccatctaccgcggccaaaaggacatctcgtgcccatactgcggatcccggtttgttcctgccattgaagggcagctttgtaccatatgcgagctggctgtggtcggcgcggacgcctcgggcctcctgtgctcccctacacagacgagatgagcggaagaggctagtcgttagagctcccctatattctttctagtctcgtaaagtctatcttatactttaccaggaggtttactgattgtgtaaggaataagtataatagtacatggtttttgtcggagtttttctcatactttttctatcactttccataccccggtttttgtttgccttgaggatgctgttatatgcttgagacttacaatgatcaactcatgcgaactatgcctacccgttgatgtatcatagtttcgctctgactatgg

SEQ ID NO: 858 - DNA, 4293 bp, Musa acuminata
gaaaaagtgatgaagtggtgtaacggagagagtagagatattcttccccgttcattctctcttctcccccccgtctccttctcccttcctctctcggcgcggcggcgatatccgcttctatcgatctaatttctcgagatccagatctgagaccctcaggcgggcgcgtggcagcgatgctgaccaagttcgagacgaagagcaaccgggtgaaggggctgagcttccacagcaagcggccctggatccttgccagcctccacagcggcgttatccagctatgggactaccggatgggcacactcatcgaccgtttcgatgagcatgatggccccgtccgaggcgtccactttcacaagtcccagcctcttttcgtctctggaggagatgactataagattaaggtctggaattataagacacaccggtgcctgttcacccttcttgggcatcttgattacatccgcactgttcagttccacgatgagcacccatggatcgttagtgcaagtgatgatcaaactattaggatttggaactggcaatctcgaaactgcatttcggtgttgaccgggcacaaccactatgtcatgtgcgcctcattccatccgaaggaggacctgattgtgtctgcatctttggatcagacggtccgtgtttgggatattagttcactgaggaaaaaggtttccccagctgatgatatcctgcgtctgggacagatgaatgcagatctgtttggaggtgttgatgctgttgtcaaatatgtcttggaaggccacgatcgtggagtcaactgggcatctttccatcctaccttgccgcttatcgtctctggtgcagatgatcggcaagtgaaactgtggagaatgaatgattcaaaggcttgggaggtggacacactgagaggccatatgaataatgtctctagtgtcatgttccatgcaaagcaggacatcattgtatctaactcagaagacaaaagcattcgcatttgggatgcgacaaagcgaacgggtattcaaacatttcgtcgtgaacatgaccgtttctggattctcgctgcacatccagaaatgaatcttcttgcagctggccatgatagtggcatgattgttttcaaattggagagggaacgacctgctttctcagtcagcggagatgccctatactatgtaaaagatcgtttcttgcgattctatgagttctcgacccagaaagatactcaggtggttcctataaggagacctggttctgtcagcttgaatcagggacccagaacactgtcttttagctccacagagaatgctgtcttgatctgttctgatgtcgatggggggtcttacgagctttatatcgttcctaaggacactgctggaaggggtgactatatgcaagatgcaaagaagggagctggagcatcagctgtttttgtagctcgtaatagatttgctgttctcgacaagactagcaatcaggccatagttaagaaccttaaaaatgagattgtgaagaagtgccctctcccaagtggtacagattcaatattttacgcaggcactggtaacttgttgtgcagggctgaggacaaggtggctatttttgatctccaacagaggattgtccttggagaacttcaaattccacctgttaaatacgttgtttggtcaagtgacatggaatctattgctttgctgggtaaacatgctatagtaattgctaataagaaacttgtacaccgttgtacattgcatgagactatccgtgtgaaaagtggtgcctgggatgacaatggtgtcttcatctatacaacgttaaatcatatcaagtattgccttcctaatggggacagtggaattataaagacacttgatgttcctatttacataaccagggtttctggaagaactatctattgcttggatcgtgatgggaagaactgtgtgatatcaattgattcaacagagtatatcttcaagctctctctgtttcggaaaagatatgatcatgtaatgagtatgatcaggaactctcagctatgcggacaagctgtcattgcatacctacaacagaaaggttttcctgaagtagcactccatttcgtgaaagatgaaaagactagattcaacctggctcttgagagtggtaacatcgaaatagctgttgcttcagcaaatgtgattgatgataaggaccattggtatcggttgggtgttgaggcacttcggcaaggaaacacaagtattgtggaatatgcatatcagaggacaaagaactttgagaggctatctttcctttatcttgttactggtaacaaggagaagctgtccaaaatgctcaaaatatctgaattgaagaatgatatcatgggccagtttcataatgccatgtatcttggtgacattcaggaacgtgtcaagattttggaaaatgctggtcatctgcctcttgcatatgttacagctgtcactcatggattaaaggaagttgctgacaggctcactgctgaattgggagaaaatattccctctttacccaaaggaaaagtgtgttctcttctgatgccaccggcatcactcgtgtgccgtggggattggcctttactaaaggtaatgagaggtatttttgacaatgggctagacgttgggagggcaggaaatgaggaagaggaggaagctactggtgctgaatggggtgatgaggaattggacattgttgaaatggagggcatgctgcaaaatgctgatatagtagcagaacttgaagatggggtagtaaatgaagatagtgaggagggtggatgggaccttgaggatttggaattaccaccagatgcagatacaccaaaagctgctggaaatgttcgcacttcattatttgttgctcctacacctggcatgcctgttagccaaatctggattcagaagtcttcccttgcaggagagcatgtggcagctgggaattttgacactgccatgcgcttgcttagacgacagttgggtataaagaactttgctcctatgaagccattgttcatggatcttcttgtgggaagtcatacctatatgcatgcctttgcctcagccccagctatatcaattgctgttgagaaaggttggagtgaggcttccagtcctaatgtgagggcccctccagcacttgtattcaacttttcacagatggatgagaagctcaaggcagcttatcgagccacaacagagggaaagtttccagaagctttacgccagtttctcaacatcttgcataccatcccacttatcgtagtagactcaaggagggaagttgatgaagtgaaggagctgattgagatagctagagagtatgttctgggcttgaaaatggaggtcaaaagaaaggaaatcaaggacaatgcagttcgacagcaggagctggcagcctatttcaccaactgtaagcttcagaatatccatatgaggcttgtcctcattaatgctatgactatctgctataagggagggaactatgcaacagcagcaaattttgccaggatgcttctggagaatagccccactgaaatccaagcaaagaaggctaggcaggtgctgcaacatgctggtgataaacaggatgctaaccagctcaattatgattacaggaatccttttgtagtttgtgggacaacttatgttccaatctatcgtgggcagaaggatgtttcctgcccttattgtggggctcggtttgtgccagccattgaggggcagctttgttctgtttgtgagcttgcaatggtgggtgcagatgcctcaggtctacgttgctctcctactcaagcaaaataattggaaacaggtataactaccagctgtgactttcacatccgtccattattgaatcgatactcattggtcagaggcgcatcctggcttccatttagtttctctagccataggtcttgcttaaatagtgtctgcggtttcagccatgagcatctatagcttcggcattttactttggttacagcaaaagttggattctttttcattgaggcactggagctggcgttttttcccctgagcgtaaagtttggagccgcattggcatttgcttcgaacgtcattgatcaactgttgggtgcatgggagagtcttctagctgccatcttcaaaaatccggtcacatattcggggcctgaattacacatgtataagctaatatagcaggctgactacaaccaaattcttggtgaattgtacttcttataacaaaaatattatccattttcttctactcatggattgaaattgttac

SEQ ID NO: 859 - DNA, 4348 bp, Musa acuminata
taccgcatcgagtgagatcatgggatcaaccgctaccaatgtgatctctgtatcatccaaagattccccccaaaaggcaaaagaattaagaaagagagggcattagaccagagagattggccggagagtgacggtgtaattgggagaggcctcgttttggcgcgatctcttcaccctctctcggcggcgacgccgatcgcctctcgtcgatccatactcttctgcttcccttccctcctagatctggcccccagatcctgaggcttttggtggtggcgagggcttcaagaggcgaaggccgcgatgctgaccaaattcgagaccaagagcaatcgggtgaaggggctgagcttccacagcaagcggccctggatcctcgccagcctccacagcggtgtgatccagctatgggactacagcatgggcacgctcatcgatcggttcgacgagcacgacggtcccgttcgtggcgtccacttccataaatcgcagcccctcttcgtctccggaggggatgattacaaaatcaaggtctggaattataagacccgccgttgtctatttacccttcttgggcatcttgattacatccgtacagttcaattccatgatgagcatccctggattgttagtgctagtgatgatcaaaccattaggatttggaactggcaatcacggacctgcatttctgtgttaaccgggcacaatcactatgtcatgtgtgcctcattccatccaaaggaggacctggttgtatcggcttcccttgatcaaacagttcgtgtctgggatattggtgctctgaggcagaaggtggtaccagctgatgacattctgcgccttagtcagatgaacacagatttgtttggtggaattgatgcagttgtcaagtatgtcttagaaggtcatgaccgtggggtcaattgggcatcattccatcctactttgcccctaatcgtgtctggtgctgatgaccggcaagtgaaactctggagaatgaatgattcaaaggcttgggaggtggacacattgagagggcacactaacaacgtttctagtgtgatgttccacatgaagatggatatcattgtatccaactcggaggacaaaagcattcgtgtttgggatgctacaaaacgcacaggtgttcagacatttagacgtgagcatgaccgcttctggattcttgctgtgcatccagctatgaaccttcttgcagcaggtcatgatagcggcatgatcatcttcaagttggagagagaacgccctgctttctctgtcagtggagatactctatactatgttaaagatcgcttcttgtggttgtatgagttctcaacccagaaggacattcaggttgttcctataaggaagcctggttctgtcagcttaaaccagggacctagaacactgtcttatagtcccacggagaatgctgtattgatctgttctgatgtggacggtggatcttatgagttatatattgttcctaaggacatatctcttaggagtgactatatgcaggaagcaaaaaggggggctggtgggtcagcagttttcatagcccgcaatagatttgctgttctggacaggagtaccaatcaagtagtagtgaagaacctgaaaaatgagatagtaaagaaaagtcttcttccaatcgctactgatgcaatattttatgctgggactggtaacgtgttgtgcagagctgaggacagggtggccatctttgatcttcagcagaggattgtcattggtgagctgcagaccccatctgtcaagtacattgtctggtcaagtgacatggaatctgttgctttgcttagtaagcatgctatagtcattgctaataagaaacttgtgcttcgttgcacaatgcacgagactattcgtgtaaaaagtggtgcctgggatgataatggcgttttcatttatgcaacattaaatcatatcaagtattgcctaagtaatggggacaccggaattgtaagaactctggatgaacctatttacataaccaagatatctggaagcaatattttttgcttggatcgcgatgggaagacccgggttatatcaattgatgctacagagtacatcttcaagctttctcttatgcaaaaaagatatgaccatgtgatgggtatgataaggaattcacagttatgtggtcaggctgtaattgcatatcttcaacagaaaggctttccagaagttgctctccatttcgttaaggatgagaagacccgatttaatctggctcttgagagtggtaatatccaaattgctgttgcttcagcaaaagagattgatgataaagaccattggtacaggttgggcattgaggcccttcgacagggaaacactaacattgtagaatatgcatatcagaggacaaagaactttgagaggctctcatttctctatcttgtaacagggaatatggaaaagctatccaaaatgctgaggatagctgaaattaagaatgacatcatgggtcagttccacaatgcactgtatcttggtgacattcaggaacgtgtcaaaatactggagaatgctggtcatttgcctcttgcatatgttacagctgccactcatggacttcaggaagttgctgataggcttgcaactgagctgggagataatgttccttcattacctgaaggaaagacacattctcttctaatgcctcctgcaccactcatgtgtggtggggattggcccttactaagggtaatgagaggtatctttgacaatggttcggatatggggagggcaggacaggaggaagaggaggatgctgctggtgctgactggggtgatgaggaactggacattgttgacatggagggagtgatgcagaatggtgaaataatagcagatctcgaggacggtgaaggaaatatagagaatgaagaggaaggaggatgggatcttgaagatctggaattaccagctgatgtggatacaccaaaagctgcaggcaattctcgccattctttgtttgttgccccaacacctgggatgcctgtaagtcaaatctggatccagaaatcatctcttgctggggagcatgtggcagctggaaactttgacactgccatgcgcttgctcagccggcaattggctataaagaactttgcacctttgaagccactattcatggatattcacatgggcagtcattcttatctgtatgcgcttgctactgcaccgattatatcgattgctgttgaaaagggatggaatgagtctgctagctctaatggaggaggtccaccagcacttgtcttcaggttctcacagatggatgagaaacttaaggcagcttatcgagccacaacagaaggaaagttccctgatgctttacgtcatttccttaacattttgcacaccatccctcttattgttgttgactcaaggagggaagttgatgaagtgaaggagctgattgacatagccagagaatatgttctaggtttgaaaattgagctcaaaagaaaggaaatcaaggacaatttggttcgacagcaagaactagcggcctatttcacaaattgtaagcttcagaagattcatatgaggctcgtcctcacaagtgctatgaccatctgctacaagggagggaactgctctacagcggctaattttgcaaggatgcttcttgagagcagcccaacagaagtccaggcaaagaaggctaggcagctgttgcaacattgtggtgacaaaaaagatgttaaccagctcaattacgattataggaatccatttgtggtttgtggggcaacttttgttccgatctaccgtggccagaaagatgtttcttgcccttattgtggagctagatttgtgccaaccatcgaaggtcatctttgtgctgtttgtgagcttgcagtggtaggagcagatgcatctggcctgctctgctcgcctacacagataagataattggcataaggtacttctgttatttgttaacttttgcccttttctgttatttagcttcttgctgttatattatatcttgcctgggacatattgattatgtgcaaggtaaagcaataatagtagaaatgttgcttttgagcatcttgccccattcgccgaaccatggggaggtatttaaggggttagtttttactagattttgcagacggtgttagaacaagattgtagaagctacatttggttaaaagaatgcagttaggattttcatgtatttcttccatccctggattgtttatggagcctttttttaggtggtcaagtttcactgttgcatgcatttattatatttgtagttattaatgaacaattgttgaatctcaataaccggtgagcc

SEQ ID NO: 860 - DNA, 4307 bp, Citrus sinensis
atcagactcagatctaaagggagaaattgaaaaatcagaacatataaaacaaacaaacccttaagctatctctcccgatctaaaaaaatttctctcttataaattcgcaaaactcgcatcgctgatcttggctttgctcatgcactaaccaaatcacatgccgttgatcatttcacgtactggtcatcagatctgagatttcggtgtttgttgattttgattggagaagatgttgaccaaatttgagacgaagagtaatagagtgaagggacttagtttccatagtaagagaccatggatccttgcaagtcttcacagtggtgtgatccagctatgggactatcgtatggggacactcatcgacaggtttgatgagcacgatggccctgttcgtggcgtccatttccacaagtctcagcccttgttcgtctctggaggtgatgattacaagatcaaagtttggaactacaagatgcataggtgtttgtttactcttctcggacaccttgattacatccgtactgtgcagtttcatcatgagtacccgtggattgtgagtgccagtgatgatcagaccatccgcatatggaactggcagtcacgtacttgtatttctgtgttgacgggccacaatcattatgtcatgtgtgcctcattccatcctaaagaagaccttgttgtttcagcctctctagatcagactgttcgtgtctgggatataggtgccctgagaaagaaaacagtgtctcctgcagatgacattctgcggttgagtcaaatgaacactgatctgtttggcggtgttgatgctgttgttaaatatgtcttggaaggtcatgaccggggagtcaactgggcagcattccatcccaccctccctctcattgtctcaggagcagatgatcgtcaagttaaattatggcgcatgaacgaaactaaggcttgggaagtggacactttgagggggcacatgaataacgtgtcctgcgttatgttccatgccaaacaggacataattgtatctaattccgaggataaaagcatccgtgtgtgggatgtaacgaagcgaactggagttcaaactttccgccgcgagcacgatagattctggattctagcatctcaccctgaaatgaatcttttggcagcaggccatgatagtggcatgattgtctttaagctggagagggaacgacctgcatttgcagtgagtggtgattctctgttttatgctaaggatcgctttctgcgatattatgagttttcaactcaaaaagatacccaagttattccaattcggcggcctggttctacaagcttgaatcaaagtccgaggactctttcttacagtcccacagaaaatgctgttcttatctgctcagatgtggatgggggatcttatgagttgtatgtcatacctaaagacagtattggtaggggtgatagtgtgcaagatgcaaagaaaggtcttggaggttcggcaatttttattgcccgaaatagatttgctgtacttgacaaaagcagcaaccaagtattggtcaagaatctaaagaatgaggttgttaaaaagagcatccttccaatcgctgcagatgcaattttctatgctggaactggtaacttgctgtgtcgggctgaggatagagtggttatatttgatctacagcagaggcttgttcttggtgatctccaaactccttttgtcaagtatgttgtatggtctaatgacatggagagtgttgccttgctcagcaaacatgccattatcattgctagtaaaaagcttgtgcaccagtgtactcttcatgagacaatccgagtaaagagtggagcctgggatgacaatggtgttttcatttacacaactttaaatcatatcaaatactgcctcccaaatggggacagtgggattattagaacccttgatgtcccaatctacataacaaaggtttctggaaacaccatcttttgcttggatcgggatgggaagaacagggctatagttattgatgcaacagagtatattttcaagctgtctctattgaggaagagatatgaccatgtcatgagcatgataaggaactcacagctttgtggtcaggcaatgattgcttatctgcagcaaaagggcttccctgaagttgctctccattttgtgaaagatgaaagaactcgatttaacttggctttagagagcgggaacattcaaattgcagttgcatcagctaaggagattgatgagaaagaccactggtatagattaggggtggaggctcttcgccagggtaatgcaggcattgtggagtatgcttatcagaggaccaaaaattttgagaggttatcttttctttatctcataaccgggaacatggacaagctgtccaagatgcttaaaatagctgaagttaagaatgatgtcatgggtcagtttcataatgctttgtatctgggtgatgtcaaagaacgtgtgaaaatcctggagagtgcaggtcatttgcctctggcttatattactgcttccgttcatgggctgcaagatgttgctgaacgactagcagctgagttgggagataatgttccatctgtgccagagggaaaagcaccttcccttttgatgcccccatcccctgttgtgtgtagtggtgattggcctcttctaagagtcatgaagggcatctttgaaggtgggctggataatattggaaggggtgctgtggatgaagaggaagaggctgttgagggtgattggggtgaggaactggatatggttgatgtggatggtttacaaaacggggatgtcgctgcaatcttggaagatggggaagtggcagaagaaggtgaagaagaagagggaggatgggaccttgaagatttggagcttccccctgaggcagaaacacctaaggctcctgtgaatgctcgatctgcagtttttgtggcaccaactcctggcatgcccgttagccagatttggatccagagatcttcccttgctgctgagcacgcagcagctggcaattttgatactgcaatgcggttgctgaacaggcaacttggaataagaaattttgctcctttgaaatccatgtttcttgatcttcattcagggagccacacttatctgcgtgcattttcatcagctccagtgataccgctagctgttgaaaggggatggaatgagtctgccagccccaatgtgaggggaccaccagcacttgttttcaatttctcacagttggaagagaaactcaaggctagttacaaggccacaacaactgggaaatttacagaggccctccgtctctttcttagcattcttcatacgattcctttgattgtggttgactcaaggagggaagttgacgaagttaaggagttgatcactattgtcaaggaatatgtccttggtctgcagttggagcttaaaagaagggaactcaaagatgatccggtacgccagcaggagcttgctgcctacttcacccactgcaaccttcaaatgcctcacttacggttagccttgctaaatgcaatgtcagtatgcttcaagaataagaaccttgctaccgccggtaactttgccaggcggttattggagacaaaccccacaattgagagccaatcaaaaacagccaggcaagtgcttcaggctgcagagaggaatccaacagatgccacacagctgaattatgattttagaaacccatttgtcatttgtggagcaacacatgtgccaatctaccgaggacagaaggatgtctcatgcccctactgtactacccggtttgtgcctagccaggaagggcagctctgctcagtgtgtgatcttgcggttgttggggtagatgcttcaggattgctctgttctcctacccagattcggtgatcaaactactgaatcaggaagaattgttcaaccatttttctgctcatccttttggcagcataaacgatcaagtttattgattctcatatctgcagctaaaaggtaagataccaaaacaagagttaaaagtttcgaatttattgtttgtgctggctacttttttggcttttgcctgtttttttttttttttgccctctatttagttggctatgatttccaatgtaataacaatttgagaattttgacttgggttattcttgttagttgttcataaacaagaatagctaaagggcttttgttaaaattagatgattgtcataggcaggaagacttatatgtcaatgtatgcagaccccatttggcaaatttgctttttgctattatacttggtttttttcttggttgactagttgaaagt

SEQ ID NO: 861 - DNA, 3837 bp, Musa acuminata
gaaaaagtgatgaagtggtgtaacggagagagtagagatattcttccccgttcattctctcttctcccccccgtctccttctcccttcctctctcggcgcggcggcgatatccgcttctatcgatctaatttctcgagatccagatctgagaccctcaggcgggtgcgtggcagcgatgctgaccaagttcgagacgaagagcaaccgggtgaaggggctgagcttccacagcaagcggccctggatccttgccagcctccacagcggcgttatccagctatgggactaccggatgggcacactcatcgaccgtttcgatgagcatgatggccccgtccgaggcgtccactttcacaagtcccagcctcttttcgtctctggaggagatgactataagattaaggtctggaattataagacacaccggtgcctgttcacccttcttgggcatcttgattacatccgcactgttcagttccacgatgagcacccatggatcgttagtgcaagtgatgatcaaactattaggatttggaactggcaatctcgaaactgcatttcggtgttgaccgggcacaaccactatgtcatgtgcgcctcattccatccgaaggaggacctgattgtgtctgcatctttggatcagacgatccgtgtttgggatattagttcactgaggaaaaaggtttccccagctgatgatatcctgcgtctgggacagatgaatgcagatctgtttggaggtgttgatgctgttgtcaaatatgtcttggaaggccacgatcgtggagtcaactgggcatctttccatccgaccttgccgcttatcgtctctggtgcagatgatcggcaagtgaaactgtggagaatgaatgattcaaaggcttgggaggtggacacactgagaggccatatgaataatgtctctagtgtcatgttccatgcaaagcaggacatcattgtatctaactcagaagacaaaagcattcgcatttgggatgcgacaaagcgaacgggtattcaaacatttcgtcgtgaacatgaccgtttctggattctcgctgcacatccagaaatgaatcttcttgcagctggccatgatagtggcatgattgttttcaaattggagagggaacgacctgctttctcagtcagcggagatgccctatactatgtaaaagatcgtttcttgcgattctatgagttctcgacccagaaagatactcaggtggttcctataaggagacctggttctgtcagcttgaatcagggacccagaacactgtcttttaactccacagagaatgctgtcttgatctgttctgatgtcgatggggggtcttacgagctttatatcgttcctaaggacactgctggaaggggtgactatatgcaagatgcaaagaagggagctggagcatcagctgtttttgtagctcgtaatagatttgctgttctcgacaagactagcaatcaggccatagttaagaaccttaaaaatgagattgtgaagaagtgccctctcccaagtggtacagattcaatattttacgcaggcactggtaacttgttgtgcagggctgaggacaaggtggctatttttgatctccaacagaggattgtccttggagaacttcaaattccacctgttaaatacgttgtttggtcaagtgacatggaatctattgctttgctgggtaaacatgctatagtaattgctaataagaaacttgtacaccgttgtacattgcatgagactatccgtgtgaaaagtggtgcctgggatgacaatggtgtcttcatctatacaacgttaaatcatatcaagtattgccttcctaatggggacagtggaattataaagacacttgatgttcctatttacataaccagggtttctggaagaactatctattgcttggatcgtgatgggaagaactgtgtgatatcaattgattcaacagagtatatcttcaagctctctctgtttcggaaaagatatgatcatgtaatgagtatgatcaggaactctcagctatgcggacaagctgtcattgcatacctacaacagaaaggttttcctgaagtagcactccatttcgtgaaagatgaaaagactagattcaacctggctcttgagagtggtaacatcgaaatagctgttgcttcagcaaatgtgattgatgataaggaccattggtatcggttgggtgttgaggcacttcggcaaggaaacacaagtattgtggaatatgcatatcagaggacaaagaactttgagaggctatctttcctttatcttgttactggtaacaaggagaagctgtccaaaatgctcaaaatatctgaattgaagaatgatatcatgggccagtttcataatgccatgtatcttggtgacattcaggaacgtgtcaagattttggaaaatgctggtcatctgcctcttgcatatgttacagctgtcactcatggattaaaggaagttgctgacaggctcactgctgaattgggagaaaatattccctctttacccaaaggaaaagtgtgttctcttctgatgccaccggcatcactcgtgtgccgtggggattggcctttactaaaggtaatgagaggtatttttgacaatgggctagacgttgggagggcaggaaatgaggaagaggaggaagctactggtgctgaatggggtgatgaggaattggacattgttgaaatggagggcatgctgcaaaatgctgatatagtagcagaacttgaagatggggtagtaaatgaagatagtgaggagggtggatgggaccttgaggatttggaattaccaccagatgcagatacaccaaaagctgctggaaatgttcgcacttcattatttgttgctcctacacctggcatgcctgttagccaaatctggattcagaagtcttcccttgcaggagagcatgtggcagctgggaattttgacactgccatgcgcttgcttagacgacagttgggtataaagaactttgctcctatgaagccattgttcatggatcttcttgtgggaagtcatacctatatgcatgcctttgcctcagccccagctatatcaattgctgttgagaaaggttggagtgaggcttccagtcctaatgtgagggcccttccagcacttgtattcaacttttcacagatggatgagaagctcaaggcagcttatcgagccacaacagagggaaagtttccagaagctttacgccagtttctcaacatcttgcataccatcccacttatcgtagtagactcaaggagggaagttgatgaagtgaaggagctgattgagatagctagagagtatgttctgggcttgaaaatggaggtcaaaagaaaggaaatcaaggacaatgcagttcgacagcaggagctggcagcctatttcaccaactgtaagcttcagaatatccatatgaggcttgtcctcattaatgctatgactatctgctataagggagggaactatgcaacagcagcaaattttgccaggatgcttctggagaatagccccactgaaatccaagcaaagaaggctaggcaggtgctgcaacatgctggtgataaacaggatgctaaccagctcaattatgattacaggaatccttttgtagtttgtgggacaacttatgttccaatctatcgtgggcagaaggatgtttcctgcccttattgtggggctcggtttgtgccagccattgaggggcagctttgttctgtttgtgagcttgcaatggtgggtgcagatgcctcaggtctacgttgctctcctactcaagcaaaataattggaaacaggta

SEQ ID NO: 862 - DNA, 4309 bp, Citrus clementina
atcagactcagatctaaagggagaaattgaaaaatcagaacatataaaacaaacaaacccttaagctatctctcccgatctaaaaaaatttctctcttataaattcgcaaaactcgcatcgctgatcttggctttgctcatgcactaaccaaatcacatgccgttgatcatttcacgtactggtcatcagatctgagatttcggtgtttgttgattttgattggagaagatgttgaccaaatttgagacgaagagtaatagagtgaagggacttagtttccatagtaagagaccatggatccttgcaagtcttcacagtggtgtgatccagctatgggactatcgtatggggacactcatcgacaggtttgatgagcacgatggccctgttcgtggcgtccatttccacaagtctcagcccttgttcgtctctggaggtgatgattacaagatcaaagtttggaattacaagatgcataggtgtttgtttactcttctcgggcaccttgattacatccgtactgtgcagtttcatcatgagtacccttggattgtgagtgccagtgatgatcagaccatccgcatatggaactggcagtcacgtacttgtatttctgtgttgacgggacacaatcattatgtcatgtgtgcctcattccatcctaaagaagaccttgttgtttcagcctctctagatcagactgttcgtgtctgggatataggtgccctgagaaagaaaacagtgtctcctgcagatgacattctgcggttgagtcaaatgaacactgatctgtttggcggtgttgatgctgttgttaaatatgtcttggaaggtcatgaccggggagtcaactgggcagcattccatcccaccctccctctcattgtctcaggagcagatgatcgtcaagttaaattatggcgcatgaacgaaactaaggcttgggaagtggacactttgagggggcacatgaataacgtgtcctgcgttatgttccatgccaaacaggacataattgtatctaattccgaggataaaagcatccgtgtgtgggatgtaacgaagcgaactggagttcaaactttccgccgcgagcacgatagattctggattctagcatctcaccctgaaatgaatcttttggcagcaggccatgatagtggcatgattgtctttaagctggagagggaacgacctgcatttgcagtgagtggtgattctctgttttatgctaaggatcgctttctgcgatattatgagttttcaactcaaaaagatacccaagttattccaattcggcggcctggttctacaagcttgaatcaaagtccgaggactctttcttacagtcccacagaaaatgctgttcttatctgctcagatgtggatggggggtcttatgagttgtatgtcatacctaaagacagcattggtaggggtgatagtgtgcaagatgcaaagaaaggccttggaggttcggcaatttttattgcccgaaatagatttgctgtacttgacaaaagcagcaaccaagtattggtcaagaatctaaagaatgaggttgttaaaaagagcatccttccaatcgctgcagatgcaattttctatgctggaactggtaacttgctgtgtcgggctgaggatagggtggttatatttgatctacagcagaggcttgttcttggtgatctccaaactccttttgtcaagtatgttgtatggtctaatgacatggagagtgttgccttgctcagcaaacatgccattatcattgctagtaaaaagcttgtgcaccagtgtactcttcatgagacaatccgagtaaagagtggagcctgggatgacaatggtgttttcatttacacaactttaaatcatatcaaatactgcctcccaaatggggacagtgggattattagaacccttgatgtcccaatctacataacaaaggtttctggaaacaccatcttttgcttggatcgggatgggaagaacagggctatagttattgaagcaacagagtatattttcaagctgtctctattgaggaagagatatgaccatgtcatgagcatgataaggaactcacagctttgtggtcaggcaatgattgcttatctgcagcaaaagggcttccctgaagttgctctccattttgtgaaagatgaaagaactcgatttaatttggctttagagagcgggaacattcaaattgcagttgcatcagctaaggagattgatgagaaagaccactggtatagattaggggtggaggctcttcgccagggtaatgcaggcattgtggagtatgcttatcagaggaccaaaaattttgagaggttatcttttctttatctcataaccgggaacatggacaagctgtccaagatgcttaaaatagctgaagttaagaatgatgtcatgggtcagtttcataatgctttgtatctgggtgatgtcaaagaacgtgtgaaaatcctggagagtgcaggtcatttgcctctggcttatattactgcttccgttcatgggctgcaagatgttgctgaacgactagcagctgagttgggagataatgttccatctgtgccagagggaaaagcaccttcccttttgatgcccccatcccccgttgtgtgtagtggtgattggcctcttctaagagtcatgaagggcatctttgaaggtgggctggataatattggaaggggtgctgtggatgaagaggaagaggctgttgagggtgattggggtgaggaactggatatggttgatgttgatggtttacaaaacggggatgtcgctgcaatcttggaagatggggaagtggcagaagaaggtgaagaagaagagggaggatgggaccttgaagatttggagcttccccctgaggcagaaacacctaaggctcctgtgaatgctcgatctgcagtttttgtggcaccaactcctggcatgcccgttagccagatttggatccagagatcttcccttgctgctgagcatgcagcagctggcaattttgatactgcaatgcggttgctgaacaggcaacttggaataagaaattttgctcctttgaaatccatgtttcttgatcttcattcagggagccacacttatctgcgtgcattttcatcagctccggtgataccactagctgttgaaaggggatggaatgagtctgccagccccaatgtgaggggaccaccagcacttgtcttcaatttctcacagttggaagagaagctcaaggctagttacaaggccacaacaactgggaaatttacagaggccctccgtctctttcttagcattcttcatacgattcctttgattgtggttgactcaaggagggaagttgacgaagttaaggagttgatcactattgtcaaggaatatgtccttggtctgcagttggagcttaaaagaagggaactcaaagatgatccggtacgccagcaggagcttgctgcctacttcacccactgcaaccttcaaatgcctcacttacggttagccttgctaaatgcaatgtcagtatgcttcaagaataagaaccttgctacagcgggtaactttgccaggcggttattggagacaaaccccacgattgagagccaatcaaaaacggccaggcaagtgcttcaggctgcagagaggaatccaacagatgccacacagctgaattatgattttagaaacccatttgtcatttgtggagcaacacatgtgccaatctaccgaggacagaaggatgtctcatgcccctactgcactacccggtttgtgcctagccaagaagggcagctctgctcagtgtgtgatcttgcggttgttggggtagatgcttcaggattgctctgttctcctacccagattcgatgatcaaactactgaatcagaaagaattgttcaaccatttttctgctcatccttttggcagcataaacgatcaagtttattgattctcatatctgcagctaaaaggtaagataccaaaacaagagttaaaagtttcgaatttattgtttgtgctggctacttttttggcttttgcctgtttttttttttttttttgccctctatttagttggctatgatttccaatgtaataacaatttgagaattttgacttgggttattcttgttagttgttcataaacaagaatagctaaagggcttttgttaaaattagatgattgtcataggcaggaagacttatatgtcaatgtatgcagaccccatttggcaaatttgctttttgctattatacttggtttttttcttggttgactagttgaaagt

SEQ ID NO: 863 - DNA, 4302 bp, Musa acuminata
aaagaattaagaaagagagggcattagaccagagagattggccggagagtgacggtgtaactgggagaggcctcgttttggcgctatctcttcaccctctctcggcggcgacgccgatcgcctctcgtcgatccatactcttctgcttcccttccctcctagatctggcccccagatcctgaggcttttggtggtggcgagggcttcaagaggcgaaggccgcgatgctgaccaaattcgagaccaagagcaatcgggtgaaggggctgagcttccacagcaagcggccctggatcctcgccagcctccacagcggtgtgatccagctatgggactacagcatgggcacgctcatcgatcggttcgacgagcacgacggtcccgttcgtggcgtccacttccataaatcgcagcccctcttcgtctccggaggggatgattacaaaatcaaggtctggaattataagacccgccgttgtctatttacccttcttggacatcttgattacatccgtacagttcaattccatgatgagcatccctggattgttagtgctagtgatgatcaaaccattaggatttggaactggcaatcacggacctgcatttctgtgttaaccgggcacaatcactatgtcatgtgtgcctcattccatccaaaggaggacctggttgtatcggcttcccttgatcaaacaattcgtgtctgggatattggttctctgaggcagaaggtggtaccagctgatgacattctgcggcttagtcagatgaacacagatttgtttggtggaattgatgcagttgtcaagtatgtcttagaaggtcatgaccgtggagtcaattgggcatcattccatcctactttgcccctaatcgtgtctggtgctgatgaccggcaagtgaaactctggagaatgaatgattcaaaggcttgggaggtggacacattgagagggcacactaacaacgtttctagtgtgatgttccacacgaagatggatatcattgtatccaactcggaggacaaaagcattcgtgtttgggatgctacaaaacgcacaggtgttcagacatttagacgtgagcatgaccgcttctggattcttgctgtgcatccagctatgaaccttcttgcggcaggtcatgatagcggcatgatcatcttcaagttggagagagaacgccctgctttctctgtcagtggagatactctatactatgttaaagatcgcttcttgtggttgtatgagttctcaacccagaaggacattcaggttgttcctataaggaagcctggttctgtcagcttaaaccagggacctagaacactgtcttatagtcccacggagaatgctgtattgatctgttctgatgtggacggtggatcttatgagttatatattgttcctaaggacatatctcttaggagtgactatatgcaggaagcaaaaaggggggctggtgggtcagcagttttcatagcccgcaatagatttgctgttctggacaggagtaccaatcaagtagtagtgaagaacctgaaaaatgagatagtaaagaaaagtcttcttccaatcgctactgatgcaatattttatgctgggactggtaacgtgttgtgcagagctgaggacagggtggccatctttgatcttcagcagaggattgtcattggtgagctgcagaccccatctgtcaagtacactgtctggtcaagtgatatggaatctgttgctttgcttggtaagcatgctatagtcattgctaataagaaacttgtgcttcgttgcacaatgcacgagactattcgtgtaaaaagtggtgcctgggatgataatggagttttcatttatgcaacattaaatcatatcaagtattgcctaagtaatggggacaccggaattgtaagaaccctggatgaacctatttacataaccaagatatctggaagcaatattttttgcttggatcgcgatgggaagtcccgggttatatcaatcgatgctacagagtacatcttcaagctttctcttatgcaaaaaagatatgaccatgtgatgggtatgataaggaattcacagttatgtggtcaggctgtaattgcatatcttcaacagaaaggctttccagaagttgctctccatttcgttaaggatgagaagacccgatttaatctggctcttgagagtggtaatatccaaattgctgttgcttcagcaaaagagattgatgataaagaccattggtacaggttgggcattgaggcccttcgacagggaaacactaacattgtagaatatgcatatcagaggacaaagaactttgagaggctctcatttctctatcttgtaacggggaatatggaaaagttatccaaaatgctgaggatagctgaaattaagaatgacatcatgggtcagttccacaatgcactgtatcttggtgacattcaggaacgtgtcaaaatactggagaatgctggtcatttgcctcttgcatatgttacagctgccactcatggacttcaggaagttgctgataggcttgcaaatgagctgggagataatgttccttcattacctgaaggaaagacacattctcttctaatgcctcctgcaccactcatgtgtggtggggattggcccttactaagggtaatgagaggtatctttgacaatggttcggatatggggagggcaggacaggaggaagaggaggatgctgctggtgctgactggggtgatgaggaactggacattgttgacatggagggagtgatgcagaatggtgaaataatagcagatcttgaggacggtgaaggaaatatagagaatgaagaagaaggaggatgggatcttgaagatctggaattaccagctgatgtggatacaccaaaagctgcaggcaattctcgccattcattttttgttaccccaacacctgggatgcctgtaagtcaaatctggatccagaaatcatctcttgctggggagcatgtggcagctggaaactttgacactgccatgcgcttgctcagccgtcaattggctataaagaactttgcacctttgaagccactattcatggatattcacatgggcagtcattcttatctgtatgcgcttgctactgcaccgattatatcgattgctgttgaaaagggatggaatgagtctgctagctctaatggaggaggtccaccagcacttgtcttcaggttctcacagatggatgagaaacttaaggcagcttatcgagccacaacagaaggaaagttccctgatgctttacgtcatttccttaacattttgcacgccatccctcttattgttgttgactcaaggagggaagttgatgaagtgaaggagctgattgacatagccagagaatatgttctaggtttgaaaattgagctcaaaagaaaggaaatcaaggacaatttggttcgacagcaagaactagcggcctatttcacaaattgtaagcttcagaagattcatatgaggctcgtcctcacaagtgctatgaccatctgctacaagggagggaactgctctacagcggctaattttgcaaggatgcttcttgagagcagcccaacagaagtccaggcgaagaaggctaggcagctgttgcaacattgcggtgacaaaaaagatgttaaccagctcaattacgattataggaatccatttgtggtttgtggggcaacttttgttccgatctaccgtggccagaaagatgtttcttgcccttattgtggagctagatttgtgccaaccatcgaaggtcatctttgtgctgtttgtgagcttgcagtggtaggagcagatgcatctggcctgctctgctcgcctacacagataagataattggcataaggtacttctgttatttgtcaacttttgcccttttctgttatttagcttcttgctgttatattatatcttgcctgggacatattgattatgtgcaaggtaaagcaataatagtagaaatgttgcttttgagcatcttgccccattcgccgaaccatggggaggtatttaaggggttagtttttactagattttgcagacggtgttagaacaagattgtagaagctacatttggttaaaagaatgcagttaggattttcatgtatttcttccatccctggattgtttatggagcctttttttaggtggtcaagtttcactgttgcatgcatttattatatttgtagttattaatgaacaattgttgaatctcaataaccggtgagcccgtttcatgtgatgttttttcattgcatctgac

SEQ ID NO: 864 - DNA, 3849 bp, Castanea mollissima
atatatgcgcctacacgtatatgtgtataagcgaatctggtagtgtcagtgattgtggatgcgatagtagctccttttgatcgtttcctatactgatcagatctgtgggttttcttgatgcgatttggttgtggacagtgattgaaattgggtcacggtgattggagaagatgttgacgaagttcgagacgaagagtaatagagtgaagggactgagtttccacagtaagaggccgtggatcctcgccagtcttcacagtggtgtgatccagctatgggactaccggatggggactctgattgataggtttgacgagcatgatggaccggttcgtggcgttcatttccacaaatctcagccactatttgtgtctggaggggatgattacaagattaaagtttggaactacaagttgcacagatgccttttcactcttcttggacacctggattatatccgtacagtgcagtttcaccatgagtacccatggattgtgagtgctagtgatgatcagaccattcgcatttggaattggcagtcacgcacttgtatatctgtgttgacgggacacaatcactatgttatgtgtgcatcattccaccccaaagaagacctagttgtgtcagcctccctagatcagactgttcgtgtttgggatatcggtgctctcagaaagaagacagtttcccctgcagatgacatcttgcggctgagtcagatgaacactgatctttttggtggtgttgatgctgttgttaagtatgtcttggaaggtcatgaccgtggggtgaactgggctgcgtttcatcccagtctgcctctgattgtctcaggagctgatgatcgccaagtcaaattatggcgaatgaatgatacaaaggcttgggaagtggacacattgagagggcacatgaataatgtttcatgtgtcatgttccatgccaaacaggacataattgtatccaactcagaggatagaagtatacgtgtgtgggatgtaacaaagagaactggagttcaaactttccgtcgtgagcatgatcgattctggattcttgcatctcaccctgagatgaatctattggctgctggtcatgacagtggtatgattgtcttcaagttggagagagaacggcctgcctttgcagtaagtggtgattctctattctataccaaagatcgctttttgcgattctatgagttttcagctcaaaaggatacacaagtaatgccaattcggcggcctggttccactagcttgaatcagagtccaaggactctttcctatagtcccactgaaaatgctgttctaatctgctcggatgttgatgggggatcttatgagttgtatttcatacccaaagatagcattggtaggggtgatagtctgcaagaagcaaagagaggtcctgggggatcagctgtctttgtggcccggaataggttcaccgtgcttgagaagagcaacaatcaagtcttggtgaagaatctgaaaaatgagattgttaaaaagagtgcccttcctatagctgcagatgcaatcttttatgctggaacaggtaacttgctttgtagggctgaggatagagtggttatttttgatctccagcagaggcttgttcttggtgaacttcaaaccccttttgtcaaatatgttgtttggtctcatgacatggagagtgttgctttactcagcaagcatgccattatcattgctagcaagaaacttgttcaccaatgcactcttcatgagacaatccgtgtaaagagtggtgcctgggatgataatggtgtttttatttatacgactctaaatcacattaagtactgcctctcaaatggagatagtgggataatcagaactcttgatgtcccaatatacattacaaaggtatctggcaatactatcttttgcttggatcgtgatggaaaaaacaggtctatagttattgatgcgacagaatatattttcaagctgtcccttttgaagaagagatatgaccatgttatgagcatgataaggaactcacagctttgtggggaggctgtgattgcttatcttcaacagaagggcttcccagatgttgctctccattttgtgaaagatgagagaactagattcaatttggctatagaaagtgggaatatccaaattgcggttgcatcagctacagcaattgatgagaaagactactggtatagattgggggtggaggctcttcgccagggtaatgcaggtattgtggaatatgcctaccagaggaccaaaaattttgagaggctgtcttttctttatctaataactggtaataatgaaaagctgtccaagatgatgaaaattgctgaagtcaagaatgatgtcatgggtcagtttcataatgccctatatctgggtgatgtcagagaacgtgttaagatcttggaaaatgttggccacttgccgcttgcttacattacagcttcaactcatgggctacaggatgttgctgaacgtctagcagctaagttgggggataatgttccctctttgccagaggggaaaacagcctcccttctgatgcccagagccccagttatgtgtagtggtgattggccccttctgagagttatgaaaggaatatttgaaggagggctggataatattggtaggggagctgcagatgaagaggatgaggctgctgatggtgattggggtgaggagttggacatggttgatgttgatggcttgcagaatggggatgttacggcaattctggaagatggcgaagtgactgcagagaatgaggaagaggcaggatgggaacttgaagatttggagctcccccctgaagcagacactccaagggcatctgtcaatgctcgctcttcggtttttgtggccccaactcctggcatgcctgtaagccaaatttgggtccagaggtcatcacttgctgctgaacatgcagctgctggaaattttgatactgcaatgcgattactgagcaggcaacttggaatcagaaactttactccattgagatccatgtttcttgatcttcatactggcagtcatagctatttacgtgcattttcatctgctccagtgatatcattggcagttgaacgaggatggaatgagtctgctagcccaaatgttaggggtccaccagcacttgtgttcagtttttctcagttggaggagaagcttaaggcaggttacaaggccacaacgactggaaaattcacagaggcacttcgactttttattagcattctccatactattcctcttattgttgttgagtcaaggagggaagttgatgaagtcaaggagttgatcattatagtgaaagaatatgttttgggtttgcaaattgagcttaagaggagggaagtcaaggatgatccagtacgtcagcaagagcttgctgcctatttcactcactgcaaccttcaaatgcctcacttaaggcttgccttgcaaaatgcaatgactgtttgcttcaaggcaaagaaccttgccactgcagctaactttgccaggcggcttctagaaaccaacccgaccctagagagccaagcaaggacagccaggcaagtgctgcaggctgcagagaggaatatgacagattctgcccagttgaactatgatttcagaaacccatttgtgacttgtggggcaacatatgtgccaatttaccgaggacagaaggatgtctcttgcccatactgtagttcccggtttgtgccaagtcaggaagggcagctctgtactgtttgtgatcttgcagtggttggtgcagatgcttcagggttgctctgctctccttcccagatacgatgatcaagcagctagaccaggagca

SEQ ID NO: 865 - DNA, 4105 bp, Allium cepa
tcccgtattagcacagacgcgaaacacttctcaaattcagaccaacaaatagatctagcttcgttttcatctaattgatgaaacaattgttttagttaattaaatatagaagggtagagatgctgacgaaatttgagacgaagagcaatagggtgaaaggattgagctttcacccaaaaagaccatggattcttgcgagtttgcatagtggagtgattcagttatgggattatcgaatgggaactctgattgatcgatttgatgagcacgatggccctgttcgtggtgtgcattttcataaatctcagcctctttttgtttcgggaggtgatgactacaaaattaaagtttggaattacaaaacgcataggtgtttgtttacccttctggggcaccttgattacattcgtacagtgcaattccatgatgaaaatccttggattgttagcgccagtgatgatcaaactattagaatttggaattggcaatccaggacctgtatttcagtactgacaggtcataatcactatgtcatgtgtgcttcatttcatccaaaggaggatctcttagtatctgcttcacttgatcagactgttcgcgtttgggatattggtgctttgaggaaaaagaccgtatcaccggctgatgacatattgcgtctaactcagatgaattcggatttatttggtggggttgatgctgtggtgaagtatgtcttagaaggtcatgatcgtggagttaattgggcttcatttcatcctagccttccacttattgtgtctggtgctgatgatcgccaagtcaaactgtggcgaatgaatgatacaaaggcttgggaagtggatactttgagagggcacatgaacaatgtatcttgtgtcatgtttcatgcaaagcaagacataatagtttccaactctgaagacaaaagcattcgtgtttgggacgctacaaagcgaacaggaattcaaacgttccgacgtgaacatgatcgattctggattcttactgcacacccagaaatgaatttgttagctgccggtcatgactctggtatgatcgtcttcaaactagaaagagaaaggcctgctttctctgttagtggcgatgttttgtactatgtgaaagatcgatttttgcgcttctatgaattctcatccgaaagagacaatcaagttgttccaataaggcgccctggttctgtcagcttgaatcaatcccctagaacactatcttatagccctacagagaatgctgtgttaatttgttcagacatcgatggtggatcgtatgaactccatattgttcccaaggatactagtggaagaggtggagattttatgcaagatgcaaagaaaggagcaggagcttccgctatctttgtagcacgtaatagatttgcggtactcgataaaagcactaatcaagttcttgtgaaaaatttgaagaacgaagtcgtgaaaaaaagcgctttacctattgctactgacgctattttctacgccgggacaggaagtttgctatgccgtgctgaggacagagtggtgatatttgatcttcagcagaggattgttcttggtgaactacaaacgccttctgttaaatacatagtctggtctactgacatggagagtgttgctctgttaagcaagcatgctatagtcattgctaataagaaactctcacacagatgcacgcttcatgagacaattcgtgtgaaaagtggcgcatgggatgaaaatggcgtatttatctatacaaccctaaaccacatcaagtattgccttcccaatggcgataatggaattattaaaactttagatgttcctatatatctcacaaaagtcataggtaacactctcttttgcttggaccgagatggaaagaatagagccataacaattgatgctactgagtatatcttcaagcttgcacttttaaagaagcgatatgatcatgtgatgagtatgataagaaattcacaactatgtgggcaggctgtgattgcttatctacaacaaaaagggttccctgaagttgctcttcatttcgcaaaagatgagcgaactcgattcaatctagccctagaaagcggcaacatccaaattgcagtcgcatctgccaaagaaatcgacgaaaaagaccactggtatcgtctaggcattgaagctttaagacaaggaaatactagcatagtggagtatgcatatcaaagaacgaagaatttcgagagactatcattcttatatctcataaccggcaacagggaaaagctttccaaaatgctaaagatagccgaaatgaaaaacgacgtgatgggtcagtttcataatgccatgtatctaggagatgttgaagaaagggtcaaaatcctagaaaatgcaggtcatttgcctcttgcatatgtcacagctaaaactcatggtctgtctgaaattgccgataagcttggtgctgagctggaaagtaaaggtatagttccgactataccagaaggaaaaacaagttctctactcatgccacctgctcctctgttatgcagtggagattggccattgttaagagttatgagaggtattttcgaaggggggttagattctaatgtaggaagaggtggagatgaagatgaatacgaaggtgctaatgctgattggggtgaagaagacttagatatagtagatgtagcagatgctgtacaagatggtgatgtaaacgctgaagtggatgacattgaaggacatggagaagaagatgatgtggaaggaggatgggatctagaagatttagagcttcctgctgatgtggacgcatcacgtgccagcaatgcacgtgcttcttctgtatttgttgctcctactgcaggaatgcctgtaagccaaatctggattcagaagtcatcgtttgctggagagcatgctgcagcaggtaacttcgacactgctatgcgattgcttagcagacagttaggaatcaggaactttgccccattgaaaccgttgttcaaagaaatgcatcttggtagtcacacttatcttgatgctttcgcttccgctcctcaactttctactgcccttgaaagagggtggagtgagtctgctagccctaatgtaagaggcccgcctgccttggtttttaaattttctcagatggatgaaaaacttaaagcggcttatcgtgccacgacagaagggaagtttccagaggctttacgccttttcttgagcattttgcacaccatccctcttatcgttgtcgattctaggagagaggtagatgaaattaaagaacttatagacatagcaaaggagtacgtattggggttgaaaattgaggttaataggaaggagctgcctagagaagatgtggttaggcagcaagaactagctgcatacttcacgaattgcaagcttcaaaaaggtcatgctaggcttgtgctcactagtgctatgaacatatgttacaaaggagggagctactccaatgctgctaattttgctaggatgctactggaaaataacccacctggaaatcaagctgagagaatcagaagggttttagctgcatgcagtgataaggtcgatactgttcagttgaattacgactttagaaacccctttgtcgtttgtggagccacttttgttcctatctatcgtggccagaaggacgtctcgtgcccatattgtggagcgcacttcgtaccagcttatgagggccagatatgtgctatttgtgagctggcgatggttggagctgatgtttctggattgctatgctcgcctactcagaggagataagttgaagtttctttctttttcgtgtttttattggggttaagactttgagattattcaagctatatatgttttgacgctgaacaataaaaaatagtaaatgttatgttttaagcatttcgttctgtttgagtcgataggtgcttattgcatgcaaaggagggtttggtagcaaccgaggtcttctactttaatggttgaggtttagttatcatttgctttgtttttctgtatttactcagactgatattgtatttatataaagtgtttctatgaatacattgtaccttatgttaatgttgttgaatttgtta

SEQ ID NO: 866 - DNA, 4317 bp, Amborella trichopoda
ggggcagagcacggaacaaatattattagggtttaccttttgctttctccccctaaaaggatctgcaactcctggatcatatctgatgttgaagaagaggaacgattgattcattcatcttctcgattccgctttcttcttatcagatctgagttgcacagaattttgaatcatgctgacgaaattcgaaacaaagagtaatagggttaagggtctgagctttcacagtaagcggccatggattctggctagtcttcacagtggcgtgattcagctatgggattatcgcatgggtaccctcattgataggtttgatgagcacgatgggcctgttcgtggtgtgcatttccacaagactcagcctttgtttgtctcaggaggagatgattacaagatcaaagtttggaactataagatgcacaggtgcctctttactcttcttgggcaccttgattatatccgaacagttcaatttcacaatgagtacccttggattgtgagcgcaagtgatgaccaaactatcagaatatggaactggcagtcacgcacatgcatctctgtgctaactggtcacaatcactatgttatgtgcgcctctttccatcctaaagaggatttggttgtatcggcttccctggatcagacagttcgagtatgggatataggtgccctgaggaagaaaactgtttctccagcagatgacatattaaggctaactcaaatgaacacagagttatttgggggagtggatgccgtcgtgaaatatgtgttggaaggccatgaccggggtgtcaactgggctgcgttccatcccagcctgccacttattgtttctggagcggatgatcgacaagtgaaactgtggcgaatgaatgatacaaaggcctgggaagtggacacattgagagggcacacaaataatgtgtcatgtgtgatgttccatgcacgacaggacatcatagtgtccaactctgaagacaaaagcatacgtgtctgggatgttacaaagcgcacaggggtacagactttccggagggaacatgatcgattctggattcttgctgctcatcccgaaatgaatctcttggcagctggtcatgatagtggcatgatagtctttaagctggagagagaacgcccagcttttgcggttagtggtgattctctatattacattaaagaccgtttcttacgctgctatgagttctcgtcccaaaaagacaaccaggtgatacccataagaaggcctggctccaccagtctgaaccaaagtccacgaactctttcatatagcccgactgaaaatgctctcttggtctgctcagatgtggagggtggatcttatgaactctatattgtgcccaaggatagcatgggcaggggcgacacttcccaagaagcgaaaagaggtgtgggggggtctgctgtctttgttgctcgcaacaggtttgctgtgcttgacaagagtaacaatcaagcgttggttaagaacctcaaaaatgaagttgtaaaaaagagcattctccccattgctgccgatgctatatactatgctggcactggtaatttgctttgtcgtgctgaggatagggtggtcatctttgatcttcagcagcggacaattattggagacctccagactccatttatcaagtatgttgtttggtcaaatgacatggagagtgttgcattactcagtaagcatgcaattgttatagcaaataaaaagctcttgcacaggtgcacactgcatgagaccattcgtgttaagagtggtgcatgggatgacaatggtgttttcatatacacaactctgaatcatatcaagtactgcctccccaatggagacagtggtataatccggacccttgatgttcccatatacatcacaaaggtttcggggaacaccatcaattgcttggatcgagacgggaagaaccgggtgatagccattgatgcaacagagtatgttttcaagctctctttgctgaggaagagatatgatcatgtgatgagtatgatcaggaactcgcagctctgtgggcaggctgtgattgcatatctgcaacagaaaggtttccctgaagttgccctccattttgttagggatgagaaaacccgcttcaatttagccttagagagtggaaacattcagattgctgttgcgtcagccaaggagattgatgagaaagaccattggtataggttgggtgttgaggccctccgacaaggaaatgctagcattgtagaatacgcgtaccaaaggacaaagaactttgagaggctctccttcttatatctcatcactggaaacatggataagttgtcaaagatgttgaggatagcggagataaagaatgatgttatggggcagttccacaatgccctatatcttggtgacattcatgagcgagtcaagatcttggaaaactcgggtcatctcccacttgcctatgttacagctgccattcatgggctaactgaagttaccgagaggcttgcagttgagttgggagacaacgttccctctcttcctgaaggaaagaaagcttctttactcattccacctccacccatctcttgtggtggggattggcccttgttaagagttatgaagggcatcttcgaaggtgggttggataacacaggaagaggaggggatgaagaggaagaagaagctgctgttgctgattggggtgaagatttggatatcgtggaatcaagtggacaaaatggacatgtggacgcagaggttgaaggaggaggagaacaagaggaaaagagtgaggagggaggttgggatctcgaagacttggagcttcctcctgaagtcgagagtgcaaatgcttcaaccaatgtgcgctcaactgttttcgtggccccaacaccaggtatgcctgttagccaaatctggacccaaaaatcttctcttgcaggtgagcatgcggcagctgggaactttgacactgcaatgcgattgctaagccgacaattgggtataaagaactttgctcctcttaagcctttcttcttggatttgcacatgggaagccattcatatctcagggcgtttgcttctgcccctgtggtgcccatagctgttgagaaagggtggagcgagtcagctagccccaatgtgcgggccccaccccaattggtttatcggttctccatgttggatgataagcttaggagtgcatacaaggccaccactgaagggaagttcactgaggctttgaggctcttcctcaatattttgcacattatccctgtggttgtggttgattctagaagggatgctgatgaagtcaaggagctcattgtaatagcaaaggagtatgttttggggcttcggatggaggtgaggagacgtgaggtgagggatgatcttaaaaagcagcaagagttggcagcttactttactcattgcaatcttcaaagaatacatctcaggcttgcacttatgactgccatgggtgcttgcttcaagggagggaactatattacagccgcaaattttgctaggcggattttggaaacagatccaccagccaatcaggcgaccaaggctcgccaacttttgcaggcttgtgagagaaacatgaaagatgctaatgaattgaattatgactttaggaacccttttgtggtttgtggggctacttttgttcctatatatcgtgggcaaaaggatgttgcttgcccttattgtatggctaggtttgtacctgtccttgaaggccagctttgccccatctgtgaccttgcgatggttgggtcagatgcctctggccttctctgctctccatctcaggtgagatgataatttcgactgatgcacatctatttgcacaattctcaagtggcatcacaattctcaagtggaatctcgaggtcttggaggagctcatgataaggctaggagtatatggtatgtatagtttccctacctttctgaatatttttggtctttgaattcaattatgatttccctttttgtcaggttctgcgtaataaacagcttgttattctgaggattttgactgtttaatctggttctactgtgcctttgttgtcattgcggtcataagatgccttgtaaaattgacataaactatgatttttcggaggtggaaaagttgatctgttttttcctgctggagagacataaactatgatttttcggaggtggaaaggttgatctgttttttcctgctggagaaatgctttacaaaaatgtcgctattggggtgaatgataaaggaactcgtgaagggtctcctcatttgttagtaacttcccgtggtttgaagtggc

SEQ ID NO: 867 - DNA, 4749 bp, Eucalyptus grandis
cgatcttcttcgcctgcacgttacactgtgcgaatcgcgttcctccgatccaaatgcccccgtggggttcagatctcttcggattcccctcgccagcctccgcgtgatccctcccctctccgagatcgcgcgccgcccccgatcgattcgattcccgccgcttgcgtcgtcgtcggaccgtgaggggaaatcgcgaggtggctcgccgtcgattcaggtcgcctccgattcgatctggtttgtctgcgcttccgcgtgctctgcggcagtcgagatctcccagtgattttttccggcgaggatgttgacgaagttcgagacgaagagcaaccgagtgaaggggctcagcttccacagcaagcggccgtggatcctcgcgtcgctccacagcggcgtgatccagctatgggactaccgcatgggcacgctgatcgatcggttcgacgagcacgacggccccgtccgcggggtgcattttcacaagtcgcagccgctcttcgtgtccggaggagacgattacaagattaaagtttggaactacaagacatgcaggtgtctctttacccttctaggacaccttgattatatccgtactgtgcagttccatcatgagcatccatggatagtcagtgccagtgatgatcaaactatccgcatatggaactggcagtctcgtacttgcatatctgtcttgacaggtcacaatcattatgtcatgtgtgcttcattccacccaaaagaggaccttgtcgtctcagcttcccttgatcagactgttcgcgtatgggatatcagtgccttaaaaaacaagacagcgtcacctggtgatgacttactccggctgggtcagatgaatacagacttatttggtggtgtggatgttgttgtcaagtatgtcttggaaggccatgaccgaggagtcaactgggcttcatttcatcccaaccttcccttgatagtctctggagcggatgatcgccaagtaaagttatggcgcatgaatgataccaaggcttgggaagtggacacccttagagggcacatgaacaacgtgtcttgtgttatgttccatgcaaaacaagacataattgtatctaactcggaagacaaaagtatccgcatttgggatgcaacaaagcgaactggaattcaaacatttcgacgtgagcatgaccgtttctggatactgtctgctcatcctgaaatgaatcttttggcagccggtcatgacagtggcatgatagtgtttaagttggagagagagcgacccgcctttgctgtgagtggtgatattattttttacaccaaagaacgtttcttgcgctgttatgagttttctagtcaacgggacacacaggttattcctattcgacgccctggatctaccagcctcaaccaaagtccaaagacactctcttatagtcctacagaaaatgctgttcttatttgctctgatgtggatggaggatcttatgaactgtatgtcatcccaaaagacagtgctggtaggggtgatagtggtcaagaggcaaagagaggtactggaggatctgctgttttcgtggcccgaaatagatttgcagtgcttgacaaaagtagcaatcaagtattggtcaagaatctgaagaacgagattgttaagaagagcgggcttccatttcctgcggatgcaatcttttatgcaggaactggcaacttactgtgtagggcagaagacagagtttacatttttgatctccagcagaggttggttattggtgatctgcagaccccttttatcaagtacgtagtgtggtcaaatgacatggaaagtgttgccttgctcagcaaacacgcaattgttattgctagcaagaagcttgtccaccaatgcactctccatgagaccattcgtgtgaagagcggagcctgggatgacaatggagtattcatctacactacactgaaccacattaagtattgcctccctaatggcgatagtggaataattagaacgcttgatgtccctatctacatcacaaaggtttcagggaataccatattttgtttggatcgtgacggaaagaatagagctatagttatcgatgcaacagagtatgtgttcaagttgtcccttctgaggaagagatatgatcatgttatgagcatgataaggaattctcagctttgtggacaggctatgattgcatatctgcagcaaaaggggtttcctgaagtggctcttcattttgttaaggatgagaggacacggttcaatttggctctagaaagtggcaatattcaaattgcagttgcatcagctaaggaaattgatgagagggaccattggtatagactaggagttgaggcccttcgccaagggaatgcgggaattgttgagtatgcttatcagaggacaaagaactttgagaggctctcttttctttatctcataactggaaatatggacaaattgaccaaaatgttgaaaattgctgaagtgaagaatgatgtaatggggcaattccataatgctttgtatttaggtgatgttcgagaacgtattaagatattagagaatgccgggcacttgcctcttgcttatattactgctactactcatgggctgcaggatgtagctgaaagattggcagccgagttgggagattctgttccatctttgccagaggggaagcaaccttcccttctgatgcccccaatgcctgtcatgtgtggtggtgattggcctcttttgagagtcatgaaaggcatatttgaaggtgggttggataatgttggcagaggtactgcacatgaagaagaagaggaggttgaaggtgattggggagatgaattggatatggttgatgtgaatggtttagcgaatggtgatgtgacagctattatggaggatggtgaagttggtgaagaaaatgaggaggagggtggttgggatcttgaagatttggagctccctcccgaggcagaaactccaagggcttctgtcaatgctcactctgcagtttttgtggccccaactcctggcatgccagtaagtcaaatatggacacagagatcatctcttgctgctgaacatgctgctgccggtaattttgacactgcaatgaggttgttgaataggcagcttggaattcggaatttcattcctttgagatcaatgttccttgatctccacactggcagccacacctatctacgtgcattctcctctgctccagtggtatctctggctgtcgagcgtggttggaatgagtctgctagcccaaatgtccggggtccgccagcccttgtctacaatttctctcaaatggaagagaagctcagggctggttatcgtgccaccacagccgggaaatttactgaggctcttcgtcttttcctgagtattctccacacaattccgcttattgtggttgaatcaagaagggaagttgatgaagtcaaagagctgattgtcattgtcaaagaatatgtcttgggtctgcaaatggagcttaagaggagagaaattagggacgatccagtgcgccagcaggaacttgcagcctacttcactcactgcaatcttcaaatgcctcacttgcggctcgccttactgaatgcgatgactgtttgctacaaggcaaagaaccttgctactgcagctaactttgctcggcggcttctagaaaccaatcccactgttgaaaaccaagcaaagatggcaaggcaagttctgcaggctgccgagaggaacatgatagatgcttctgagctaaactatgatttcagaaacccatttgtggtctgtggagcaacatatgtgcctatataccgagggcagaaggatgtctcttgtccatactgcagctctcgttttgtgccaagccaggagggccagctttgtactgtgtgtgatcttgctgtggttggagcagatgcttcaggattactgtgctccccatctcaggtgcggtgatctttcctgctgaaccaaagaattttccgaccttttcatgcgtcagagttgcagctgttggctttgtttacataagcagcagctaagaggtaagaaatattgtcagagctaatagctggttgtgttttctttttttattcatcgtcattggattctcctttacttagctattgagattttcggtgtaataattgaattcagaattttgtaattcatagatgtttatagataccaatgtgtcaagccccttgttagattttgatgacggtactaggctggccaactttcatacactgcagatgcactttgcagatttactaaaattttatgatggattggggtttatattgactgggagcagcatttgaagagttcagtggatctatgtttcttctttttctgcacccagtatcttatttatgccatttttaggttctttgaagtgctgttctgttgttgtcctgtgtagtccattcttcaccaggcaattctcctccgaaggttttgcgagattaacgccacatgacatctcttctaaaccacattgttgctttgattcggcagcatctggctttattgggaataaatgaatgaacaagacaacgcatattgtgttgtgcgtgttgatgttttgtggatttggtatataacatactgtctagtataatgtaccaaatgtttccttttttgttacttataaagtagcaaatgatgctatgaggttttctgcaagtttcataagtgtctctggacctcccacgatatattgaaaggtgaatctgtgttctggc

SEQ ID NO: 868 - DNA, 4757 bp, Populus trichocarpa
ataatcggacggtgaacagtcccttgaacaacatcatcatcatattacaacaaatttccaccattcaaaattacggaaatcccctccatatcttcttctctttaacgcacactaactattcgacgagactcatcagatctaaaattcccttctaataataaagagagagctccaaaacaaagcaagacaaaacagaaaccctctccctcgatctacctccctctccctctccctctccctgtgaaacaaaagaaatctacactctcacttaaattttgcaaattgcagatgcgattccgtttctcttgatcagatctaaagtagtagtttttccggtggtttgaagaagatgttgaccaagtttgagaccaagagtaatagagtgaaggggctgagtttccacagtaagagaccatggatccttgctagtctccacagtggtgtgatccagctatgggactatcgtatgggcactctcatcgatcgctttgatgagcatgatggccctgttcgtggtgttcatttccataaatctcaacctctttttgtctctggaggtgatgattacaagattaaagtctggaactacaaattgcataggtgtctgtttacacttcttggacatcttgattacattcgtaccgtgcagtttcatcatgaatacccatggatcgtgagtgccagtgatgatcagaccatccgcatttggaactggcagtctcgtacttgcatttctgtgttgacaggacacaatcattatgtgatgtgtgcctcattccaccctaaagaagaccttgttgtttctgcatctctggatcagactgttcgtgtttgggatattggtgctttgagaaaaaagacggtgtcccctgctgatgacatcatgaggcttacacagatgaacactgatctttttggtggtgttgatgctgttgttaagtatgttttggagggccatgacagaggagtcaactgggctgcattccacccaacactacctttgattgtctcaggagcagatgatcgccaagtaaagttgtggcgcatgaatgacacaaaggcctgggaagtggacacgttaagaggacacatgaacaatgtgtcatgtgttatgttccatgccaagcaggatataattgtatcaaattcagaggataaaagcattcgtgtctgggatgtaactaaacgaactggtgttcaaactttccgtcgagaacatgaccgattctggatccttgcatctcatcctgagatgaatcttctggctgcaggtcatgacagtggcatgattgtctttaagttagagagagaaaggcctgcttttgctttaagtggtgattctttgttctatactaaagatcgctttttacggttttttgagttttcaactcaaagagatacacaagtaattcccatccgacgacctggcaccacaagcctgaatcaaagtccaagaactctttcatacagtcctacagaaaatgctgttcttatctgctcggatgtggatggaggatcttatgagttatatgtcattcctaaagacagcattgctaggggtgatgctgtgccagaggcaaagagaggtgctggtggatctgctgtctttgtggctcggaataggtttgctgtgcttgataagagcagcaatcaagtcctagttaagaacctcaagaatgaagttgtcaaaaagagtggtcttcctatcagttgtgatgctatattctatgctgggacaggtaacttgctttgcagggcagaggatagggtggtcatatttgatctccagcagaggcttgttctcggggagttgcagacaccttttgtcaagtatgttgtttggtccaatgacatggaaagtgttgccttgctaagcaaacatgccatcatcattgctagcaagaagcttgtccaccaatgcaccctccatgaaacaatccgtgtaaagagtggagcttgggatgataatggtgttttcatttacacaactttaaatcatatcaaatactgcctgcctaatggagatagtggtataattagaacccttgatgtcccaatatatatcactaagatttctggaaatactatcttttgcttagatcgggatgggaagaatagggctattgttattgatgctacggaatacatctttaaactgtctctgctgaagaagagatatgatcatgttatgagcatgataaggaactcacagctttgtggtcaggcaatgattgcttatttgcaacagaaggggttcccagaagtcgctctgcattttgtgaaagatgagagaactaggtttaatttggctttagagagcggaaatattcagattgctgtggcttcagcaaaggaaattgatgagaaagaccactggtataggttgggggttgaagctcttcgccaagggaatgcaggtatagttgaatatgcctaccagaggacaaaaaattttgagaggttatctttcctttatctcataactggtaatttggaaaagctgtccaagatgcttagaattgctgaagttaagaatgatgtcatgggtcagtttcacaatgccttgtacttgggtgatgtcagagaacgagttaagatcttggagaatgctggccatctgccacttgcctatgccgcagctaaggtccatgggctggaggatgttgtggaacgtctagcagctgagttgggagatgatattccatcttttcccaagggtaaagaaccatcccttctgatgcccccagcccctattatgtgtggtggtgattggcctcttctgagagtcatgaaaggtatatttgaaggtgggctggataatatggtcagaggtggtgctgatgaggatgaagaagaagctgctgatggtgattggggcgaggaactggacatggtcgacgcagttggtttgcaaaatggggatgtcacagcaattttggaggatggggaagcagctgaagaaaatgaagaggaggagggaggatgggaccttgaagatctggagctacctcccgaggcagacacaccaagggcttctgtgagtgcccgctcatcagtttttgttgctccaactcctggtatgcctgtaagccagatttggattcagagatcttcacttgctgctgaacacgccgcggctggcaatttcgacactgccatgcgactactcaacaggcaacttggaattaaaaactttgtgcctttaaaacccatgtttcttgatcttcactcaggcagccatacctatttacgtgcattttcatctaccccagtgatttcactggctgttgaacggggatggaacaagtctgctagccccaatgttagggcccctccagctctggttttcaacttctctcaattggaagagaagcttaaggctggttacaaagccacgacagctgggaaatttaccgaggcacttaaactctttcttagcattcttcacacaattcctctgatagttgttgactcgaggagggaagttgatgaagtcaaggaattgattattatagtcaaagagtatgttttgggtctgcaaatggagctcaagaggagggagatgaaagacaatccagtacgccaacaagagcttgctgcctacttcacacactgcaacctgcaagctcctcacttgaggcttgcgcttcaaaatgcaatgactgtctgcttcaagaataagaaccttgctacggcagctaactttgccagacggctattggagacaaaccccccgaacgagaaccaggcaaggtctgccaggcaagtattggcagcttcagagaggaatatgacagatgctgctcagctgaactatgattttagaaatccttttgtggtatgtggtgcaacatatgttccaatttatcgaggacaaaaggatgtctcttgctcgtattgtggttcccgatttgtaccaagccatgaagggcagctgtgtactgtttgtgatcttgcagtagttggggcagatgcttcagggttgctctgttctccttcccagatacgatgatcaagaagctgaaaatggagcattttttcaatcatttttcacctcatcctactggcagcgggaaacataatctccctttgtttcatgttgcaggtaaaaaggtaagagatactgtagaagagtttaagcttcgaatgatttgcttgtgctgtctacttttttctgcctatctctttgttttctttgtttagttgattatgcttttaaatgtaataaacaacttgaaaattttgacttgggctattcttgttagttgttcatagacaagaatagtcaagggccctttgttaaattagtataggcaggacaaatttcatgtcagctgccatttggcaaatttgcttatttctattgttgaatttggttttggcagtaccatatggtggtctaaaattattccctgtgaaatctctgcttcattctgtagttgctgcagaaattttgccataactttacatggtggctgagttgtttgtagaaatgaatttctttcttggattggaaggtaaagaggtaatgatgaccagtcaccatggtagctttgttggaatcttggttttgaacaaaccatctctgacacatgataaatgtagtccaacgtatttgtgctggctacggaattaattctttttcatgatctgggtgagaatcctaatttgggcttcttctaacttgaatctagtctggtcggagcaacttctgatttgatagacgtggtggcttactgtgtttgatgcgaaaaaga

SEQ ID NO: 869 - DNA, 5018 bp, Populus trichocarpa
cctccatatattcttctctctaaaattaactcacacacgcactaaactcctcgacgagacccagatctaaagttccataataataaagagagagccccgctcccaaaaaaaaataaataaaaggaaaggaaaaggaaaaaatttctctcccccatctagctctcttgctttctctgtttttttttaaacacaaacaaatttacagtctcactcaaattccaatactattttgtaaattgcagatgcgtttccgtttattttgatcagatctaaagttgtagtgtttttgttggattgaagatgttgaccaagtttgagaccaagagtaatagagtgaaggggctgagtttccacagtaagagaccatggatccttgctagccttcacagtggtgtgatccagctatgggactatcgtatgggcactctcattgatcgctttgatgagcatgatggccctgttcgtggtgttcatttccacaaatctcagcctctttttgtatctggaggtgatgattacaagattaaagtctggaactacaaattgcataggtgtctgtttacgctccttggacatcttgattacattcgcactgtgcagtttcatcatgaatacccgtggattgtgagtgctagtgatgatcagaccatccgcatttggaactggcagtctcgtacttgcatttctgtgttgacaggacacaatcattatgtgatgtgtgcctcattccaccctaaagaagaccttgttgtgtcggcttctctagatcagactgttcgtgtttgggatattggtgctctgagaaaaaagacggtgtcccctgctgatgacataatgaggttgactcagatgaacagtgacctttttggtggtgttgatgcagttgttaagtatgttttggaaggccatgaccgaggtgtcaactgggctgcattccaccctacacttcctttgattgtttcaggagcagatgatcgccaagtgaagttgtggcgcatgaatgacacaaaggcctgggaagtggacacattaagaggacacatgaacaatgtgtcatgtgttatgttccatgccaaacaagatataattgtatctaattcagaggataaaagcattcgtgtctgggatgtaactaaacgaactggagtccaaactttccgccgagagcatgaccgattctggatccttgcatcccatcctgagatgaatcttctggctgcaggtcacgacagtggcatgattgtctttaagttagagagagaaaggcctgcttttgctgtgagtggtgattctttgttctatgccaaagatcgctttttacgattttttgagttttcaactcaaagagatacacaagtaattcccattcgacgacctggtactacaagcctgaatcaaagtccaagaactctttcgtacagtcctacagaaaatgctgtccttatctgttcggatgtggatggaggatcttacgagctgtacgtcatccctagagacagcattgctaggggtgatgctgtgccagaggcaaagagaggtgttggtggatctgctgtctttgtagctcggaataggtttgctgtgcttgacaagagcagcaatcaagtcttagttaagaacctcaagaatgaagttgtcaaaaagagcagtcttcccatctctgcagatgctatattctatgctggcacaggtaacttgctttgcaggacagaggatagggtggtcatatttgatctccagcagaggcttgttcttggggagctgcagacaccttttatcaagtatgttatttggtccaatgacatggaaagtgttgccttgctaagcaaacatgccattatcattgctagcaagaagcttgtgcaccagtgcactctccatgaaacaattcgtgtaaagagtggagcctgggatgataatggtgttttcatttacacgactttgaatcatatcaaatactgcctgcccaatggagatagtggcattatcagaaccctcaatgtccccatatatattactaagatttctggaaatactatcttttgcttggatcgggatgggaagaataaggctattgttattgatgcaacagaatacatcttcaaactatctctgctgaagaagaaatatgaaaatgttatgagcatgataaggaactcccagctttgtggtcaggcaatgattgcttatttgcaacagaaggggttcccagaagtcgctctgcattttgtgaaagatgagagaactaggtttaatttggctttagagagtggaaatattcagattgctgttgcttcagcaaaggaaattgatgagaaagaccactggtataggttgggggttgaagctcttcgccaagggaatgcaggtatagttgaatatgcctaccagaggacaaaaaattttgagaggttatctttcctttatctcgtaactgggaatttggaaaagctctctaagatgcttagaattgctgaagttaaaaatgatgtcatgggtcagtttcacaatgccttgtatttgggtgatgtcagagaacgtgttaagatcctggagaatgctggccatttgccacttgcttatgccacagctaaggtccatggcctagaggatgttgtggaacgtctagcagctgagttgggagatgatattccgtctttgccagagggcaaaacaccatcccttctgatgcctccagcccctattatgtgcggtggtgattggccacttctgagagttatgaaaggtatatttgaaggtgggctggataatatgggcagaggtggtgctgatgaggacgaagaagctgctgatggtgactggggtgaggaactggacatggttgatgtggatggtttgcaaaatggggatgtctcagcaattttggaggatggggaagcagctgaagaaaatgaagaggagggaggatgggaccttgaagatctggagctacctcccgaggcagacacaccaagggcttctgtcagtgcccgctcatcagtttttgtggctccaactcctggtatgcccgtaagtcagatttggattcagagatcttcactcgctgctgaacatgctgcagctggcaattttgatacggctatgcgactactcaacagacaacttggaattaaaaactttgtcccattaaagtccatgtttcttgatctttactcaggcagccatacctatcttcgtgcattttcatctaccccagtgatatcactggctgttgaacggggatggaatgagtctgccagccctaatgttaggggtcctccagctctggtgttcaatttctctcagttggaagagaagcttaaggctggttacaaggccacgacaactgggaaatttactgaggcacttagactcttccttggcattcttcacacaattcctctgattgttgttgattcgaggagggaagttgatgaagtcaaggagttgattattatagtcaaagagtatgttttgggtctgcaaatggagcttaagaggagggagatgaaagacaatccagtgcgccaacaagagcttgctgcgtacttcacccactgcaaccttcaagctcctcacttaaggcttgctcttcaaaatgcaatgactgtttgcttcaagaataagaaccttgctacagcagctaactttgccaggcggctactggagacaaaccccccgaatgagaaccaggcaagggctgccaggcaagtattggcagctgcagagaggagcatgacagatgccgctcagctgaactatgatttcagaaatccatttgtggtatgtggtgcaacctatgttccaatttaccgaggacaaaaggacgtctcttgtccatattgtggttcccgatttgtaccaagccaggaagggcagctgtgtactgtgtgtgatcttgcagtagttggggcagatgcttcagggttgctctgttccccttcccagatacgatgatcaagaagttgaacatggagcatttttttcaatcatttttcacctcatcctactggcagcaggaaacattctctctctttgtttcatgttccaggtaaaaaggtaagggatactgtagaagagtttaagcttccaatgatttgcttgtgctgtctacttttttttctgcttgttttcctttgtttagttgattatgatttcaatataataaacaacttgagaattttgacttgggctattcttgttatttgttcatagacaagaatagtcaagggccctttgttaaattagatgatatatcctcttataggcaggacaaattacatgtcagtgtatgcagatttcatttggcaaatttgcttatttctattttgttgaatttggttttggcggtacgacgtgctggtcgaaatgtgtatctatctatccggcaacatgttatcttcgatcatatttgctgtatcttccttaacctactttctgcggattttttgccaaaactttgcatggtgctgtgttgtttgtgtaaatagtttcatcagtggattggaaggagggaggagatgattgaccaatcaccatggaggcatagttggaaccttgtttttaaacaaaccatctcacaatatagttctactttttggtgaggcgcttttgaaaagcctgctaggactaagagaacgaggatttcatcagtgtatattttccgctagttgtggaataatatcgtactgtggtgtgagcagcttctgcttcggtagtttgctgtgatcaatacaaaaaggtgcgcgctcattgaggaggtaattagccattctgctcaaggttagcatgtgaacaatattattttgatctggattagtaaatagcaagacgaaaaataaaaggactgggaacctcacctcctttcgcttgattgacacctgtgtagccctaaaatgaaaggacactaccctaaaatgcacaagtttaggtcttgattgacacctgtttagccctcccttcgattcttctcttgtcaatgttatgtctaaataactaggagcaaaaacgatattatt

SEQ ID NO: 870 - DNA, 3988 bp, Prunus persica
ttcaattgtgttttgagatgctgacgaaattcgagaccaagagtaatcgagtgaaggggctgagctttcacagcaagaggccatggatcttggccagtctccacagcggtgtgatccagctctgggattaccggatgggcactctcatcgaccgttttgacgagcacgatggccctgtacgtggtgtccatttccacacctctcagccgcttttcgtctctggaggggatgattacaagatcaaggtgtggaattacaagctgcataggtgtttgtttacacttcttggacaccttgattacatacgcaccgttcaattccatcatgagtacccatggattgtcagtgctagcgatgatcagacaatcagaatatggaattggcagtcccgaacttgtatttctgtgctcactggacacaaccattacgtcatgtgtgccttattccatccaaaggaggatcttgttgtctcagcatccttggatcaaactgttcgtgtttgggatattggtgccctcaggaaaaagacggttgcccctgcagatgacatcctgcgcctgagtcagatgaatgcagatttctttggtggagttgatgctgttgtgaagtatgtcttggaaggtcatgatcggggtgttaattgggcatcattccatcccacactccctctgatcgtctctggagcagacgatcgacaagtgaaactctggcgaatgaatgatacaaaggcttgggaggtggacaccttaagggggcacatgaacaatgtatcatgtgttttattccatgcaaggcaggatattattgtgtccaattcagaggatagaagcatccgagtctgggatgccacaaaacggactggtcttcagacatttcgtagagagcatgataggttctggattcttgcagcacatcctgaaatgaaccttttggctgctggtcatgatagtggcatgatcgtctttaaattggagagagaacgtcctgccttttctgttagtggtgattcaatgttctatgttaaagatcgttttctccgcttctttgagttctctacccagagagacactcaggttatccctattcgaaggcctggttcttccaccttgaatcaaggggctaaaacactatcttatagccctacagaaaatgctgttttgatatgttcagaaacggaagggggttcttatgagctatacattatacccaaagatagctttggccggggtgatattgtgcaggaggcaaaaagaggaattggagggccagccgtgttcgtggctaggaataggtttgcagtgcttgaaaagagcagcaatcaagttatagttaagaaccttaaaaatgagattgtcaagaagagtgccctacctattattgctgatgcaatattttatgctggaactggaaacttgctttgcagggcagaggacagagttattatttttgacctgcagcagagaattattcttggggagcttcaaactcctttcgtaaggtatgttgtttggtcaaacgatatggaaagcattgctttgctgagcaaacattctattgtgatagccaacaagaagcttgtgcatcagtgcactctccatgagacaattcgtgtaaagagtggagcttgggatgacaatggcgttttcatatacacaaccttgaaccacatcaaatactgccttcccaatggggacaacggaatcatcaggaccctagatgttccagtatatataacaaaagtgtatggaagcaccatccattgcttggatcgagatgggaagaactgtgccattgttgttgatgcaacagaatatgttttcaagctatccttactgaagaagaggtatgaccaggttatgagcatgattaagagctctgagctctgtggccaggccatgattgcatatctacagcagaaaggtttccctgaggttgcccttcattttgtgaaggatgaaaggactcgcttcaacttggcactagggagtggaaacatccagattgctgttgcttctgccaaggaaattgatgagaaagatcactggtatcgtttgggagtggaggcccttcgccagggtaatgcaggcattgtagaatatgcgtatcagaagacaaagaattttgagaggctatcattcctctatcttgtgactggaaacttggataaattgtccaaaatgctgaaaattgctgaagtcaagaatgatgtgatgggtcaattccacaatgctctatatttgggtgacatcagagagcgtgttaagatattggagaatgctggtcatttaccccttgcttatagcacagctgtaattcatggcctccatgatattgcagaacgtttggcagctgaactgggagataatgttccgattttacccaaggggaaatctccatctcttttgatgcctccaaccccaatcatctgtggtggagattggcccttgttgagggttatgagaggaatatttgagggtggtcttgataatgtgggccggaatgcagaggaagagtatgaagaggctacagatgctgattggggagaggatttggatattgttgacgtggaaaacattccaaatggagacatcagtgcagtgctggaggatgaggaagaacatgaggaaaatgaggagggaggatgggatcttgaagatcttgaacttccacctgagattgatactcccaaaactgcaagtaatgcccgttcttctgtgtttgttgccccaactcctggtatgcctgtaagtcaaatttggacccagaagtcatctcttgctgctgaacatgcagcggctgggaatttcgatattgcaatgcgtttgttgaaccggcagctgggtataaagaactttgctcccctaagacaattgtttcttgacttacacatgggcagtcatacgtatctacgtgccttctcatcagctcctgtgatctctgtggctgttgagaggggatggagtgagtcagctactcctaatgttaggggtcctcctgctcttgtgtttaaattctcagagctggaagagaagcttaaggcgggttacaaggccacaactacggggaaatttacagaggctttacgacttctccttggtattctgcatactattcctttgattgtagttgattcaaggagagaggttgatgaagtaaaagaattaattatcattgtgaaggagtatgttctgggtttgaagatggagcttaagaggagggaacttaaggacaatcccgttcgccaacaggagctagcagcttacttcacccactgtaaccttcagatgcctcacttgagacttgcattactgaatgccatgagtgtttgctttaaggctggtaatctcaacacagcagccaactttgccaggcgacttttggagaccaatcccaccactgaaaaccatgcaaagactgcaagacaagtcctccaggctgccgagaagaacatgaatgatgcaacccagctaaattatgatttcagaaatccatttgtggtttgtggtgcaacatatgtgcctatttaccgtgggcagaaggatgtttcatgcccgtactgcagttctcggtttgttctggcccaggaagggcagctctgtactgtttgtgatcttgcagtggttggagcggatgcatctgggttgctttgttctcctacccagataagatgatctcctgctgctcgagtaggagcaatttttcaaccttcagctacactacaacaacggttatgttagtttcctcatctccttgagcagggtttccattttaaacaaagggatttgattaggttgtgcttctcttgtatttctatttcaaattttattgcaaggttcatgataatggttttcactgtaatgaacaggttaaggattttgatctaggtgattcttgtgtcttttgagaataaacaaattagattgagctggcaaattaattgcttttcccgaaatgtgtaactttgaaatttcatatattgtagacagca

SEQ ID NO: 871 - DNA, 4796 bp, Ricinus communis
ttttgcactactcgtcgaacgcacagatctaaaaagaaagaacccaaaaacctctttcttccctcacttcctccgatctacctccgtttctttcttttctcttatatatacagttctcgctttacacatacaaatccttcacaatacgcaccgttttatcaatcgtagatgcgattcagttcctcatcttgatttgatcagatctaaggttttgattttgattgaatttagagaaagacaagatgttgacgaaatttgaaacgaagagcaatagagtgaaaggactgagtttccacagtaagagaccgtggatcctagcgagtcttcacagtggtgtgattcaactatgggattaccgaatggggactttgattgatagatttgatgaacatgatggacctgttcgcggtgtccattttcataaatctcagcctttatttgtctctggaggtgatgattacaagattaaagtttggaactacaagatgcataggtgtctgtttacacttcttggacatcttgattacatccgtactgtgcagtttcatcatgagtacccatggattgtgagtgccagtgacgatcagacaatccgtatttggaactggcaatcccgtacttgcatttctgtgttgacgggccacaatcattatgtcatgtgtgcctcattccatcctaaagaagacctcgttgtttctgcctccctagatcagacagttcgtgtttgggatattggtgccctgagaaagaaaacagtctcgcctgctgatgatattctgcggttgagtcagatgaatacagatctttttggtggggttgatgctgttgttaagtatgtcttggaaggccatgatcgaggagtcaactgggctgcattccaccccaaccttcccttgattgtctcaggagcagatgatcgccaagtgaaactgtggcgtatgaatgacacaaaggcttgggaagtggacacattgagagggcacatgaataatgtgtcgtgtgttatgttccatgccaaacaggatatcattgtctcaaattcagaggataaaagcattcgtgtttgggatgtcactaaaagaactggagttcagacattccgtcgagaacatgaccgattctggatccttgcatctcaccctgagatgaatctccttgctgctggtcacgatagtggcatgattgtctttaaattagagagagaaaggcctgcttttgcagtgagcggtgactctttgttctatgctaaagatcgctttctgcggttctatgagttttcaactcaaagagatactcaggtgattcccatccggcgacctggtaccaccagcctgaatcaaagtccaaggacgctgtcttacagtcctactgagaatgctgttcttatttgctcagatgtggatggtggaacttatgagttgtatgtcattcccaaagatagcatcagtaggggtgatactgtgcaggaggcaaagagaggtgctgggggatcagccatctttgtggcccgaaatagatttgctgtgcttgacaaaagcagcaaccaggtcctagtcaaaaacctgaagaacgaggttgttaaaaagagcagtctccccattgctgcagatgcaatattctatgctgggactggtaacttgctttgcagggcagaggatcgagtagtcatatttgatctccagcaaaggattgttcttggggaccttcaaacgccatttgtcaagtatgttgtttggtctaatgacatggaaagtgttgcattgctcagcaaacatgcgatcatcattgctagcaagaagcttgtgcatcagtgcactctccatgagactatccgtgtaaagagcggagcctgggatgacaatggtgtttttatttatacaacattgaaccacataaaatactgtctgcccaatggggacagcggcataatcagaactcttgatgtcccaatatatgtaactaaggtttctggaaataccatattttgcttggatcgggatgggaagagcagacatattgacattgatgcaacagaatacatgttcaaactttctcttttgaggaagaagtatgaccatgttatgagcatgattaggaactctcagctctgtgggcaggcaatgatcgcttatttgcaacagaagggttttcctgaagttgctttgcattttgtgaaggatgagaggactcgatttaatttggccttagagagtggaaatattcagattgctgttgcttcagcaaaggaaattgatgagaaagatcactggtatagattgggagtggaagctcttcgccaaggtaattcaggtattgttgaatatgcctaccagagaaccaaaaactttgagaggttgtctttcctctatctcattactgggaacctggaaaagctttctaaaatgctgaaaattgctgaagttaagaatgatgtcatgggccagtttcataatgcactttatttgggtgatatccaagaacgtgtcaagatcttggagaattctggccatttgccacttgcttatataactgcgaaagtccatgggctagaggatgttgctgaacgtctagctgctgagttaggagataatgttccatctttgccggagggtaaagtgccttcacttctgatacctccagctcccatcatgtctggcagtgattggccccttctaagagtcatgagaggcatatttcaaggtgggctggatgatacgggtaaaggtgctgttgatgaggatgaagaggctgctgaaggtgattggggtggagatctggatattgacgatgtggatggcttgcaaaatggagatgtttcaggaattttggaggatggggaagtggctgatgaaaatggggagggaggatgggaccttgaagacttggagctcccccctgaggcagacacaccgagggcttctgtaagtgcccgctcgtctgtttttgtggctccaactcctggtatgcctgtaagccagatttggatccagagatcatcacttgctgctgaacatgctgcagctggcaattttgatactgctatgcggttgctcaacaggcaacttggaattcgaaactttgctccattgagatccatgtttcttgatcttcacacaggtagccatacctatttgcgtgcattttcatctactccagtgatatctctggctgttgaacgtggatggagtgaatctgctagccctaatgtaaggggccctccagcactggtgttcaatttctctcagttggaagagaagctcaaggctggatacagagccacaacagctggaaaatttactgaggcacttcgactctttctcagcattcttcatacagtccctctaattgttgttgagtccaggagggaggtcgatgaagttaaagagttgattatcatagtcaaagaatatgtcctggcttcgaagatggagctcaaaaggagggaaatgaaagacaatccaatacgtcaacaggagctagctgcctatttcactcactgcaaccttcaaatgcctcatttaaggcttgctctgcaaaatgcaatgactgtttgcttcaaggcaaagaacctagctactgcagctaattttgccaggcgtctattagagacgaaccccacaattgagaaccaggcaaagatggccaggcaagtgctgcaggctgcagaaaggaatatgacagatgcctccgagctaaattatgacttcagaaacccatttgtgacatgtggtgcaacatatgttccaatttacagaggacaaaaagatatctcttgcccattttgtagttcacgatttgtgccaagccaggaaggacagttgtgttctgtttgtgatcttgctgttgttggggcagatgcttcagggttactctgttctcctacccagatacgatgagcgagtttttgtcaattatttttcagctcgtcttatctgatagcagaagtggcggtcttcattgttttctatctgcagggaaaaaaggtaagagatacctatagaagagttaagtccccagtgaatttgtttgtgttatctttttcttctattctgctttattctggaaatctctttcaccccttgtttacttagttgattatgattttcaatgtaataaacaacttgagaattttggcttggcctattcttgttagctgttcatagacaagaatagacgagggggctcttttgttaaattagataaatctttataggcaggacaagtttacatctcagttgtatggcaaaatttgcttatttgtgatgatttcgggtttctattggttggctgcaagtgatttttctagcttactattatattcatcaacctattcacggcatcatcttttggttcagatgttagaggtggtgatcattcaccttttaacgcattttcttactggtaaaattaagggatccgcttccagccatggttttgtcatatttgattgataggaatttaaactcgaaaagtgaaggagttttatgggatttagattccaaatttgtgatttgcgcagatggaaaacatgattttgaattgaacaagttcgaacggcttctctctggtatcctgtatcctaagctcgtgaattataaaaaaggacttctcagtgtcctgtttgcactgcatggcttctgggcatggtcaatttgcccccgtgaatttgctcacattctcgacaaccagacgtaaggggtttctaaattgaaaaggaaaagagaagaaaaacaaaaagaaagaagaaattcttagtttccttggagaaatagaactcaaaatttaagaaacaccgg

SEQ ID NO: 872 - DNA, 4024 bp, Chelidonium majus
aacgcatactctctcctcaagaccaaaatccagatctgccggaataagtacctcgatttcactctctttctcagatctcccgatctagcctttcttcacccattaacctacacccttctctctgcttatcctacgccccctctccccctttccctcaccgacttctctcatctcttcattctttgctgcttatggtgttgcgattgcagaggcgatgttagattccgcttgatctactattatccttctcagatctgagtttgtattagatagggtttgagatttgattggggacgatgttgacgaaatttgagacaaagagtaatcgggtgaaaggactgagtttccatagcaagagaccatggatccttgccagtcttcacagtggtgtgatccagctatgggattacaggatgggaactcttattgacagatttgatgagcacgatggacctgttaggggagttcatttccacaaatctcagccattatttgtctccggaggagatgattacaagatcaaagtatggaattacaagatgcatcggtgtttgttcactctacttggacacctcgattatattcgtactgttcaatttcacaatgagtacccatggattgttagtgcaagtgatgaccaaaccatcagaatatggaactggcagtctcgtacatgtgtttctgtgttgactgggcataaccactatgtcatgtgtgctaccttccatcctaaagaggatcttgttgtttcggcatctttggatcagacagttcgtgtttgggacattggtgctttgagaaagaagacagtatccccagctgatgacatcttgcggttgagtcagatgaacacagatttatttggtggtgttgatgccattgtcaagtatgtcttggaaggtcatgaccggggagtcaattgggcttcgtttcatcccagcctgcctctaatcgtttctggagcagatgatcgtcaagtcaaactgtggcgaatgaatgatacaaaggcttgggaagtagatacattgagaggacacatgaataatgtctcatgtgttatgttccatgctaggcaggacattattgtatctaattcagaagacaaaagtattcgtgtgtgggatgttacaaagcgaactggggttcagacgttccgcagggagcatgatcggttctggatacttgcattacatccagagatgaaccttcttgctgctggtcatgatagcggtatgattgtttttaagttggaaagagaacgccctgctttctcagtgagtggagattctttattttatgttaaagatcgttttctccgtttctacgagttctctactcagaaagacactcaagtaattccaattagaaggcctggttcgactactttgaatcaagggccaaggactatgtcttatagccccacagaaaatgctgtcttgatctgttcggatgtggatggagggtcatatgaactttatgtagtgccaaaagacagcttgggcagaggtgatactgtgcaagaggcaaaaagagggcttggaggatcggcaatatttgtggctcgaaataggtttgcagttcttgataagagcaacaaccaagtgttagttaaaaaccttaaaaacgaaattgtgaaaaagagtggccttccagtcgctactgatgcaatattctatgctggaactggcaatttgttgtgcagatcagaggatagagtggtgatctttgacctccagcagaggcttgttcttggtgatcttcagacaccttttgttaaatatgttatttggtcaaatgacatggagagtgttgcattgttgagcaaacatgctatcatcattgccagtaaaaaactagtgcaccggtgcaccctccatgagacgatacgtgtaaagagtggagcctgggatgacaatggtgttttcatatatacaacattgaaccacatcaagtactgccttccaaatggagacaatggaatcatcaggactctcgatgtcccgatatacatgacaaaggttagtggaaatgtcatcttttgcttggatcgggatggaaaaaaccgtgccatagctattgatccgactgagtatgttttcaagctctcccttctcaagaagaaattcgatcaggttatgaacatgatcaggagctcacagctctgtggacaggccatgattgcctatttgcagcagaaaggtttccctgaagttgctctccatttcgtgaaagatgaaaggactcgcttcaacttggcactagaaagtggtaatatccagatagctgttgcttcagcgaaggagattgatgagaaagatcactggtataggttgggagtagaggctcttcgtcaggggaatgctggcattgtagaatatgcgtatcagaggaccaaaaactttgagaggttatccttcctgtatctcattacaggtaatgttgataagttgtcgaaaatgctgaagattgccgaagtcaagaatgatgtgatgggtcagtttcataatgccctttacctgggggatatccgcgagcgtgtcaagatcttggagaacgctggccatttgcccctagcttacataacagcttctgttcacgggcttcaggatgttgctgagcggttggcagaagagttgggagataatgtaccctctttgcccgaggggaaagcgccttcacttctaatgcctccaaaccccatcatgtgtggtggagattggcccttgttgagggtcatgaaaggcatctttgagggtggtcttgataatttgggcaggggagcagaagaagaagaggaagatgctgccgatggtgattggggtgaggacttggatattgttgatggggatcatcatatgcagaatggagatgttgaagtagtggatgaagatggggaagcgaatgaaggaaatgatgaggagggaggatgggaccttgaggacctagagctcccaccagaaattgatactccaaagcatgcagtcaacgcccgctcttctgtatttgtgtgtccaactccaggcatgcctgtaagccagatctgggtccagaaatcatctcttgctggtgaacatgcagcagctggcaattttgatactgcaatgcgtttgttgagccgacaactgggaataaagaactttggtcctttgaagcccatgtttcttgatctacacagtggaagccacacatatctacgagccttttcttcagctccagtaatctcattggcagtcgagagagggtggactgagtctgctagccctaatgttagagggccaccagctctggtgttcaggctttccgagttggatgataggcttaaggctggttacaaggccactacaagtggcaagttctctgaggctctccggctctttctcagtatcctacactgtattccaatgattgtggttgagtcgaggagggaggttgatgaggttaaggagttgatcattataaccaaggaatatgtattggggttgcagatggaactcaagaggagggaactgaaagacaatcccgtacgccagcaggagctggctgcctacttcactcactgcaacctacaaatgcctcacctaaggcttgctttgttgaatgccatgagtgtttgctacaaggcaaagaacttcaacactgcagctaactttgccagacgactcattgaaaccaaccccaccattgagaatcacatgaagacagcacgacaagtgttaacggcttctgagaggaacatgagggatgagagtccgttgaactacgactttagaaacccgtttgtagtttgtggagcgacctatgtgccaatttatcgcggtcagaaagatgttgcatgcccatactgttgttcacggtttgtgccagcccaggaggggcagctctgtactgtttgcgatcttgcagttgttggagcggatgcttctggactgctttgttctccttcccagataagatagattccttgaatcatcatggctttttcaaacattccctggttgatgcaactcaacatcagttatattgg

SEQ ID NO: 873 - DNA, 4455 bp, Ricinus communis
ttcgctttaacaacataaaagtaagtaccttcatgcacttcccaatctaccctcatacatttccaaaatttccttccatatacaatttctgatttctttctcaaattaacacacattgtttttgcactactcgtcgaacgcacagatctaaaaagaaagaacccaaaaacctctttcttccctcacttcctccgatctacctccgtttctttcttttctcttatatatacagttctcgctttacacatacaaatccttcacaatacgcaccgttttatcaatcgtagatgcgattcagttcctcatcttgatttgatcagatctaaggttttgattttgattgaatttagagaaagacaagatgttgacgaaatttgaaacgaagagcaatagagtgaaaggactgagtttccacagtaagagaccgtggatcctagcgagtcttcacagtggtgtgattcaactatgggattaccgaatggggactttgattgatagatttgatgaacatgatggacctgttcgcggtgtccattttcataaatctcagcctttatttgtctctggaggtgatgattacaagattaaagtttggaactacaagatgcataggtgtctgtttacacttcttggacatcttgattacatccgtactgtgcagtttcatcatgagtacccatggattgtgagtgccagtgacgatcagacaatccgtatttggaactggcaatcccgtacttgcatttctgtgttgacgggccacaatcattatgtcatgtgtgcctcattccatcctaaagaagacctcgttgtttctgcctccctagatcagacagttcgtgtttgggatattggtgccctgagaaagaaaacagtctcgcctgctgatgatattctgcggttgagtcagatgaatacagatctttttggtggggttgatgctgttgttaagtatgtcttggaaggccatgatcgaggagtcaactgggctgcattccaccccaaccttcccttgattgtctcaggagcagatgatcgccaagtgaaactgtggcgtatgaatgacacaaaggcttgggaagtggacacattgagagggcacatgaataatgtgtcgtgtgttatgttccatgccaaacaggatatcattgtctcaaattcagaggataaaagcattcgtgtttgggatgtcactaaaagaactggagttcagacattccgtcgagaacatgaccgattctggatccttgcatctcaccctgagatgaatctccttgctgctggtcacgatagtggcatgattgtctttaaattagagagagaaaggcctgcttttgcagtgagcggtgactctttgttctatgctaaagatcgctttctgcggttctatgagttttcaactcaaagagatactcaggtgattcccatccggcgacctggtaccaccagcctgaatcaaagtccaaggacgctgtcttacagtcctactgagaatgctgttcttatttgctcagatgtggatggtggaacttatgagttgtatgtcattcccaaagatagcatcagtaggggtgatactgtgcaggaggcaaagagaggtgctgggggatcagccatctttgtggcccgaaatagatttgctgtgcttgacaaaagcagcaaccaggtcctagtcaaaaacctgaagaacgaggttgttaaaaagagcagtctccccattgctgcagatgcaatattctatgctgggactggtaacttgctttgcagggcagaggatcgagtagtcatatttgatctccagcaaaggattgttcttggggaccttcaaacgccatttgtcaagtatgttgtttggtctaatgacatggaaagtgttgcattgctcagcaaacatgcgatcatcattgctagcaagaagcttgtgcatcagtgcactctccatgagactatccgtgtaaagagcggagcctgggatgacaatggtgtttttatttatacaacattgaaccacataaaatactgtctgcccaatggggacagcggcataatcagaactcttgatgtcccaatatatgtaactaaggtttctggaaataccatattttgcttggatcgggatgggaagagcagacatattgacattgatgcaacagaatacatgttcaaactttctcttttgaggaagaagtatgaccatgttatgagcatgattaggaactctcagctctgtgggcaggcaatgatcgcttatttgcaacagaagggttttcctgaagttgctttgcattttgtgaaggatgagaggactcgatttaatttggccttagagagtggaaatattcagattgctgttgcttcagcaaaggaaattgatgagaaagatcactggtatagattgggagtggaagctcttcgccaaggtaattcaggtattgttgaatatgcctaccagagaaccaaaaactttgagaggttgtctttcctctatctcattactgggaacctggaaaagctttctaaaatgctgaaaattgctgaagttaagaatgatgtcatgggccagtttcataatgcactttatttgggtgatatccaagaacgtgtcaagatcttggagaattctggccatttgccacttgcttatataactgcgaaagtccatgggctagaggatgttgctgaacgtctagctgctgagttaggagataatgttccatctttgccggagggtaaagtgccttcacttctgatacctccagctcccatcatgtctggcagtgattggccccttctaagagtcatgagaggcatatttcaaggtgggctggatgatacgggtaaaggtgctgttgatgaggatgaagaggctgctgaaggtgattggggtggagatctggatattgacgatgtggatggcttgcaaaatggagatgtttcaggaattttggaggatggggaagtggctgatgaaaatggggagggaggatgggaccttgaagacttggagctcccccctgaggcagacacaccgagggcttctgtaagtgcccgctcgtctgtttttgtggctccaactcctggtatgcctgtaagccagatttggatccagagatcatcacttgctgctgaacatgctgcagctggcaattttgatactgctatgcggttgctcaacaggcaacttggaattcgaaactttgctccattgagatccatgtttcttgatcttcacacaggtagccatacctatttgcgtgcattttcatctactccagtgatatctctggctgttgaacgtggatggagtgaatctgctagccctaatgtaaggggccctccagcactggtgttcaatttctctcagttggaagagaagctcaaggctggatacagagccacaacagctggaaaatttactgaggcacttcgactctttctcagcattcttcatacagtccctctaattgttgttgagtccaggagggaggtcgatgaagttaaagagttgattatcatagtcaaagaatatgtcctggcttcgaagatggagctcaaaaggagggaaatgaaagacaatccaatacgtcaacaggagctagctgcctatttcactcactgcaaccttcaaatgcctcatttaaggcttgctctgcaaaatgcaatgactgtttgcttcaaggcaaagaacctagctactgcagctaattttgccaggcgtctattagagacgaaccccacaattgagaaccaggcaaagatggccaggcaagtgctgcaggctgcagaaaggaatatgacagatgcctccgagctaaattatgacttcagaaacccatttgtgacatgtggtgcaacatatgttccaatttacagaggacaaaaagatatctcttgcccattttgtagttcacgatttgtgccaagccaggaaggacagttgtgttctgtttgtgatcttgctgttgttggggcagatgcttcagggttactctgttctcctacccagatacgatgagcgagtttttgtcaattatttttcagctcgtcttatctgatagcagaagtggcggtcttcattgttttctatctgcagggaaaaaaggtaagagatacctatagaagagttaagtccccagtgaatttgtttgtgttatctttttcttctattctgctttattctggaaatctctttcaccccttgtttacttagttgattatgattttcaatgtaataaacaacttgagaattttggcttggcctattcttgttagctgttcatagacaagaatagacgagggggctcttttgttaaattagataaatctttataggcaggacaagtttacatctcagttgtatggcaaaatttgcttatttgtgatgatttcgggtttctattggttggctgcaagtgatttttctagcttactattatattcatcaacctattcacg

SEQ ID NO: 874 - DNA, 4455 bp, Vitis vinifera
ataaatttccctcacttaggttgaaacttgcttcgcaattccgcacccaaacgtaaaaagaaattaagaattgagaagcataacaggaagctgacccgcttttagcacattcgcattttacaggaaccggcgagaggggccagatccgcaagacgatcctcattctctatttttcctttctttgtagaatctccctgatctgtggtctagccttaagctgcacccctccctgcttatcctacgctcccctgaccgacgatttcccatttgtctctcgttgtcggcggttgacgcggcgatgttcggttcctcttgatccaccgtcatccttttcagatctgagagtttgagttttgatttgaaacgatgttgacgaaattcgagacgaagagtaatagagttaagggactgagttttcacactaagaggccatggatccttgcgagtcttcacagcggtgtgatccagctatgggattacagaatggggactcttattgacagatttgatgagcacgatggaccagtgcgtggtgtgcatttccacaaatctcagccgctgtttgtttctggaggagatgattacaagatcaaggtgtggaattataagttacataggtgtttatttaccctttttggacaccttgattacatccgcacagttcagtttcaccatgagtatccttggattgttagtgcaagtgatgaccagactattagaatatggaactggcagtcccgcactttaatgtctgtattaaccggacataatcattatgtcatgtgtgcctcattccatcccaaagaggacctggttgtatcagcctccttagatcagaccgttcgtgtttgggatattggtgccttgaggaagaaaacaagttcccctgcagatgatatcctgcgcttgagtcaaatgaacacagatttctttggtggagttgacgctgttgttaagtatgttttggagggtcatgaccgaggagtgaattgggcttcattccatcccactcttcctcttatagtctcaggagcagatgatcgccaagtgaaactttggagaatgaacgacacaaaggcttgggaagtagatactttgagggggcacatgaataatgtttcatgtgtcttctttcatgcaaggcaggatgtgattgtgtcaaattcagaggataaaagtattcgtgtttgggatgcaacaaagcgaactggtattcagacatttcgaagggaacatgacaggttctggattcttacggcacatcctgaaatgaaccttcttgcagctggtcatgatagtggcatgattgtctttaagttggagagagaacgtcctgccttttctgtgagtggtgattgtctgtactatgtcaaagaccgctttctccgcttgtacgaattctcaactcagaaggacgctcaggtgattccaattcgcaggcctggttctgctgccttgaatcaaggcccaagaactctttcttacagccctacagaaaatgctgttttgatttgttcagatgtggacggggggtcatatgaactctatattgtgcccagagatagcattggcaggggggatacggttcaggatgcaaaaagaggggttggagggtcagcagtttttgtggctcgaaacaggtttgctgtactagaaaagagcagcaaccaagtgttagtcaagaaccttaaaaatgagatcgtgaagaagagtgttcttcctgttgctgctgatgcaatattttatgctggaactgggaacctgctgtgcagggcagaggatagagtcgttgtctttgatctccagcagaggcttgttcttggggaacttcaaacatctttcatcaggtatgttgtttggtcaaacgacatggagaatgttgctttgctgagcaaacatactatcataatagccagtaagaaactcgagcaccggtgcacacttcatgagacaatccgtgtaaagagtggagcctgggatgataacggggtcttcatatatacaaccctgaatcacattaaatattgtcttcctaatggtgataatggtatcatcaggaccctcgatgtcccagtatacataacaaaagtatctcaaaacactgtctattgcttggatcgagatggaaaaaaccttgctgttgcaatcgatgcaactgaatatgtcttcaagctgtccctcctgaagaagagatttgaccaggtaatgagcatgatcaggagctcggagctttgtgggcaggccatgattgcttacctccagcaaaagggtttcccagaggttgctcttcattttgtgaaggatgaaaggactcgtttcaacttggcactagaaagtggcaatatccagatcgccgttgcttctgcaaaggaaattgataagaaagatcactggtataggttgggagtggaggccctccgtcagggtaatgcaggcattgtagaatatgcataccaaaggacaaagaactttgagaggttatccttcctctatcttgtaacaggtaatatagataaattgtctaaaatgctgaaaattgctgaagtaaagaatgatgttatgggccaatttcacaatgccctatacttgggtgatattagggagcgcgtcaagatcttggaaaatgctggccatttgccccttgcttacatcactgctgctgtccatgggctccatgacattgcagaacgtctggctgctgatcttggagataatgtcccttctttgcctgagggaaaatcacattctcttttgattcctccaagtcctatcatgtgtggtggagattggcccttgttgagggtcatgaaaggaatatttgagggcggtcttgataatgtgggcaggaatgctcaggaagaggatgaagaagctgcagatgctgattggggtgaggatttggatattgttgatggggaaaacatgcagaatggagacattggtatggtgctggaggatggggaagtgcatgaagaaaatgaagagggaggatgggatcttgaggatcttgaacttcctcctgagcttgatactccaaagactagcagccatgctcgctcatcagtttttattgccccaactcctggtatgcctgtaaatctaatttggacccaaagatcatctcttgctgcagagcatgctgcagctggcaattttgatactgcaatgcgtttgctgagccggcagcttggtataaggaattttgctcccttgaaaccactattttttgatctacacatgggtagccacacttacttgcgtgccctttcttcatctccggtgatctcagtagcagttgagaggggatggagcgaatcctccagccctaatgtgaggggtccacctgcacttgtgttcaaattctcacagttggaagaaaagctaaaggctggttacagggcaacaactgctgggaaatttacagaagctctacggatttttctcagtattctccataccattcctctgattgtggttgagtcaaggagggaagtagatgaggtcaaggaattgatcatcattgtgaaagagtatgctctgggtttgcagatggaagttaaaaggagggaagtcaaggatgatccagttcgtcagcaggaactggctgcttactttactcactgtaacctgcaattgcctcacctgagactggcattgttaaatgccatgactgtttgctataaggcacgcaatcttaacacagcagcaaactttgcccggcgactgttggagactaatcccaccaatgaaaaccatgccaaaacagcccggcaagtcctgcaggctgccgagaggaacatgacagatgcatccccgctgaattatgacttcagaaacccatttgttgtttgtggggcaacctacatccccatataccgcggacagaaggatgtgtcgtgccctttctgcagttcgcgatttgttccttcacaggaagggcagctttgtactgtttgtgatcttgcggttattggatctgatgcatctggattgctctgttctccttcccagataaggtgatttgagctcaatcaggagcaattttcaaatttcagcagtagcactgattatgctagctgtttcttctcgacaggtaaaggtaggaactttaaacaaagagttgggttccattagattgtatttttttttttttttttgttttcaaaaatttttattgcccgtcttcatctcttcctcttccccttccccttccccgacaccttttaattttcatgttcatgattttcactgtaataagctacttaagaattttggattaggctcttcatgcgacttgtgggaattagtgtatcttgttgaggtgactgattcgatgctttcacagtccgctagttgtgagtttttgttaaggtatgaccaccatcattcggtttaagttaatgaagtaggaaactggttgggaaccattttgagccattggacaagagggattta

SEQ ID NO: 875 - DNA, 4346 bp, Manihot esculenta
ggtctctctcaaattcacaaacacaagcacgcagacactacccatcgaggcacagatctaaagagagaactggaaaatcccttgttctctctctcttctctcttctctcttctctcttctctcttcttctttcctttctgatctgcttctgattatttgtttctctgaatttgatattggctttccctcgccttctctcacgaatctagtagtgttgtgattgattgtagatgcgattgggtacatcttcttgatctgttcagatctaaggaaaaggttttttttttttgtttgattagagaagatgttgacgaagtttgaaacgaagagtaatagagtgaaaggacttagtttccacagtaagagaccgtggatccttgcgagtcttcacagcggcgtgatccagctatgggactacagaatggggacattaattgataggtttgatgagcacgacgggcctgttcgcggagtccatttccacaaatctcagcctctgtttgtatctggaggtgatgattacaagattaaagtttggaactacaagatgcataggtgtctgtttacacttcttggacaccttgattacatacgtactgttcagtttcatcatgagtacccatggattgtgagtgccagtgatgatcagaccatccgaatttggaattggcagtcacgtacttgcatttctgtgttaacgggccacaatcattatgtaatgtgtgcctcattccaccctaaagaagaccttgttgtttcagcctctctagatcagactgttcgtgtttgggatattggtgctctaagaaagaaaactgtttcccctgctgacgacattctgcgcttgagtcagatgaatacagatctatttggtggggttgatgctgttgttaagtatgtattggaaggtcatgatcgaggagtgaactgggctgctttccaccccacccttcccttgattgtctcaggagcagatgatcgtcaagttaaattgtggcgtatgaatgacacaaaggcttgggaagtggacacattgagaggacacatgaacaatgtgtcatgtgttatgttccatgccaaacaggatatcatcgtttcaaattctgaggataaaagcattcgtgtttgggatgtaactaaacgaactggagttcagactttccgtcgggagcatgaccgattttggatccttgcttctcaccctgagatgaatctccttgctgcaggtcatgacagtggcatgattgtttttaaactagagagagaaaggcctgcttttgcagtgagtggtgattcgttgttctatgccaaagatcgctttttgcggttctttgagttttcaactcaaagggacacacaagtgattcccatccgacgacctggtaccaccagcctgaatcaaagtccaaggacactttcttacagtcctacagagaatgctgttcttatttgctcagatgtggacggtggatcttatgagttgtatgtcatacccaaagacagcattggtagaggtgacactgtccaggaggcaaagaggggtgctgggggatcagccatttttgtggctcggaataggtttgctgtgcttgacaaaagtagtaaccaagtgttggtaaaaaacttgaagaatgaagttgttaagaaaagtagtctccccattgctgcagatgcaatattctatgctgggacgggtaacttgctttgcagagctgaggatagagttgttatatttgatctccagcaaaggcttgtacttggggatcttcaaacaccttttgtcaaatatgttgtttggtctaatgatatggagagtgttgccttgctcagcaaacatgccatcattattgctagcaagaagcttgtgcaccagtgcactcttcatgagacaatccgtgtaaagagtggagcttgggatgataatggtgttttcatttatacaactttgaatcacataaaatactgccttcctaatggggatagtggcataatcagaaccctcgatgttccaatatacatcaccaaagtttctggaaataccatattctgcttggaacgcgatgggaaaaatagagctattgtcattgatgccacagaatatatcttcaaactctctcttttgaggaagagatatgaccatgttatgagcatgattaggaattctcagctctgtggtcaggcaatgattgcatatttgcaacagaaaggttttcctgaagttgctttgcattttgtgaaggatgagagaactcgatttaatttggcgctcgaaagtggaaatattcagattgctgttgcctcggcaaaggaaattgatgagaaagatcattggtatagattgggagtggaagctcttcgccaaggtaattcaggtattgttgaatatgcctaccagagaactaaaaattttgagaggttatctttcctttatctcataactgggaatctggaaaagctttccaagatgctgaaaattgctgaagtcaagaatgatgttatgggacaatttcacaattccttgtacttgggtgatgtccaagagcgtgtcaagatcttagagaatgctggtcatttgccacttgcttatataactgctaaagtccatgggctagatgatgttgctgaacgtctggctgcagatttaggagatgatgtcccatcagtgccagagggtaaagtgccttcccttctgatgcccccagttccagttatgtgcggtggtgattggcctcttctaagagtcatgaagggtgtttttgaaggtggactagataatatgggcagaggtggtgctgatgaagatgaagacactggtgaaggaggtgaaggtgattggggtgggctggatattgttgatgatgatggcttacaaaatggggatgttacagcaattttggaggatgggaaagtggctgaagaaaatgaagagggaggatgggaacttgaagacctggagcttccccctgaggcagacacaccaagggcttctgtcagtgctcgctcttcagtttttgtggcaccaactcctggtatgcctgtaagccagatttggatccagagatcatcacttgctgccgaacatgctgcagctggcaatttcgatactgctatgagattgctgaacaggcaacttggaatacggaacttttctcctttgagatccatgtttcttgatcttcattcaggtagccattcctatttacgtgcattttcatctactccagttatatcattggctgttgaacgtggatggaatgagtctgctagcccaaatgtgaggggccctccagcgctggtattcaatttctcacagttggaggagaagctcaaggctggttacagagccacaacaggagggaaattcactgaggcactcagactctttctcagcattcttcacacagttcctttaattgttgttgaatcaaggagagaggttgatgaagtaaaggaattaattgttattgtcaaagaatatgttctgggtctgcagatggaacttaaaaggagggaaatgaaggacaatccagtccgccagcaggagctagctgcctacttcacccactgcaaccttcaaatgcctcatttaaggctggctttgctaaatgcaatgactgtttgctacaaggcaaagaaccttgcaactgcagctaactttgcaaggaggcttttggaaacaaaccccacgattgagaaccaggcgaagactgccaggcaggtgttgcaagctgcagaaaggaatatgagagacgctgctgagctgaattacgattttagaaatccttttgtgacatgtggcgcgacatatgttccaatttaccgaggacagaaggacgtctcttgcccatattgtagttcacggtttgtgccgagccaagatgggaaactgtgtactgtttgtgatcttgcagttgttggggcagatgcttcagggttgctctgttctccttcccagatacgatgattgagatgatttttcaattatttttcatctcatcttattagcagcagaaacagaagtggtcaactcgattgtttcaaatgtctgctgggaaaaggtaaaagatatcatagaagagttaagtgcccagtgaatttgtttgtgccgtctccttttctttgctttattctctgaatcatcttcccttcttcttgcttagttgattatgattttctatgtaataaacaacttgagaattttgacttgggctattcttgttatctgttcataggcaagaatagtggagggctcttgttaaattagataatctttataggcaggacaaattacatcagtcgtttggcaaatttgcttacttgtgatgatttggggtttctattggttg

SEQ ID NO: 876 - DNA, 4555 bp, Aristolochia fimbriata
aaccatttctccgtcatcggggcgcggttgtcaattccggatccaatccttccgttaccagatccaggcccggaggttcagacttctcggaaaattctgcgatttgatctgcggccgggaagatgctgacgaaatttgagaccaagagtaatagagttaagggactgagttttcatagtaagagaccatggatcttggccagtctccacagcggcgtgatccagctctgggattaccggatgggaaccttaattgatcgattcgatgagcacgatgggcctgttcggggtgtccatttccacaaatctcagccgctctttgtatccggcggagatgattataagataaaggtctggaattataagatgcaccgttgtctattcactcttcttggacacttggattacatacgaacagtgcaatttcataatgagtacccatggattgttagtgctagtgatgatcaaactatcagaatatggaactggcaatcacgcacttgtatatctgttttaactggtcacaaccactatgtcatgtgtgcttcatttcatcctaaggaggaccttgttgtatctgcatcactggatcagactgttcgagtgtgggacattggtgcacttaggaagaagacagtttctcctgcagatgacattctgcgtttgagtcagatgaactcagatctctttggaggagttgatgcagttgtgaaatatgtcttggaaggtcatgatcgtggagtcaactgggctgcatttcatcctaatttgcctcttattgtgtctggcgcagacgatcgtcaagtgaagctgtggcgaatgaatgatacaaaggcttgggaagtggatacgttgagaggacacatgaataatgtttcttgtgtaatgttccatgcaaggcaggatattatcgtatccaattcagaggacaaaagcatccgtgtgtgggatgtcacaaaacgaacaggtgttcagacgtttcggagggagcatgataggttctggattcttgctgctcatcctgagatgaaccttctggctgctggtcatgatagtgggatgattgtcttcaagttggaaagagagaggcctgccttttctgtcagtggagattcattgtactatgtcaaagatcgatttcttcgattttttgagttctcttctcaaaaagataaccaggttatcccaataagacgtccagggtcaaccagcttgaatcagggccccagaaccctctcttacagcccgactgagaatgctgttttgatatgttcagatgtggatggtggatcctatgaactgtatgtagtaccacgagagagtgctggcagaggagataatatgcaagacgctaagagaggacttgggggttctgcagtttttgtggcacgtaacaggtttgcggtgcttgacaagagtagcaatcaagtgttggtgaagaacctaaagaatgaaattgttaagaaaagcactcttcctgttgcagcagatgctattttctatgctggcactggcagtttgctttgtagggctgaggatcgggtggtcatctttgatcttcagcagagaactgttcttggagatcttcagacaccttttgttaagtatattgtttggtctaatgacatggaaagcgtagccttactaagcaaacatgccatcataattgcaagtaagaggctggtccatcgctgtactctgcacgagactattcgggtcaagagtggagcttgggatgataatggtgtttttatctataccacattaaaccacatcaagtattgccttccaaatggggatagtggaataattaggacccttgatgttccaatttacattacaaaggtttcagggaacactatctattgtttggatcgcgacggacggaaccgtgtcatagcaattgatgcaacagaatatgtcttcaagcttgctttgataaaggaaagatttgaccatgttatgagtatgattagaaactcccagctttgtggccaggctatgattgcttaccttcagcaaaaaggttttccagaagtggcacttcattttgttagagatgagagaactcgcttcaacttagcactagaaagcggtaatatacaaatagctgtagcttcagcaaaggaaattgatgagaaagatcactggtacaggttgggtgttgaggcccttcggcagggtaatgctagcatagttgaatatgcttaccagaggacaaagaattttgaaaggctttcatttctttatctggtcactgggaatatagagaagctttccaaaatgctgagaatagctgagattaagaatgatgtgatgggtcagtttcataatgccctataccttggtgatgttcgtgagagagtgaagattttggagaatgtgggtcacttgcccttggcttatgttactgcagcagttcatgggctgactgaggatgctgaaagaattgcagctgaactgggggacaatgttccatctcttcctgaaggaagggttccttcacttcttgtgccacctccacctattatgtgtggtggagattggccactacttagggttacaagaggtatttttggaggtggtcttgacaatgttggcagggctggacccgaggaagatgaagaagcttcaagggccgactggggtgatgacttggaccttggtgttgatggccttgacaatggagatgttagtatgatagttgaagatggcgatgtcaatgaaggtgatgaagaagggggatgggaacttgaagatatcgagctgccacctgaagttgatacccccaaaactgctcttgtatcccgctccacagtttttgttgcccccaccccaggtatgcctgttagccagatctggattcagaagtcatctcttgccggtgaacatgcagcagcaggcaattttgatactgcaatgcgtttgttgagtcgacaactgggcataaagaactttgctccattgaagccagttttcttggaccttcacactgggagtcatacatatctgcgtgctttcacttcagcacctgttattcccttggctgttgagaaaggatggtcagaaaattcgagtcccaatgtgcggaacccacctgcacttgtttacaaattctcacagttagatgacaagctcagaagtgcgtacaagctcaccacagagggtaagtttggcgaagctttgaagcttttccttagcattttgcacaacatccctgtagttgttgttgagtcaagaagagaagtggatgaagttaaggagttgatcacaatagcaaaagaatatgttttgggcttaagaatggagcttaaaagaaaggaacttaaagatgaccctgtccgtcagcaggagttggcagcttatttcactcattgcaacctccaaagggttcatctgaggcttgtccttgtcagtgccatgaccctttgctttaagggtgggaattacaatgctgctgccaattttgcacgcaggcttttggagacagacccaactatagaagcacaggtcaagcgggcgcggcaagtcctgcaggcttgcacggagagaaatatgaaagatgctaatcagctgaattatgacttcaggaacccatttgtagtttgtgggtccacatttgtgccaatttatagggggcaaaaggatgttgcatgctcctattgtgggtctaggtttgtgccatcaattgaaggtcaaatctgctcagtttgtgatcttgccgtagttggagcagatgcgtcaggtctcctttgttcaccttcccagatgagatgaaaagagggaagagagaatcctagatcactttcttgcgggggttagtgctgaatgcggaaagagtaaaagctgtctggagtggacaactaggagttttatgctcccgatcgtggaattgtcaatgctaaagaaggtaggattgggttggttattatctcatatcatccaacatctaatatcgattgtcattttgtggtgatgtttattgtaataaacttttttctttttctcacagagaatttttgctgcctgttcctgttgtgttagtttctgtcactatcatattaagaggacgtttttattgattcattattaacgaagaagactaaattgtatgaatttgttgatgaggatgatatggcttcggtaatgaattagacgaagagctttagttctaaactgttttgatacagtaatgtttatatctttcctttcaccttggctgtctgttggtttactgtgcactttgattctgtccttattttatcagacttccgtgccctgtactcaagactattatgattttgttaatcatatatgtattatgaccattatggcttgatgcttatctctcatatttttagttctcttcatttttgctcgtctttgagttgtattgcttggaagcattatcgggtgcgctgtcctggtctacacggaagggggggttcgtttatcttcttgatgaagcaaatgaagtatgtacaagttccagggaatagggtagctggcccagcgattgtgtttcaaccgtggcttccctttttcgtattctttaa

SEQ ID NO: 877 - DNA, 10898 bp, Gossypium raimondii
aggcaaatgaccagcattctccaagatctttacacgttcttggatatcgccaagatacaaagcattgtgaaactggcccataacgtcgttcttgacttctgcaatcttcagcatcttggacagcttttccaggttaccatttatgagataaagaaacgacaacctctcaaagttctttgtcctctggtaggcatattcaactatacctgcattgccttggcgaagggcttccacacccaacctataccaatgatccttgtcatcaatctccttagctgatgcaacagcaatttgaatgttcccactctctatagccaagttaaaccgagttttctcatctttgacaaaatggagagccacttcagggaaccccttctgttgtagataagcaatcacggcctcaccacaaagctgggagtttcttatcatgctcataacatgatcatacctcttccgaagcagagacagcttaaaaatgtattctgtagcatcaatgaccagcgtcttgttcttcccatcacggtccaggcaaaatattttgtttccagaaaccttagttaggtatattggaacatcaagagttcgaattattccactatctccattgggtaggcagtattttatatggtttagagtggtgtaaataaaaacaccattttcatcccaggctccactcttaactcgtattgtctcatgaaaagtgcactggtgcacaagtttcttgctagtaatgataatggaatgcttgctgagcaaagcgacactctccatgtcactagaccaaacaacatacttcacaaaaggcgtttgtagatcaccaagaacaagtctctgctggagatcaaatacaaccactctatcatctgatctacacaataaattacctgttccagcatagaaaattgcatctgtaggcactggaagaccgctttttttaacaacctcatttttaagattcttgattaagacttggttgttgcttttgtcgagtacagcaaaacggttccgagccacaaatatggcagaactaccaggacctctctttgcctcctgcaagtcactcctaccaatgctgtcttttggtatctgatacaactcataagttcctccatcaacatctgagcagataaggacggcattttctgtgggactataagaaagagtccttggacattgattcaaggttgtggaaccgggccgccggataggaactatttgtgtctctttttgtgttgaaaagtcataataccttaagaatcgatccttggcataaaacagagaatccccactaactgcaaaagcaggccgttctctctctagcttaaatacaatcatgccactgtcatgtccagctgccaaaagattaatctcaggatgggctgcaagaatccagaacctgtcatgttctcgacggaaagtttgaagtccagttcgctttgttgcatcccacactcgaatacttttatcctcggaattggatacaatgatgtcttgtttggcatggaacatgacacatgacacattattcatgtgtcctctcaaggtatccacttcccaagccttggtatctgaaaaaaaccaaacaatttactcaatcccacaacaattcaagagtctaaattccctgctgcaaaaaaaattatccacctacttttagcagtttgtatatacacagccaagatcataaaataaaatgaagaagttgcggtggcaggctaaactaccaagggccaccatatccaacttacaggaggggaaagaaagaggtaagtccctataaaatttatagttagaaaaagaattacttacaaaaactttaatcagtatatctaccaaatgcaacatataacggaagtgatatagttcctgtatttaccattcatacgccacaatttcacttggcggtcatcggcaccagagactatcaaaggtaaagttggatgaaatgcagcccaatttactcctcggtcatgtccttccaacacatacttgacaactgcatcaacaccaccaaaaagatctgtgttcatctgactcaaccgtaaaatgtcatctgctggggaggcacccttctttttcaaggaactaacatcccaaactcgaactgtctggtcaagggaggccgacacaaccaggtcttctttaggatggaatgaggcgcacataacatagtgattatgaccagtcaacacagagatgcaagttcgagactgccagttccatatgcgaatggtttgatcatcactggcactcacaatccatggatgttcatgatgaaattgcacagtacgaatataatcaagatgtccaagaagggtaaaaagacatctatgcaacttgtagttccagacctttatcttgtaatcatcccctgaaaaaataaaaaatttaatgtcatttggattccacaagtaccttatgctctgtaacagaaaatcatagcacaaatggagatttttgagctaatctcaaattcagacttctattgcctatgttgaacaagtcaaggaaatttcaaatcataaaccttattaaatcaatttgttattccttaattctaatgatataatcactaataggagtgaaatgcaaatcccaataaaatggtaaataaactgttaaaaaaatttatacattccagtctattacaaattctaaatatgctcaaatatttaactccattttccactcacttgtattaaagctttatatttaggaatcttcatcgacaacaatttaccctaaaaaaagcattaaactaaacaaattcaaaattattcattcaactggttttattacaaagattgtgaccctcttattcggtatatgaaaggttgtaaccgttgggcagttcaagacttcggtcttccagctagaatggaaatgcaaataaaatagcaccaaggaaggcagggtgggatgggacatagttactatcttaaagggaaggtagttttgggcagaaaattttgaggacttgactagctgcttctatcttaaggcacatctggtcttatcttttgcaggccagcagctcaggctctctccgagtgacatggttgtaagattacaaccttagaaacaattgttttaggcagatctcgatcccaaattcttacattcagcattggacaatgctcttgcattgaaggtatagtgccaggccttgaatttctactggccttgagtcaggtatccatatcaagaaggtgaagatctaaacgaaagtccaaatacatgaaatctctataataaatatagatccagcaacatcatatgcatcggatttctcaaatgccatacagttacatgaataaaatatagctccagaaactaaactaattcaaactaattcataagcaaattccacaatttcacattcaaatccatagatcactaaaataattaacgagattcattaagaaataaaactgaggcgaaaaggaaaagaaatccgaacctccagagacaaacaaaggttgagacatgtgaaaatggacaccacgaacagggccatcgtgttcgtcaaatcgatcaatcaaagtccccattcgatagtcccataactgaataacgccactgtggagactagctaagatccacggcctcttggtgtggaaacttagtcccttcactctattactcttcgtctcaaacttcgtcaacatttttgttcctttatctccaactactaattctctgcaatatcaaatcaaattcaacgtaagtatatgcgtaaccaaacgggcagaatccgatttgaaaattgaacgatgaaaatgagaataatttacctcagatctgatccagcatttaaaattaagaacaaaaatgagaagaaattgaatttgggtttaaatgaaaggaaaacagagagtttttgatcctctctttaagaaatttttatttaagatctgagcctagaaatctaggaattttattattgtttcttcaacctatcttacggtgccgtttttgtgcggtaaaagggaacttttgtagtgtaagtattaaattgaatttataaaatttgtttgataattataaaaaatataattagattttttgataaatatatatttaaataaaaaatatttttgattcttagatatttcaaaaattaaattttaaatctaaaatttttataggataatataatattaaaataaataaaattgaagtaattgaaaatattttttattaagtgataataacttttatctatctatcattttcaacacaaaaaatttctattgaattgtttttattttagattataaaacatgtgtaaaaattaaatcgttgaaaatattattttttaatagatttaaagtttttaataatctatcaattttgatagtgaattattaaagacaattaatcacgtacaatcaatgtttttcatccatgaaacataattttgattgatataataataaattatgatattatttttttctattttctttatacatttttattttgaaaagtattattatttggtatattaatggtggaaattattaatttcataaagaggattgagaatttaccgcatatattatttatttatttttaatttttttaaataatgtaaatgtctgtggcttatgaacttgaaaattcccactattataacatttaaaatttaatgtatttgttgttgttcaaataatgtaatcattttacttttttatttaagaaataaaggaaatttccattaaatttaaacatttatatttttatattaaaagattttatttaaaaattaaagtctaattattaaaatgttcaaatttaatgaaattcaattaattgtattattgtctactgaatcattagtgtaatggtaaaaaaaattgagatgattttagaccctcgttgacactagattcaagattcaagttgttgacaacccattccccatcccactaaaagaaaaataataatgttattatttgaactttaattttaaatttcggcaagtaatgaaattaaattttaaaatttataagaaaaaacacaataaatttaagaaatcaaaaaatatagggagtgagggtagaattaagcgtttcctagctgtccaaaatgcaaatgcaataatgttttatgtgaatatattattttatatctgagtttgaatttaatgttaagttaaggaattaaagttttttttcaagtttttaaattcgataaataagtttttcttttacaattaagtatttaattctaattttaatgtttaatttgatacctgaattactacgcaccattgttgaaagtaattatatgaccacctaatcaaaaatcaaaccatcggataaaaaaacttttcgaatcaaatgtaaataaaataaaaaaactaatgacttgagaatgtaattcttcactaacttgaaaaaaataaaccatcaaatacaccacatacaagtgattggaggctcaacataatccccaccatgagattttattttagatacaatttatttgtcatacattactctactactattcgagcacataatttcgtgtatttaattaaagttaacccttaattttttcagaaagggtcaaatcacttttttaatgaaatttttttataaaatttcgaaaaaaattaataaatatttaaaaattttgaaaattattttgaaattttgtgttaaagagacctatttgctcgttttttaaattgacaatgatctaaagggtatttatatcaatttgtttatttgagttgtaaaattcaactcaaaaatttaaattacttgttttagttgattcaaaattgaataactaaatccgattaacgcgaaatttaaaaaaatgatttttattgttgatgggttaattgaacaatatgaagataactgtggggaagcacggttcaccttatttattataagacagtgagtcaccgtttaaggtggttgaggagaggagagagtgagagattgcatcgactctattctttggccttatatacctataatcctagtttcgagatgtcatgtattgagttctcatacgagggataatggcaagtggccaaatagtttatcattatatgctcaagtagagtggtaataagatgtgcttttggtcatcgcaaatggaatatgatggttggagtctggtacatcgattaataaaatagatccctctttagtattaagttgaagggtatcttcaaaaagttcatttaaattgctcgacgattcattatttgatctcaacaacaaaggcataacatttttcgcgacaaatagaattttactcgcccttaataattatctaaacaggtataaaatattaaaattcattctaattaattactaacataataattacaattttattcattaatatgtgatgtgctatcaatcgccatccttaactaaaacaattcttatttaccgtaacagaaacgtcgtcgtaaggggctttgagataggctgtacaaaaataataaaattcctagatttccaggctcagatcttaaaatcaaaatttcttaaagagaggatcaaaaactctctgtttccctttcatttaaacccaaattcaatttcttctcatttttgttcttaattttaaatgctggatcagatctgagcgtattaaacgttggagataaagataaaaaatgttgacaaagtttgagacgaagagcaatagagtgaagggactaagtttccatactaagaggccatggatcttagctagtctccacagcggcgttatccagttatgggactatcgaatggggactttgattgatcgatttgacgaacacgatggccctgttcgtggcgttcattttcacatgtctcagcctttgtttgtctctggaggggatgactacaagataaaggtctggaactacaagttgcatagatgtctttttacccttcttggacatcttgattatattcgtactgtgcaatttcatcatgaacatccatggattgtgagtgccagtgatgatcaaaccattcgcatatggaactggcagtctcgaacttgcatctctgtgttgactggtcataatcattatgttatgtgcgcctcattccatcctaaagaagacctggttgtgtcagcctcccttgatcagactgttcgagtttgggatattggttccttgaaaaagaagggtgcctccccagcagatgacattttacggttgagtcagatgaacacagatctttttggtggtgttgatgcagttgtcaagtatgtgttggaaggacatgaccgaggagtaaattgggctgcatttcatccaactttacctttgatagtctctggtgccgatgaccgccaagtgaaattgtggcgtatgaatgataccaaggcttgggaagtggataccttgagaggacacatgaataatgtgtcatgtgtcatgttccatgccaaacaagacatcattgtatccaattccgaggataaaagtattcgagtgtgggatgcaacaaagcgaactggacttcaaactttccgtcgagaacatgacaggttctggattcttgcagcccatcctgagattaatcttttggcagctggacatgacagtggtatgattgtatttaagctagagagagaacggcctgcttttgcagttagtggggattctctgttttatgccaaggatcgattcttaaggtattatgacttttcaacacaaaaagagacacaaatagttcctatccggcggcccggttccacaaccctgaatcaatgtccaaggactctttcttatagtcccacagaaaatgccgttcttatctgctcagatgttgatggaggaacttatgagttgtatcagataccaaaagacagcattggtaggaatgacttgcaggaggcaaagagaggtcctggtagttctgctatatttgtggctcggaaccgttttgctgtactcgacaaaagcaacaaccaagtcttaatcaagaatcttaaaaatgaggttgttaaaaaaagtggtcttccagtgcctacggatgcaattttctatgctggaacaggtaatttattgtgtagatcagatgatagagtggttgtatttgatctccagcagagacttgttcttggtgatctacaaacgccttttgtgaagtatgttgtttggtctagtgacatggagagtgtcgctttgctcagcaagcattccattatcattactagcaagaaacttgtgcaccagtgcacttttcatgagacaatacgagttaagagtggagcctgggatgaaaatggtgtttttatttacaccactctaaaccatataaaatactgcctacccaatggagatagtggaataattcgaactcttgatgttccaatatacctaactaaggtttctggaaacaaaatattttgcctggaccgtgatgggaagaacaagacgctggtcattgatgctacagaatacatttttaagctgtctctgcttcggaagaggtatgatcatgttatgagcatgataagaaactcccagctttgtggtgaggccgtgattgcttatctacaacagaaggggttccctgaagtggctctccattttgtcaaagatgagaaaactcggtttaacttggctatagagagtgggaacattcaaattgctgttgcatcagctaaggagattgatgacaaggatcattggtataggttgggtgtggaagcccttcgccaaggcaatgcaggtatagttgaatatgcctaccagaggacaaagaactttgagaggttgtcatttctttatcgcataaatggtaacctggaaaagctgtccaagatgctgaagattgcagaagtcaagaacgatattatgggccagtttcacaatgctttgtatcttggtgatatccaagaacgtgtaaagatcttggagaatgctggtcatttgcctcttgcttatgttacagcatcagtccatgggctacatgatgttgcggaaaggttagctgctgagttgggagatgatgtcccttctttgccggaagggaaaaaaccttccttattgatgcctccggcacccgttatttgttgtggtgattggcctctgttgagagtaatgaaaggtatatttgaaggtggattcgatagtactggcaggggtgcggtggaggaagaggaggagggtgcagatggtgattggggtgaagatcttgatatggtcgatgctgatgacttgcagaacggagatgttactgcaattttggaggatggggaagtggctgaagacaatgaagagggtggatgggaccttgaagacttagaactccctcctgaggtagagacaccaagggttaatgctcgttcttctgttttcgtggcaccaactcctggtatgcctgtgaatcaaatttggactcagaggtcgtcacttgctgctgatcatgcggctgctggcaattttgatacagccatgcgtttgctaagcaggcaacttggaataagaaactttgctcctttaaaatccatgtttctcgatcttcacactggcagccatagctatcttcgtgcattttcatctgcgccagtggtgtccttggcagttgagaggggatggagtgagtctgctagtcctaatgtgaggggtccacccgctctcgtattcaacttttctcagctagacgagaagctgaaggctgggtacaaggccacaacagatggaaaatttaccgaggctcttcggcttttcctcagcattcttcatacaattccattgattgttgttgagtcgaggagggaagttgatgaagtcaaagagttaattatcatcgctaaggagtatgttcttggtctgcagatggagcttaagcgtagagaattgaaagacaatccggtacgccagcaggagctcgctgcctacttcacccattgcaaccttcaaatgcctcatctcagacttgctctgcgaaacgcaatgaccatctgtttcaaggcgaaaaacctggctacagccgctaacttcgccaggcgtcttctagaaacaaaccctaacgagaaccattcaaaggcagcgaggcaagtactccaggcttcagagaggaatatgacagatgcatctcagttaaactacgatttcaggaacccttttgtgacatgtggggcaacttacgtcccgatttaccgaggacagaaagatgtatcttgtccttactgtactactcgctacgtgcctacccaggagggtcaattgtgtacaatctgtgagctcgcagtcatcggagcagacgcatcaggtttgctttgttctccttctcaaattcgataattttgaactacatagtcgaggcttgtttctttaatcttgctcaaccttgagcaaatgccgtaccagtcacgtctgaaaatagtcagagggcccttgtttaaaatagataatggtcatatctcatatataggacaattacatgttaatgtgtgtcaaatttgctcacttctctttgatacctttttttttttttttcaagttcccattgcttggtattttttcctattcaagtacccgaaccttttgttgtgttgcattgcactctacccacaacatttaggactaattatgtccttagtgcctgtactttttggacttttgaaattcagtctctctatttttaatttcaggaatttagtctatttatttgttagtttgatttaaaaattaaaatccaattggtaatattcttgtttttccctttgcagtatcatttggactttaatttttaaaccatgcccatattcaaattaaacggaagttcattaataatattatcaattgggttttaattttgaattcaaacaagtagagagaccgaatttttggaaataaaaacggagaaattaacttagttcatttattcaaatatgaccattattttaaa

SEQ ID NO: 878 - DNA, 4002 bp, Gossypium hirsutum
ttcgatttctgcggagacttagcttccggagagaaaggaaaagaagaagaagaagaagatgttgacgaagtttgagacgaagggtaatagagtgaagggactgagtttccacgctaagaggccttggatcttagctagtctccacagtggcgttatccagttatgggactatcgaatgggaaccctgattgatcgattcgacgaacatgatggccctgttcgcggcgttcatttccacatgtctcagcctttgtttgtctctggaggggatgactacaagataaaggtctggaattacaagttgcatagatgtcttttcacccttcttggacatctggattatattcgtactgtgcaatttcatcatgagcatccatggattgtaagtgctagcgatgatcagactattcgcatttggaactggcagtcacgaacttgcatttcggtgttgactggtcataatcactatgttatgtgtgcttcattccatcctaaagaagaccttgttgtgtcagcctcccttgatcagactgttcgggtctgggatattggttccttgaaaaagaagactgcctcccccgcggatgacattctacggttgagtcagatgaacacagatctttttggtggtgttgatgcagttgttaagtatgtgttggaaggtcatgacagaggtgtaaattgggctgcatttcatcccactctacctttgatagtctctggagcagatgatcgccaagtaaaattatggcgcatgaatgagacaaaagcttgggaagtggataccttgagggggcacatgaataatgtgtcatgtgttatgttccatgccaaacaagatatcattgtatcaaattctgaggataagagcattcgcgtgtgggatgtaacaaagcgaactggacttcaaactttccggcgagaacatgacagattctggattctttctgttcatcctgaaatgaatgttttggcagctggacatgacagtggcatgattgtatttaagctagagagagagcgccctgcttttgcagtgagtggggattctctgttttatgccaaggatcggtttttaaggtattttgacttttcatctcaaagagagacacaagtaattccaattcggcgtcctggttcctcaagtctgaatcaaagcccaagaactctttcttacagccctacggaaaatgctgttcttatctgttcagatgtggatggaggatcttatgaattgtatgtggtaccaaaagacagctctgctaggagtgacagtttgcatgaggcaaagaaaggtctaggcagttctgctatatttgtggctaggaatcggtttgctgttcttgacaaaggaaacaaccaagtcttaatcaagaatctgaaaaatgaggtggtgaaaaagagtggtctgcctgtgcctactgatgcaatattttatgctggaacaggtaacttgttgtgtaggtctgaggatagagtagttatatttgatctccagcagaggcttattcttggtgatcttcaaaccccttttgtgaagtatgttgtttggtctaatgacatggagagtgttgctttgctcagcaagcataccattgtcattactaacaagaagcttgtgcatcagtgcactcttcatgagacaatacgtgttaagagtggagcttgggacgagaatggtgtttttatttacaccaccttaaaccatgtaaaatactgccttcccaatggagatagtggaatcatccgaacgcttgaggttcctatatacataactaaggtttctggcaatactatattttgcctggatcgtgatgggaagaataagactatcgtcattgatgttaccgaatacatttttaagctatctcttcttcggaagagatatgatcatgttatgagtatgataaggaactcccagctttgtggtgaggccatgattgcttatcttcaacagaaggggttccctgaagtggcactccattttgtcaaagatgagaaaacacgctttaatttggctctagagagcgggaacattcaaattgccgttgcatcagctaaggagattgatgacaaagatcattggtataggttgggtgtggaggcccttcgccaaggcaatgcaggtatagtggagtatgcctaccagaggacaaagaactttgagaggttgtcatttctttaccttgttaatggtaacctcgaaaagctgtccaagatgctgaaaattgcagaagttaagaatgatgtcatgggtcagtttcacaatgctttgtacctgggtgatatacaggaacgagttaagatcttggagaatgctggtcacttacctcttgcttatattacagcatctgtccatgggctacaggatgttgctgaaaggttggcagctgagttgggagatgatatccctcctttgccagagggtaaagaaccttcgttattgatacctccaacccctgttacatgtggtggtgattggccccttttgagagtcatgaaaggcatatttgatggtggattggatagcattggcaggggtgctgcggatgaagaggagggtgaagaaggtgattggggtgaagatcttgatgtggttgatgttgatggcatacagaatggtgatgttagtgtaaatttcgagggtgcggaagtggctgaaggaagtgaagaggagggtggttgggaccttgaagatttggaacttccccctgaggcagacaccccgaaggtttctggcaatgcccgttctatttttgtggcaccaactcccggtatgcctgtaagtcagatttgggttcagaaatcatctcttgctgctgaacatgcagcagctggcaattttgatacagcaatgcgtttgctgagcagacaacttggcataagaaacttttctcctttgaaatccttgtttcttgatcttcacactggcagccatagctatcttcgtgcattctcatccgctccagttgtgtcgttggcagttgagaggggatggagtgagtctgctattcctaatgttaggtgtccgccagccctggtattcaatttctctcagttggatgaaaagctgaaggctggttacaaggccacaacagctggaaaatttactgaggcactccggctcttcctccgcattcttcatactattccgttgattgttgtggagtcaaggagagaagttgatgaggtcaaggagctaattattattgccaaggagtatgttcttggtctgcagatggagcttaagcgaagagaaatgaaagacaatccagtacgccagcaggagcttgctgcctacttcactcactgcaaccttcaattaccacacctaagacttgccctgctgaatgcaatgactgtctgctacaaggcaaagaacatggctacagcaggtaactttgcccggcgactgctagaaacaaaccccacaaatgagaatcaagcgaagacagccaggcaagtgcttcaagctgctgagaggaacatgacagatgcttctcagctgaactatgatttcagaaatccatttgtgacatgtggggcaacttatgtgcctatttaccgagggcagaaggatgtatcgtgcccatattgtactagtcgctttgtgcctagccaggaagggcaattgtgtacagtgtgtgaccttgcattggtcggggcggatgcatcagggttgctgtgttctgcttcacagatacgatgaggcaacaaaagttggatccgcttttgaacttaatcctgctgatccttttagatgcaaaacccatcctcagcgatcaactcatatctgcagtttaaaaggtcagagtttactttagaaattattgagaactgaaattaatttgtttgtgctatttccttctgttttggttttttccggcttaatagagttcattatgattttcgtatgtaagaatgaatttggatttataattttctggatattcgcgttttttgttgtttcatagacaaaaaatagaaaagtcacggagcctt

SEQ ID NO: 879 - DNA, 4429 bp, Gossypium raimondii
tcacaagaaaacgtcgtcgtaaaagccgtgaaatgggaagggaagtctcctccgtcataagactatacagaaaaatcacagaagttgcaatactggcactaaaaaaggctcagatcttaaagaaaacagagaatcgaaaactctctctttcctttttgaataaatccgaagatacaaaggcgctttcatttttgtaattaattttagatgctgaatcagatctaagacgttggttttagttcgatttctgcggagacttagcttccggagagaaaggaaaagaagaagaagaagaagatgttgacgaagtttgagacgaagagtaatagagtgaagggactgagtttccacgctaagaggccttggatcttagctagtctccacagtggcgttatccagttatgggactatcgaatgggaaccctgattgatcgattcgacgaacatgatggccctgttcgcggcgttcatttccacatgtctcagcctttgtttgtctctggaggggatgactacaagataaaggtctggaactacaagttgcatagatgtcttttcacccttcttggacatctggattatattcgtactgtgcaatttcatcatgagcatccgtggattgtgagtgctagtgatgatcagactattcgcatttggaactggcagtcacgaacttgcatttcggtgttgactggtcataatcactatgttatgtgtgcttcattccatcctaaagaagaccttgttgtgtcagcctcccttgatcagactgttcgggtctgggatattggttccttgaaaaagaagactgcctcccccgcggatgacattctacggttgagtcagatgaacacagatctttttggtggtgttgatgcagttgttaagtatgtgttggaaggtcatgacagaggtgtaaattgggctgcatttcatcccactctacctttgatagtctctggagcagatgatcgccaagtaaaattatggcgcatgaatgagacaaaagcttgggaagtggataccttgagagggcacatgaataatgtgtcatgtgttatgttccatgccaaacaagatatcgttgtatctaattccgaggataagagtattcgcgtgtgggatgtaacaaagcgaactggacttcaaactttccggcgagaacatgacagattctggattcttgctgttcatcccgaaatgaatgttttggcagctggacatgacagtggcatgattgtatttaagctagagagagagcgacctgcttttgcagtgagtggggattctctgttttatgccaaggatcggtttttaaggtattttgacttttcatctcaaagagagacacaagtaattccaattcggcgtcctggttcttcaagtctgaatcaaagcccaagaactctttcttacagccctacggaaaatgctgttcttatctgctcagatgtggatggaggatcttatgaattgtatgtggtaccaaaagacagctctgctaggagtgacagtttgcatgaggcaaagaaaggtctaggcagttctgctatatttgtggctaggaaccggtttgctgttcttgacaaaggaaacaaccaagtcttaatcaagaatctgaaaaatgaggtggtgaaaaagagtggtctgcctgtgcctactgatgcaatattttatgctggaacaggtaacttgttgtgtaggtctgaggatagagtagttatatttgatctccagcagaggcttattcttggtgatcttcaaaccccttttgtgaagtatgttgtttggtctaatgacatggagagtgttgctttgctcagcaagcataccattgtcattactaacaagaagcttgtgcatcagtgcactcttcatgagacaatacgtgttaagagtggagcttgggacgagaatggtgtttttatttacaccaccttaaaccatgtaaaatactgccttcccaatggagatagtggaatcatccgaacgcttgaggttcctatatacataactaaggtttctggcaatactatattttgcctggatcgtgatgggaagaataagactatcgtcattgatgttaccgaatacgtttttaagctatctctgcttcggaagagatatgatcatgttatgagtatgataaggaactcccagctttgtggtgaggccatgattgcttatctgcaacagaaggggttccctgaagtggcactccattttgtcaaagatgagaaaacacgctttaatttggctctagagagcgggaacattcaaattgccgttgcatcagccaaggagatcgatgacaaagatcattggtataggttgggtgtggaggctcttcgccaaggcaatgcaggtatagtggagtatgcctaccagaggacaaaaaactttgagaggttgtcatttctttacctcgttaatggtaacatcgaaaagctgtccaagatgctgaaaattgcagaagttaagaatgatgttatgggtcagtttcacaatgctttgtacctgggtgatatacaggaacgagttaagatcttggagaatgctggtcacttacctcttgcttatattacagcatctgtccatgggctacaggatgttgctgaaaggttagcagctgagttgggagatgatgtccctcctttgccagtgggtaaagaaccttcgttattgatacctccaacccctgttacatgtggtggtgattggccccttttgagagtcatgaaaggcatatttgatggtggattggatagcattggcaggggtgctgcggatgaagaggagggtgaagaaggtgattggggtgaagatcttgatgtggttgatgttgatggtatacagaatggtgatgttagtgtaaatttcgaggatggggaagtggctgaaggaagtgaagaggagggtggttgggaccttgaagatttggaacttcccccagaggcagacaccccaaaggtttctggcaatgcccgttctatttttgttgcaccaactcccggtatgcctgtaagtcagatttgggttcagaaatcatctcttgctgctgaacatgcagcagctggcaattttgatacagcaatgcgtttgctgagcagacaacttggcataagaaacttttctcctttgaaatccttgtttcttgatcttcacactggcagccatagctatcttcgtgcattttcatccgctccagttgtgtcgttggcagttgagaggggatggagtgagtctgctagtcctaatgttaggtgtccgccagccctggtattcaatttctctcagttggatgaaaagctgaaggctggttacaaggccacaacagctggaaaatttactgaggcactccggctcttcctcagcattcttcatactattccgttgattgttgtggagtcaaggagagaagttgatgaggtcaaggagctaattattattgccaaggagtatgttcttggtctgcagatggagcttaagcgaagagaaatgaaagacaatccagtacgccagcaggagcttgctgcctacttcacccactgcaaccttcaattaccacacctaagacttgccctgctgaatgcaatgactgtctgctacaaggcaaagaacctggctacggcaggtaactttgcccggcgactgctagaaacaaaccccacaaatgagaatcaagcgaagacagccaggcaagtacttcaagctgctgagaggaacatgacagatgcttctcagctgaactatgatttcagaaatccatttgtgacatgcggggcaacttatgtgcctatttaccgagggcagaaggatgtatcgtgcccatattgtactagtcgctttgtgcctagccaggaagggcaattgtgtacagtgtgtgatcttgcattggtcggggcggatgcatcagggttgctgtgttctgcttcacagatacgatgaggcaacaaaagttggatccacttttgaacttaatcctgctgatccttttagctgcaaaacccatcctcagcgatcaactcatatctgcagtttaaaaggtcagattttactttagaaattattgagaactgaaattaatttgtttgtgctatttccttctgttttgtctttttccggcttaatagagttcattatgattttcgtatgtaagaatgaatttggatttataattttctggatattcgcgttttttgtggtttcatagaccaaaaatagaagagtcacggaggccctgttaaatgatgattgttagtcacagttagcacttattatctgattcttcgtttctcatttccttaaagagtatccatgtcttgacatttacttggatgcgagtacaaggtacgattatctaaacatgatatataaatatattttaaaatttgagtatattttatgtccaacactcacgttgaaattg

SEQ ID NO: 880 - DNA, 4230 bp, Gossypium raimondii
tttttgtgttgaaaatgatagatagataaaagttattatcacttaataaaaaatattttcaattacttcaattttatttattttaatattatattatcctataaaaattttagatttaaaatttaatttttgaaatatctaagaatcaaaaatattttttatttaaatatatatttatcaaaaaatctaattatattttttataattatcaaacaaattttataaattcaatttaatacttacactacaaaagttcccttttaccgcacaaaaacggcaccgtaagataggttgaagaaacaataataaaattcctagatttctaggctcagatcttaaataaaaatttcatgaagagaggatccaaaactctctgttttcttttcatttaaacccaaattcaatttcttctcatttcttgttcttaattttagatgctgtatcagatctgagagaattagaagttggagataaaggaacaaaaatgttgacgaagtttgagacgaagagtaatagagtgaagggactaagtttccacaccaagaggccgtggatcttagctagtcttcacagtggcgttattcagttatgggactatcggatggggactttgattgatcgatttgacgaacacgatggccctgttcgtggtgtccattttcacatgtctcaacctttgtttgtctctggaggggatgactacaagataaaggtctggaactacaagttgcatagatgtctttttacccttcttggacatcttgattatattcgtactgtgcaatttcatcatgaacatccatggattgtgagtgccagtgatgatcaaaccattcgcatatggaactggcagtctcgaacttgcatctctgtgttgactggtcataatcactatgttatgtgcgcctcattccatcctaaagaagacctggttgtgtcggcctcccttgaccagactgttcgagtttgggatgttagttccttgaaaaagaagggtgcctccccagcagatgacattttacggttgagtcagatgaacacagatctttttggtggtgttgatgcagttgtcaagtatgtgttggaaggacatgaccgaggagtaaattgggctgcatttcatccaactttacctttgatagtctctggtgccgatgaccgccaagtgaaattgtggcgtatgaatgataccaaggcttgggaagtggataccttgagaggacacatgaataatgtgtcatgtgtcatgttccatgccaaacaagacatcattgtatccaattccgaggataaaagtattcgagtgtgggatgcaacaaagcgaactggacttcaaactttccgtcgagaacatgacaggttctggattcttgcagcccatcctgagattaatcttttggcagctggacatgacagtggcatgattgtatttaagctagagagagaacggcctgcttttgcagttagtggggattctctgttttatgccaaggatcgattcttaaggtattatgacttttcaacacaaaaagagacacaaatagttcctatccggcggcccggttccacaaccttgaatcaatgtccaaggactctttcttatagtcccacagaaaatgccgtccttatctgctcagatgttgatggaggaacttatgagttgtatcagataccaaaagacagcattggtaggagtgacttgcaggaggcaaagagaggtcctggtagttctgccatatttgtggctcggaaccgttttgctgtactcgacaaaagcaacaaccaagtcttaatcaagaatcttaaaaatgaggttgttaaaaaaagcggtcttccagtgcctacagatgcaattttctatgctggaacaggtaatttattgtgtagatcagacgatagagtggttgtatttgatctccagcagagacttgttcttggtgatctacaaacgccttttgtgaagtatgttgtttggtctagtgacatggagagtgttgctttgctcagcaagcattccattatcattactagcaagaaacttgtgcaccagtgcacttttcatgagacaatacgagttaagagtggagcctgggatgaaaatggtgtttttatttacaccactctaaaccatataaaatactgcctacccaatggagatagtggaataattcgaactcttgatgttccaatatacctaactaaggtttctggaaacaaaatattttgcctggaccgtgatgggaagaacaagacgctggtcattgatgctacagaatacatttttaagctgtctctgcttcggaagaggtatgatcatgttatgagcatgataagaaactcccagctttgtggtgaggccgtgattgcttatctacaacagaaggggttccctgaagtggctctccattttgtcaaagatgagaaaactcggtttaacttggctatagagagtgggaacattcaaattgctgttgcatcagctaaggagattgatgacaaggatcattggtataggttgggtgtggaagcccttcgccaaggcaatgcaggtatagttgaatatgcctaccagaggacaaagaactttgagaggttgtcgtttctttatctcataaatggtaacctggaaaagctgtccaagatgctgaagattgcagaagtcaagaacgatgttatgggccagtttcacaatgctttgtatcttggtgatatccaagaacgtgtaaagatcttggagaatgctggtcatttgcctcttgcttatgttacagcatcagtccatgggctacatgatgttgcggaaaggttagctgctgagttgggagatgatgtcccttctttgccggaagggaaaaaaccttccttattgatgcctccggcacccgttatttgtggtggtgattggcccctgttgagagtaatgaaaggtatatttgaaggtggattcgatagtactggcaggggtgcggtggatgaagaggaggagggtgcagatggtgattggggtgaagatcttgatatggttgatgctgatggcttgcagaacggagatgttactgcaattttggaggatggggaagtggctgaagacaatgaagagggtggatgggaccttgaagacttggaactccctcctgaggtagagacaccaagggttaatgctcgttcttctgttttcgtggcaccaactcctggcatgcctgtgagtcaaatttggactcagagatcgtcacttgctgctgatcatgcggccgctggcaattttgatacagccatgcgtttgctaagcaggcaacttggaataagaaactttactcctttaaaatccatgtttcttgatcttcacactggcagccatagctatcttcgtgcattttcatctgcgccagtggtgtccttggcagttgagaggggatggagtgagtcttctagtcctaatgtgaggggtccacctgctctcatattcaacttttctcagctggacgaaaagctgaaggctgggtacaaggccacaacagatggaaaatttaccgaggctcttcggctttttctcaacattcttcatacaattccattgattgttgtggagtcaaggagggaagttgatgaagtcaaagagttaattatcatcgccaaggagtatgttcttggtctgcagatggagcttaagcgtagagaattgaaagacaatccggtacgccagcaggagcttgctgcctacttcacccattgcaaccttcaaatacctcatctcagacttgctctgcgaaatgcaatgaccatctgtttcaaggcgaaaaacctggctacagccgctgactttgccaggcgtcttctagaaacaaaccctaacgagaaccattcaaaggcagcgaggcaagtactccaggcttcagagaggaatatgacagatgcatctcagttaaactacgatttcaggaacccttttgtgacatgcggggcaacttacgtcccaatttaccgaggacagaaagatgtatcttgcccttactgtactactcgctttgtgcctacccaggaaggtcaattgtgtacaatctgtgatctcgctgtcattggagcagacgcatcaggtttgctctgttctccttctcaaattcgatgattaagctctgcatactcgaggcatgtttccttcaatcttgctcaacctttgagcagccagccgaaccaatcacatcgatcgaattcttatccacaggtaaaaag

SEQ ID NO: 881 - DNA, 4119 bp, Euphorbia peplus
agaacaaccctctcctcattctctcacaacattcttattctccgatctacccctaccttcgatctctaattacgccattgccctacgctatccttctctgcggatgcatactttcctacatcagatctaaggagatatttgtgtgattggggaagatgttgacgaagttcgaaacgaagagtaatagagtgaagggattgagttttcacagtaagagaccgtggatccttgcgagtctccatagcggtgtgatccagctatgggactaccgtatggggactctcattgataggtttgatgaacatgatggtcctgttcgtggcgttcacttccacaaatctcagcctctcttcgtctctggaggtgatgattacaagattaaggtttggaactacaagatgcacagatgtttgtttacacttcttggacatctggattacatccgtactgtgcaattccatcatgaatacccatggattgttagtgccagtgacgatcagaccatccgaatttggaattggcaatcacgtaattgcatttctgtgttaactggccacaatcattatgtcatgtgtgcctcattccatcctaaagaagacctagttgtctctgcctctcttgatcagactgttcgagtatgggatattggtgctttgagaaagaaaacagtgtctcctgctgatgacattctgcggttgagtcagatgaatacagatctttttggtggggtggatgctgttgtcaagtatgttttggaaggtcatgaccgaggagtcaactgggctgcattccaccctacccttcccttgatcgtctctggagcagatgatcgtcaagtgaaattatggcgcatgaatgacaccaaggcttgggaagtggacaccctgagaggacacatgaataatgtgtcatgtgttatgttccatgccaaacaggatatcattgtttcaaattctgaggataaaagcattcgagtttgggatgtaactaaacgaacaggagttcaaactttccgtcgcgagcatgatcgtttctggatccttgcatctcatcctgagatgaatctcctggctgcaggccatgacagtggtatgattgtctttaagctagagagagaaaggccagcgtttgcagtaagtggtgacagtttgttctacgccaaagatcgctttttacggttctttgagttttcaactcagagagatactcaagtgattcccatccgccgacctggtaccaccagcctgaatcagagtccaaggacactttcgtatagtccgacagagaatgctgttcttatttgctcagatgtggatggtggatcttatgaattgtacgtgataccaaaagacagtattggtaggggcgatactgttcaggaggcaagaaggggcactgggggatcagctatctttgtagctaggaacagatttgctgtgcttgacaaaagcagcaaccaggttttggtcaaaaatttgaagaatgaggtggttaaaaagagtgggctcccccttgctgcagatgcaatattctatgctgggacaggcaacttgctttgcagggcagaagatagagtagtcatatttgatctccagcagaggattgttcttggggatcttcaaacaccttttgtgaagtatgttgtgtggtccaatgacatggaaagtgttgcattgcttagtaaacatgccatcatcattgctagcaagaagcttgtgcaccagtgcactcttcatgagacaattcgtgtaaagagtggagcgtgggatgaaaatggtgtctttatctatacaactttaaatcacattaagtactgcctccctaatggggatagtggaataatcagaactcttgatgtaccaatatacattacgagggttactggaaatactatcttttgcttggatagagatggaaagaatagagctattgtcattgatgctactgagtacatcttcaaactttctcttttgaagaaaagatatgaccatgttatgaacatgattaggaactctcagctctgtggacaggcaatgattgcttatttacaacagaagggttttccagaagttgctctacattttgtgaaggatgagaggactcgattcaatttggccctcgagagtggaaacattcagattgctgttgcatcagcaaaggaaattgatgagaaagatcactggtatagattgggggtggaagctcttcgccaaggaaatgccgggattgttgaatacgcctaccagaggaccaaaaattttgagaggctttctttcctttatctcatcactggaaacttggaaaagctttccaaaatgttaaaaattgctgaagttaagaatgatgtcatgggccagtttcacaatgccttgtatttgggagatgtccaagagcgtgtcaagattttagagaatgctggccatttgccacttgcatatataactgctaaaacccatgggcttgaggatgttgctgaacgactagctactgagttaggagatgatattccatcattgccaaagggaaaagtgccctcccttctgatgcctccagctcccattatgtgtggaggagattggccactcttgcgtgtcatgaaaggcatatttgaaggtggactggacaatgtgggtagaggtgctgttgatgaggaggaggatgatgttgatgcgggtgattgggctcaggagctggatgatgtagatgacgtagcaccgaatggagatgcttcagcaatttcagaggatgtagaaatggctgaagagaataatgatgggggaggatgggagcttgaagatttggagctcccccctgaggcagacacaccaagggcttccataagtgctcggtcctcggcttttgtagccccaaatcctggcatgcctgtaagccaaatctggatccagaggtcatcacttgctgctgaacatgctgcaggcggaaacttcgatactgctatgagattactaaacaggcaactcgggattagaaactttggtccattgagatccatgtttcttgatcttcatgcaggtagccatacctatttacgtgcagcttcatcaactccagtgatatctctagctattgaacgtggatggagtgagtctgctagccccaatgtgaggggtcctccagcattggtgttcaatttttctcagttggaggagaagcttaaggctggttacagagccacaacagcagggaaattcactgaggcacttcgtctctttatcagtattcttcatacaattccattgattgtagtggagtcaaggagggaggtggatgaagtcaaggagttgataaatatagtaaaagaatatgttcttgggctaaagatggagcttaagaggagggaattgaaagatgatccaatacgccaacaggagcttgctgcctacttcactcattgcacccttcaaatgcctcatttaaggcttgccctcttaaatgcaatgactgtttgctacaaggccaagaacctcgctactgcagctaactttgccaggcggcttctggagacaaaccccacagttgagaaccaggcaaagatggctaggcaagtattgcaggcagcagagaggaacatgacagatgtctcagagctgaattatgatttcagaaacccgtttgtgacatgtggtgcaacatatgtcccaatttacagagggcaaaaggatgttccttgcccgttttgtagttccagattcgtcccaactcaggaaggccaactatgtgctgtttgtgatcttgcagttgtcggggcagatgcttcaggtttgttttgctctccttcccaggtacgatgatcatcgagatgccagatcaagaaatattaccaattattttctgcccaacgatcaagtggtgagagatactgtagaagagttaagtgccaatgaatttgtttgtgctttctttctttatttttggcttccttatccaaatcttattactaccttttacttagtcttcttttataattttgaatgtaataaataactttaagaattttgattttgcgctattcttgtttagctgttcagacaagataagtcgagggctcttgttaattagataatcattttacatatcagtgtatgcacactatgcagg

SEQ ID NO: 882 - DNA, 4673 bp, Theobroma cacao
gtttatttgaaaacgaagcagcaccaagacgtgtgatgcagtgatagcaccgtcctgaaaaaacacaaacatcttgcgctgaaaacccgaaaaccaagagaataaaaaacggagcttttgtatctttcttttctaggtttttccttttcctcattgacagatctgcgatactctcttccgatcatctccttaacgtacacgttattaactttgcttatcctgtgccaacttgttggcagatctaccaatttctcaataccgtttcaatttgcaatgctcgtttcttcttgatccccaatctctcaggattgcgttttgactttggatcttgagagggagagagtgaagatgttgacgaaatttgagacgaagagcaatcgggtgaaagggctgagctttcacagcaagagaccatggatcttagcgagtctacacagcggcgtgatccagctgtgggattataggatggggactctcattgatcgattcgacgagcacgatggccccgtccgtggcgtccatttccacaagtcccagcctctctttgtctctggaggggatgattacaagatcaaagtttggaattataaactgcatagatgtctgtttacacttcttgggcacctggattatatacgtactgttcagtttcatcatgagtatccatggattgttagtgcaagtgatgaccaaacaatcagaatatggaattggcagtctcggacttgcattgcagtgctaactggacacaatcactatgtcatgtgtgcctcattccatcctaaggaggacttggttgtttcagcatccttggaccaaacagttcgtgtgtgggatattggcgccctgaagaagaaaacagttgcccctgccgatgacatcctgcgtttgggtcagttgagccagatgaacacagatttctttggtggggtggatgctgttgttaaatatgtcttggagggtcatgatcgaggagttaactgggcctcgttccatcccactcttcctctaattgtctcaggggcggatgatcgacaagtgaaactttggcgaatgaatgatacaaaggcttgggaagttgacactatgagagggcacatgaataacgtgtcatgtgttttattccattcaaggcaggacatcattgtgtctaattcagaggataagagtattcgagtgtgggatgctaccaagcgtactggccttcagacatttcgcagggagcacgacaggttctggatacttgcatgtcatcctgagatgaaccttatggctgctggtcatgatagtggcatgattgttttcaaactggagagggaacgccctgctttttctgtgagtggtgattcaatgtactatgttaaagaccggtttttgcgcttttatgaattctcaactcagaaagacactcaggtgatcccaatccgtaggcctggttctaccagtttaaaccaaggggcaagaacactttcttatagccccacggaaaatgctattttggtctgttcagaattggatggaggctcctatgaactttacattatacctaaagacagttttggcagaggtgagtctgttcaagacgcaaaaaaaggtattggtggatcagcagtttttgttgctcgaaataggtttgctgtacttgacaagagcagcaatcaagtattagtcaagaaccttaaaaatgagattgtgaaaaaagttgccattccaattattgttgattcaatattttatgctggaaccgggaacttgctatgcaaagcagaggatcgagtaattatctttgacctccaacagaggatgattcttgcagagcttcaaacttcttttgttaggtatgttgtttggtcaaacgatatggagagtgttgccctgctgagcaaacattcaatcataatagccaacaagaagctcgtgaatcaatgtactctccatgaaacaatccgtgtaaagagtggggcttgggatgacaatggtgtcttcatatacactacactgactcacatcaaatactgccttcccaatggggacaatggagttattaggacccttgatgtaccagtgtacatcacgaaagtgtctggaaacaccatgtgttgcttggacagagatgggaaaaatcgtgccatagtatttgatgcaactgagtatgtatttaagctgtccctcctgaaaaagagatatgatcatgttatgagcatgattaggagttctgagctctgtgggcaagccatgattgcatacctccagcagaaaggcttccctgaggttgctcttcattttgtaagggatgaaaggacacgcttcaacttggcactagagagtggtaacatccagattgcagttgcttctgccaaggaaattgatgagaaagatcactggtatcgcttgggggtggaggcccttcggcagggtaatgcaggcattgttgaatatgcttaccagaggacaaaaaatttcgacagactatcatttctctacctcatcacagggaacatggataagttatcgaaaatgctaaaaattgctgaagtcaagaatgatgtcatgggtgagttccacaacgctctatacttgggtgatatcaaagaacgtgtcaagatattggaaaatgctggccatttgccacttgcttacatcactgctgcagttcatgggctccatgatattgctgagcgtctagctgctgacctgggagatgatattccctctttgcctgagggtagatctccatcccttttgacacctccaagtcctgtcttatgcggtggagattggcctttgttaagggtaatgagaggagtatttgagggtggtcttgataatgttggcagaaatgctcaggaagaagatgaagaggctgctgatgctgattggggtgaggatttggatattgttgatgtggaaaacatgccaaatggagacgtcagtatggcccttgtggaagaagcacatgaagagaatgatgagggaggatgggatcttgaggatcttgaacttccacctgaaatgggtactccaaaaactgctggcaatgctcattcatctgtttttgttgcccctactccaggtatgcctgtaagtcaaatttggatccaaaaatcatcccttgcagctgaacatgctgctgcaggcaattttgataccgccatgcgtttgttgagccggcaattgggtatcaggaatttcgctcccttgaaacaattattccttgacttgcaagtgggcagccattcttatcttcctaccttttcctctgcccctgtcactcttgtggcagtggaaagaggatggactgaatcagcaagtcctaatgtaagaagcccgcctgctcttgtttttaagttttatcagctggaggagaagctcaaggccggttacaaggccacaacttctggaaagtttacagaggctttacggctctttcttagtattcttcacaccattcctttgatcgttgttgactctaggagagaggttgatgatgtgaaggaattgatcatcattgtgaaggagtatgttcttggtttgcaaatggagcttaaaaggagggaacttaaggacaatcctgtacgtcaacaagagctagcagcctacttcacccactgtaaccttcagccacctcacatgagactggcattgctgaatgctatgactgtttgctacaagaatggtaatctaatgacagctgctaacttcgcaaggcgattgttggagaccaatcccaccaatgaaaaccaagcgaaaactgcccgtcaagtcctgcaagcggccgagagaaacacgaacgacaaagtccagctgaactatgatttcaggaacccattcgtagtttgtggggcaacttatgtgcctatataccgtggacagaaggatgtctgctgcccttactgcagttcacggtttgttccatcccaggaaggtcagctttgtcctgtctgtgatctcgcagtggttggatcagatgcatctggtttactttgttccccttcccaaatgagatgattccaagaccaaggtctttcggaccaattttcagttctttccatctccatcaacagttaagcagagtgtgttcaatcagattgtatatacgatattattattttttttattctatttttttactgccagcttatttcaattccttacgttctcctctacggtatgatattcactgtaataaactcgagaattttggcttagaatattcttattactcgtgagtagtagtgcatcagtttgagatggcgaattcaatgtatgcacgaaaacgattgctttccatccctaaactgagatcaccgacgacctaccattatcgcacaaaacttaattccaaatatatatatattttttaaaaaataataataacaataataaaagaaaagaaaaagcgatgaacagttactgcaacgaaagaccttttttccccacaagtgtttgagaatgtcagctgtaaaatggagtgttgctttaaaggaatcatcacaacaagttaacatcacttttccagattaaaaaaaaaaaagaaaaagaaagaacctttcgccacgagtagaaacaggtcagggaaggggtttctgtttccgttgcgagggcatcagttttaaagaggggtcgtaggtttgtcaaaaagttagtacacctaggcacgtgacaggggcgag

SEQ ID NO: 883 - DNA, 4120 bp, Panax ginseng
tctctcctcctcagatcgcgatctacgagcctataaatttctctctatatgtatgtatatgtttctgttccataagcggtttatcgaatctgatttgattagaagttatcaaatctgaggtaaaagttgcttttactatttgtaaattcgttgaatctgaggacttttatttttgcagatcggtagtcgattaatctcataaggtttttaatttgttgctgaattatgttatcacttgaattttattctattttgtgtttacactttcattgatctgatctgaatgtttgtatttcgattttgaacgtgcaattaggttttggtttgtggattttgagtgtagaaattgttgacgaaatttgaaacgaagagtaatagagtgaaaggactgagttttcattgtaagagaccttggattcttgctagtcttcacagtggtgtgatccagctatgggattaccgaacggggacactcattgataggtttgatgagcatgatggacctgttcgtggtgttcattttcacaaatctcagcccctttttgtttctggaggagatgactataaaattaaagttttggaattacaagttgcataggtgtttatttactcttcttggacacctcgattacatccgcactgtgcagtttcatcatgagcatccttggattgtgagtgcaagtgatgaccagactatcagaatctggaattggcagtcacgcacttgtatctctgttttgactgggcacaaccattatgtaatgtgcgctttattccacccaaaagatgaccttgttgtatcagcatcacttgatcagacagttcgtgtctgggatattggtgcccttaggaagaaaactgcatctcctgctgatgatattctgcgtttgagtcagataaacactgatttttttggtggcgttgatgctgtggtcaagtatgtattggaaggtcatgaccgtggagtcaactgggcttcatttcatcccaccttgcctttaattgtgtcgggggctgatgatcgtcaagtaaagctgtggcgtatgaatgatacaaaggcttgggaagtggacacattgagaggacacatgaataacgtttcatgcgtcctttttcatgccaagcaggatataattgtttccaactcagaggacaagagtattcgtgtttgggatgcaacaaagcggactgccatccaaactttccgtcgtgagcatgaccggttttggattcttgcatctcatccggagatgaatctgctggcggctggtcatgatagtggggttattgtttttaagttggagagagaaaggcctgcgttttcggttagcggtgattctatgttctatgcaaaggatcgctttctgcggttttatgagttttcaactcagagagaaacacaagttattccaataagacgccctggctctactagtttgaatcagagtccgcgaactctgtcatacagtcctacagaaaatgctgttcttatctgttctgatattgaaggtggatcttatgagctttatatcatacctaaagacggtattagcaggggagatacggtgcaagaggcaaaaagaggtattggtggatcggctatttttgtggctcggaatcgttttgctgtgcttgacaaaaccaacaatcaagtgttggtcaagaacctgaagaacgagattgttaaaaagagtgttctaccgatagctgctgatgcaatattctacgccggaacaggtaacttgctttgtagggcagaggacagagtggttatatttgacctccagcaaaggattgttcttggtgatcttcaaacaccttttgtgaagtatattgtctggtcgaatgacatggagaacattgctttgcttagcaaacatgcaatagtggttgctagtaagaagcttgtgcaccaatgcacacttcatgaaacaattcgagtcaagagtggtggctgggatgataatggagtttttatttatacgactctgaatcacatcaagtactgcctacctaatggagacagtgggataataaagacgcttgatgtcccgatatacatcacaaaagtttcggggaataagatctattgcttggatcgtgatggaaagaacaaggtggtagttattgacgctacagaatatattttcaagctgttcttgttgaagaagaaatacgacaacgttatgagcatgataagaaactcgcagctctgtgggcaggcaatgattgcttatttgcagcagaaggggtttcccgaagttgctctccattttgtgaaagatgagagaactcgttttgggcttgcattggagagcggaaacattcagactgcagttgctgcagctaaggaaattgatgagaaggatcactggtataggttgggggttgaggcccttcgccagggtaatactggtattgttgaatacgcttatcagaggacaaagaattttgagaggttgtctttcctttatcttataactggtaatattgaaaaactgtccaagatgcttaaaattgctgaagtcaagaatgatgtgatgggtcagtttcataatgctctttatcttggtgacattcaagagcgtgttaagattttggagaatgctggacacttgccgcttgcttatatcacggcttccgttcatggtctacaggatggtgctgaacggctagcagccaagttgggagacaatgttcccaccttgccaaatcgtaaggcaccctcccttcttatgcccccaatcccaatattgtgtggtggagattggcccctcttgagggtcatgagaggcatttttgagggtgggctggacaatattggtaagggtgctcctgaggaggatgatgaggctgctgatgctgactggggtgaagaattggatatggttgatgtggatgatgccttggaggatggggtagctgctgaggaaaatgaggaagatggaggatgggaccttgaggaattggagcttcctcctgaggcagatactcctaaggtctctgttaactcttgctcgacatttgtagccccaactcctggcatcgctgtaagccagatttggactcagagatcatctcttgcagctgaacattctgcagctggtaattttgacactgctatgcggttgttaagccggcagttaggaataaaaaactttgctcctttgaaatcaatgtttcttgagcttcacactggcagccatacttatctacgcgcgtttgcatctgctccagttttatcagttgcggtggaacggggatggactgaatctgctagccctaatgtaaggggtccaccctcactagtgttcaatttctctcagttggaagagagactgaaggctggttacaaagcgacgacagctgggaaattctctgaagctcttcggctattcctcaatattctacacactatccctctgattgtcgttgagtcaagaagggaagttgatgaagttaaggaattgattattatagtgaaagaatatgttttgggtctgcagatggagctgaagagaaaggagctcaaagacaatcctatccgccagcaggagcttgcagcctatttcacccactgcaaccttcaagtaccacatttgaggctagcgctacaaaacgcaatgactgtatgttttagggccaagaaccttaatacagctgccaactttgctagaagacttttagagaccaacccaaccaacgagaaccaagccaagacggccaggcaagtgctgcaggctgctgagaagaacatgaaagatgtgtctcagctgaactatgatttcagaaatccttttgtgatttgtggggccacacatgttcccatctaccgtggccagaaagatgtgtcatgcccatactgcagttcccggtttgtgccaagccaagacgggcagctttgtactgtttgtgatcttgcagcaatcggggcagatgcttcaggtttgttatgttctccatcgcagataagatgatgaatctgctgaaccatgagcacacataatagacctttactatacgcagtgagatgttccatgttgtatctttccactatttctgcaggcaatggtgatgatattagaactaaattcttgttcctattaagttgagtgtgtct

SEQ ID NO: 884 - DNA, 4095 bp, Gossypium hirsutum
agcaataataaaattccaagatttctaggctcagatcttaaataaaaatttcataaagagaggatccaaaactctctgttttcttttcatttaaacccaaattcaatttcttctcatttcttgttcttaattttagatgctgtatcagatctgagagaattagaagttggagagaaaggaacaaaaatgttgacgaagtttgagacgaagagtaatagagtgaagggactaagtttccacaccaagaggccgtggatcttagctagtcttcacagtggcgttattcagttatgggactatcgaatggggactttgattgatcgatttgacgaacacgatggccctgttcgtggtgtccattttcacatgtctcaacctttgtttgtctctggaggggatgactacaagataaaggtctggaactacaagttgcatagatgtctttttacccttcttggacatcttgattatattcgtactgtgcaatttcatcatgaacatccatggattgtgagtgccagtgatgatcaaaccattcgcatatggaactggcagtctcgaacttgcatctctgtgttgactggtcataatcactatgttatgtgcgcctcattccatcctaaagaagacctggttgtgtcggcctcccttgaccagactgttcgagtttgggatgttagttccttgaaaaagaagggtgcctccccagcagatgacattttacggttgagtcagatgaacacagatctttttggtggtgttgatgcagttgtcaagtatgtgttggaaggacatgaccgaggagtaaattgggctgcatttcatccaaccttgcctttgatagtctctggtgccgatgaccgccaagtgaaattgtggcgtatgaatgataccaaggcttgggaagtggataccttgagaggacacatgaataatgtgtcatgtgtcatgttccatgccaaacaagacatcattgtatccaattctgaggataaaagtattcgagtgtgggatgcaacaaagcgaactggacttcaaactttccgtcgagaacatgacaggttctggattcttgcggcccatcctgagattaatcttttggcagctggacatgacagtggcatgattgtatttaagctagagagagaacggcctgcttttgcagttagtggggattctctgttttatgccaaggatcgattcttaaggtattatgacttttcaacacaaaaagagacacaaatagttcctatccggcggcccggttccacaaccttgaatcaatgtccaaggactctttcttatagtcccacagaaaatgccgtccttatctgctcagatgttgatggaggaacttatgagttgtatcagataccaaaagacagcattggtaggagtgacttgcaggaggcaaagagaggtcctggtagttctgccatatttgtggctcggaaccgttttgctgtactcgacaaaagcaacaaccaagtcttaatcaagaatcttaaaaatgaggttgttaaaaaaagtggtcttccagtgcctacggatgcaattttctatgctggaacaggtaatttattgtgtagatcagatgatagagtggttgtatttgatctccagcagagacttgttcttggtgatctacaaacgccttttgtgaagtatgttgtttggtctagtgacatggagagtgttgctttgctcagcaagcattccattatcattactagcaagaaacttgtgcaccagtgcacttttcatgagacaatacgagttaagagtggagcctgggatgaaaatggtgtttttatttacaccactctaaaccatataaaatactgcctacccaatggagatagtggaataattcgaactcttgatgttccaatatacctaactaaggtttctggaaacaaaatattttgcctggaccgtgatgggaagaacaagacgctggtcattgatgctacagaatacatttttaagctgtctctgcttcggaaaaggtatgatcatgttatgagcatgataagaaactcccagctttgtggtgaggccgtgattgcttatctacaacagaaggggttccctgaagtggctctccattttgtcaaagatgggaaaactcggtttaacttggctatagagagtgggaacattcaaattgctgttgcatcagctaaggagattgatgacaaggatcattggtataggttgggtgtggaagcccttcgccaaggcaatgcaggtatagttgaatatgcctaccagaggacaaagaactttgagaggttgtcgtttctttatctcataaatggtaacctggaaaagctgtccaagatgctgaagattgcagaagtcaagaacgacgttatgggccagtttcacaatgctttgtatcttggcgatatccaagaacgtgtaaagatcttggagaatgctggtcatttgcctcttgcttatgttacagcatcagtccatggtctacatgatgttgcggaaaggttagctgctgagttgggagatgatgtcccttctttgccggaagggaaaaaaccttccttattgatgcctccggcacccgttatttgtggtggtgattggcccctgttgagagtaatgaaaggtatatttgaaggtggattcgatagtactggcaggggtgtggtggatgaagaggaagagggtgcagatggtgattggggtgaagatcttgatatggttgatgctgatggcttgcagaacggagatgttactgcaattttggaggatggggaagtggctgaagacaatgaagagggtggatgggaccttgaagacttggaactccctcctgaggtagagacaccaagggttaatgctcgttcttctgttttcgtggcaccaactcctggcatgcctgtgagtcaaatttggactcagagatcgtcacttgctgctgatcatgcggccgctggcaattttgatacagccatgcgtttgctaagcaggcaacttggaataagaaactttactcctttaaaatccatgtttctcgatcttcacactggcagccatagctatcttcgtgcattttcatctgcgccagtggtgtccttggcagttgagaggggatggagtgagtcttctagtcctaatgtgaggggtccacccgctctcatattcaacttttctcagctggacgaaaagctgaaggctgggtacaaggccacaacagatggaaaatttaccgaggctcttcggctttttctcaacattcttcatacaattccattgattgttgtggagtcaaggagggaagttgatgaagtcaaagagttaattatcatcgccaaggagtatgttcttggtctgcagatggagcttaagcgtagagaattgaaagacaatccggtacgccagcaggagcttgctgcctacttcacccattgcaaccttcaaatgcctcatctcagacttgctctgcgaaacgcaatgaccatctgttgcaaggcaaaaaacctggctacagctgctaactttgccaggcgtcttctagaaacaaaccctaacgagaaccattcaaaggcagcgaggcaagtactccaagtttcagagaggaatatgacagatgcatctgagttaaactacgatttcaggaacccttttgtgacatgcggggcaacttacgtcccgatttaccgaggacagaaagatttatcttgcccttactgtactactcgcttcgtgcctacccaggagggtcaattgtgtacaatctgtgatctcgcagtcatcggagcagacgcatcaggtttgctctgttctccttctcaaattcgataattttgaactacataatcgaggcttgtttctttaatcttgctcaacctttgagcaactgccgtaccagtcacgtcggtagtcagagggcccttgtttaaaatagataatggtcatatctcatatataggacaattacatgttaatgtgtgtcaaatttgctcacttctctttgattacctttttttttttctttttttcaaggttcccattgcttggtattttttcctattgaagtacctgaaccttttgttgtgttgcattgcactc

SEQ ID NO: 885 - DNA, 2012 bp, Zea mays
gtgttctcatctcatccaaatccaagcatgtttgctgtgcaattcactcttcggaattgagtcacgtgcacgagaaattaaagggagggcgctatccgtcctctacccccaaagcgcggtcccctcccttccccagtccccactaccactacacgcctctcgccgtcgcgtcttcaaagcctccgccacttgactcccatcccctctcgcgtggtccttctcctgctcccgctcccgctgctcctcatcttctcgcgccgcggcccccagcctttgcccgccgctacctctctctaattgggcggcggcctgccggtccgatggcgttcaactaccacgaccacgcgctggcgatggaccccgcggcggccgccgcggttggggcggccgcgaaccctagctttgtctccggaggtggcatggccggggggcccggctgggagagggagaaggcggccatcgcggcgcacccgctgtacgagcgtcttctcgaggcgcacgtcgcctgcctccgcgtcgccacccccgtcgaccagctcccgcgcatcgacgcgcagatagcggcgaggcccccgcccatggaggccgcggctgcggctgctgcggcgggcggagcacactcgggaggcgaggagctcgacctcttcatgacacattatgtgttgctcctctgttcattcaaggaacaactccagcagcatgtgcgtgttcatgcaatggaagcagtcatggcttgttgggagctcgaacaaactttacaaagccttacaggtgcatctcctggtgagggcactggggcaactatgtctgacgatgaagacaatcaggtggacagtgagagcaacatgtttgatggaaatgaggggtcagatggaatgggatttggcccattaatgttgactgagggtgagagatccttagttgagcgcgtccggcaggagctaaagcatgagcttaagcaggggtacagagacaaacttgtggatattcgggaagagatattgcggaagcgaagagctgggaaactccctggcgacactgcttctaccttaaaagcatggtggcaggctcattctaagtggccgtacccaaccgaggaagacaaggctcgactggtgcaggaaacagggctacaactgaagcagatcaataactggtttatcaaccagcgtaagcggaactggcacaacaattcggcgtcatcctcgtcggacaaaagcaagagaaaaaggaacactgcaggtgatgggaacgcagaaccagcctggtagggcatggtcggggaacgaagtttatgtaaataatgcttctactgtgaagagttccatcatatttgttgctccagaaaagaccctcagaccggtgtttcctgaacccatattcatacaaagacatcagacgatgaataatgttgcgagtagtcaaataaaataaataacttgtatagtgaataactagaaactagcattcatcgttttggtattgtatagcgctagagtgtaattgtttggtcggactgtcttgtataatggtgtaaggttcaaatgcattttgacctagcattcgatattgtattttgtgatgttaaaaaccattgtattccgttttgtgttttatccgtggaatagggacactgtttagtgttgccctcaattcggccatgtcgtgttgtcaacttcatattaaacttcaaagttgtttgtatttaataaacttcaaacttcatatataacacgaggttgtggtatagtttcacgatatgcaattatttgtatttaataaacaacatattgttgaagatattattagccaaaatgcagtattgatggatgtccagtgactagatttgtccgtgtgttgcattgtcaactctttgatggtaccagcattagaagtgtgtgttgcattgtcaactctttgatggtacggagtgtaatcggatcgaatacggacggatatcaatgaaatcatattttttttcatatttttagtcggattcgaattcgaatacg

SEQ ID NO: 886 - DNA, 1712 bp, Panicum virgatum
tcccctccccactacacgcacacgcctctcgccgtcgcgtcctctcctctcgcctcttcaaagcctccgccacttgactcccctccccgtctcccgtggtcctccactccacctccttctccgccttccccctcgagctcgcctcgcctcgaccaggctccgcagccctcgcccgcagctggccggctctctcgcgtccagccgggagccgggctctggggggatggcgttccactacccggaccacgcgctggcgatggaccccgcggccggggtcggcgcggcggtcaaccctagcttcgtgtcccccggcggcggcggggtcgggggaggagggggcgggtgggagcgggagaaggcggccatcgcggcgcacccgctgtacgagcgcctgctcgaggcgcacgtcgcctgcctccgcgtcgccacccccgtcgaccagctcccgcgcatcgacgcgcagatagccgcgaggcccccgcccatggcggcggccgcggccgcggccgctgcggcggcgggcggggcgcagtcgggaggcgaggagctcgacctcttcatgacgcattacgtattgctcctctgttcattcaaggaacaactccagcagcatgtgcgtgttcatgcaatggaagcagtgatggcttgctgggagcttgaacaaactttacaaagccttactggggcatctcctggtgaaggcactggggctactatgtctgatgatgaagacaatcaggtagacagcgagagcaacatatttgatggaaatgaggggtcagatggaatgggattcggtcccttaatgttgactgagggtgagagatccttagttgagcgtgtgcggcaggagctaaagcatgagcttaagcagggatacagagaaaaacttgtggatattagggaagagataatgcggaagcgaagggctggaaaactccctggggacacagcttctacgttgaaagcctggtggcaagctcattctaaatggccatacccaactgaggaagacaaggctagactggtacaggaaacagggctgcaactaaagcagatcaacaactggttcatcaaccagcgtaagaggaactggcacagcaatccggcatcatcctcatccgacaaaagcaagagaaaaaggaacactgcaggtgatggcaatgctgagcaatcctggtagagcgtggtcggagaagaattatatgtaaataacgcgtctactgagaagaatggcaccatatttgttgcgtgggaaacaaccattcgagtgggtgtttcctgagccccatattcatacaaagatatcacacgatgtaataatgttgtaagtagtcatgtaaactaaataatttgtatagcgaatcactagagactagcattcatgtttggtattgtatagttttaattgattgagcgtactgtctctgtataactctacgatttaaatgtatttgactagcactcgatattgtattttgtattagtatgtcatgtgaaaccgtggttataactgtatttgttctgtgagctatctatctgtggaactgtagagatgcacgtggtcttgtttgttcccgtatgtagattactagaagcttgcagtctgtatcgtaacaatttagtatgtgaaatgtaacaatctgagacttaattatttcagtctctgtttgaccttaagtgtttcaatcacaaggtcaccttcgttttgg

SEQ ID NO: 887 - DNA, 1666 bp, Panicum virgatum
gtcccctccccactacactcacgcctctcgccgtcgcgtcctcctctcgcctcttcaaagcctccgccacttgactcctctccccgtctccgtcccgtggtcctcctccccctccccttccccctcgagctcgcgtcgcctcgaccagcctccgcagccctcgccggcagctggctggctctctcgcggctagccgggagccgggctctgggggatggcgttccactacccggaccacgcgctggcgatggaccccgcggccgcggccggggtcggggtcggggcggcggtcaaccctagcttcgtgtcccccggcggcggcggcggcgggggtgggtgggagcgggagaaggcggccatcgcggcgcacccgctgtacgagcgcctgctcgaggcgcacgtcgcctgcctccgcgtcgccacccccgtcgaccagctcccgcgcatcgacgcgcagatagccgcgaggcccccgcccatggcggcggccgcggccgccgcggcggcgggcggggcgcagtcgggaggcgaggagctcgacctcttcatgacgcatttcgtattgctcctctgttcattcaaggaacaactccagcagcatgtgcgtgttcatgcaatggaagcagtgatggcttgctgggagcttgaacaaactttacaaagccttacaggggcatctcctggtgaaggcactggggctactatgtctgatgatgaagacaatcaggtagacagtgagagcaacatgtttgatggaaatgaggggtcagatggaatgggatttggtcccttaatgttgactgagggtgagagatccttagttgagcgtgtgcggcaggagctaaagcatgagcttaagcagggatacagagaaaaacttgtggatattagggaagagataatgcggaagcgaagagctgggaaactccctggagacacagcttctacgttgaaagcctggtggcaagctcattctaaatggccatacccaactgaggaagacaaggctagactggtacaggaaacagggctgcaactaaagcagatcaacaactggttcatcaaccagcgtaagcggaactggcacagcaatccggcatcatcctcatctgacaaaagcaagagaaaaagaaacactgcaggtgatggaaatgctgagcaatcctggtagagcgtggttggagaagaattatatgtaaataacgcgtctactgagaagaatggcaccatatttgttgcgtgggaaacaaccattcgagtgggcgtttcctgagccccatattcatacagagatatcacacgatgtaataatgttgtaagtagtcacgtaaaactaaataatttgtatagcgaatcactagagactagcattcatgtttggtattgtataattttaattgattgagcgtactgtctctgtataactctatggttcaaatgtatttgactagcactcgatattgtattttgtgtaagtattgtcatgtaaaccgtggttacaagtttataactgtgtttgttccgtgagttatctatgtgtggaactgtagaggcgcactagtggccttgtttgttccagtatatcgatactagaaggttgcagtctgtatcgtaacaatctggtatgtgaaatgttacaatctgagacttgattgtttcagtctgt

SEQ ID NO: 888 - DNA, 1863 bp, Setaria italica
cacccgtcctctcctctacccccacacccccgagagagagaggtgaggtcccctccactacacgcctctcgccgtcgcgtcctccctctcgcctcttcaaagcctccggtcctccgccacttgactcctgtcccctctcgcgtggtcctcttcctcctcctcctcctccccttgtccctcgagcacgcctcgtctctcccggtctccgccgcgcgccgccccgccgttggctggctctctagccgggaggggggatggcgttccactacccggaccacgcgctggcgatggaccccgcggcggcggcggccgcggccggggtcggggcggcggtgaaccctagcttcgtgcccggaggaggcggcgtggggggaccgggcgggtgggagcgggagaaggcggccatcgcggcgcacccgctgtacgagcgcctgctcgaggcgcacgtcgcctgcctccgcgtcgccacccccgtcgaccagctcccccgcatcgacgcgcagatagccgccaggcccccgcccatggcggcggccgcggcggcgggcggggcgcagtcggggggcgaggagctcgacctcttcatgacacattatgtattgctcctctgttcgttcaaggaacaactccagcagcatgtgcgtgttcatgcaatggaagcagtgatggcttgctgggagcttgaacaaactttacaaagccttacaggggcatctcctggtgaaggcactggggctactatgtctgatgatgaagacaatcaggtagacagtgagagcaacatgtttgatggaaatgaggggtcagatggaatgggatttggtcccttaatgttgactgagggtgagagatccttagttgagcgtgtccggcaggagctgaagcatgagcttaagcaggggtacagagaaaaacttgtggatattagggaggagataatgcggaagcgaagagctgggaaactcccaggtgacacagcttccactttgaaagcctggtggcaagctcattctaaatggccatacccaactgaggaagacaaggctagactggtgcaggaaacagggctgcaactaaagcagatcaataactggttcatcaatcagcgtaagcggaactggcacagcaacccggcttcatcctcatccgacaaaagcaagagaaaaagaagcactgcaggtgatggcaacgcagagcaatcctggtagagcgcggttggagaagaattatatgtaaataacgcttctactgagaagaatggcaccatatttgttgctcgggaaacgaccaccagcatttcccgagccccatattcgtacaaagataccacacgatgtaataatgttgtaagtagtcacgtaaactaaataatttgtatagtgaataactagagactagcattcactttcggtattgtatagtttaagttgtttggacgtgctgtgtctgtactgtacggttcaaatgtatttgactagcattcgatattgtatttttgtggaagtatggcatgtaaaaccgtggatcataactgtatttgtaccttgaattatatgtgaaactgtagagacgcactgtggccttgtatattccagtatataggtagaagattgcagcgtgcgcttgggtgattagattatttaatcgtaacaatccggtatgtgaaagactcagtttgtttcagtttgtgaattataacaatttgcaatctgcaattcagatctatgtttgaccataagtatttcaatcacatggttaccttcgttttggcagctctcgtgtttaccaacttgtctacggctttcttcctcagggcagccgctaatttctgggttttcagtttctgatggaagaacatgttag

SEQ ID NO: 889 - DNA, 2012 bp, Setaria italica
tctacccccacacccccgagagagagaggtgaggtcccctccactacacgcctctcgccgtcgcgtcctccctctcgcctcttcaaagcctccggtcctccgccacttgactcctgtcccctctcgcgtggtcctcttcctcctcctcctcctccccttgtccctcgagcacgcctcgtctctcccggtctccgccgcgcgccgccccgccgttggctggctctctagccgggaggggggatggcgttccactacccggaccacgcgctggcgatggaccccgcggcggcggcggccgcggccggggtcggggcggcggtgaaccctagcttcgtgcccggaggaggcggcgtggggggaccgggcgggtgggagcgggagaaggcggccatcgcggcgcacccgctgtacgagcgcctgctcgaggcgcacgtcgcctgcctccgcgtcgccacccccgtcgaccagctcccccgcatcgacgcgcagatagccgccaggcccccgcccatggcggcggccgcggcggcgggcggggcgcagtcggggggcgaggagctcgacctcttcatgacacattatgtattgctcctctgttcgttcaaggaacaactccagcagcatgtgcgtgttcatgcaatggaagcagtgatggcttgctgggagcttgaacaaactttacaaagccttacaggggcatctcctggtgaaggcactggggctactatgtctgatgatgaagacaatcaggtagacagtgagagcaacatgtttgatggaaatgaggggtcagatggaatgggatttggtcccttaatgttgactgagggtgagagatccttagttgagcgtgtccggcaggagctgaagcatgagcttaagcaggggtacagagaaaaacttgtggatattagggaggagataatgcggaagcgaagagctgggaaactcccaggtgacacagcttccactttgaaagcctggtggcaagctcattctaaatggccatacccaactgaggaagacaaggctagactggtgcaggaaacagggctgcaactaaagcagatcaataactggttcatcaatcagcgtaagcggaactggcacagcaacccggcttcatcctcatccgacaaaagcaagagaaaaagaagcactgcaggtgatggcaacgcagagcaatcctggtagagcgcggttggagaagaattatatgtaaataacgcttctactgagaagaatggcaccatatttgttgctcgggaaacgaccaccagcatttcccgagccccatattcgtacaaagataccacacgatgtaataatgttgtaagtagtcacgtaaactaaataatttgtatagtgaataactagagactagcattcactttcggtattgtatagtttaagttgtttggacgtgctgtgtctgtactgtacggttcaaatgtatttgactagcattcgatattgtatttttgtggaagtatggcatgtaaaaccgtggatcataactgtatttgtaccttgaattatatgtgaaactgtagagacgcactgtggccttgtatattccagtatataggtagaagattgcagcgtgcgcttgggtgattagattatttaatcgtaacaatccggtatgtgaaagactcagtttgtttcagtttgtgaattataacaatttgcaatctgcaattcagatctatgtttgaccataagtatttcaatcacatggttaccttcgttttggcagctctcgtgtttaccaacttgtctacggctttcttcctcagggcagccgctaatttctgggttttcagtttctgatggaagaacatgttagttgtaaccgggcaaaatagatgtattgatctcctagcttttgtctcgagccctcgacggtcaatttcgtcaagattggtcgacctagttcctcgactttcggttttattcaaactcattcttctactaatatagcactacatactagtacttattatgagatc

SEQ ID NO: 890 - DNA, 1889 bp, Oryza sativa
gcaaaactgaaatgggctcctcctattcccatcgctcctctacggtcccctcccactcccgaagaagatcctctgacttacttccctctaactctgagtcaccgatatatgggcccattaaatagagggcccatatgttagtgacacaagttagaggagcctcccgactcactccctccctccctcccaactgctacaaccacaagtcctcgtcctcgtcctcgtcctcgtcttcgtcttcctcctccacctcgcgcgctgcagcagcagcagcggtgcgcgtgatggcgttccactaccaggaccacgcgctggcgatggacgccgcggctgcggcggcggagacgggcggccaccaccaccctgggttcgtcggggcgggaggagttgtggggggaggaggaggaggagggtgggagcgggagaaggccgccatcgcggcgcacccgctgtacgagcggctgctggaggcgcacgtcgcgtgcctccgcgtcgccacccccgtcgaccagctgccccgcatcgacgcgcagattgcggcgcgccccccgccgctggccgccgccacggccgcagcggcggccgcggcggccggaggggcgccgtccggcggcgaggagctcgacctcttcatgacccattatgtattgctcctttgttcgttcaaggaacaactacagcaacatgtgcgtgttcatgcaatggaagcagtaatggcttgctgggaacttgaacaaactttacagagccttacaggggcatctcctggtgaaggttctggagcaactatgtctgatgacgaagacaatcaggttgatagtgagagcaacatgtttgatggaaatgatggatcagatggtatgggctttggccccttaatgctgacggagggcgagagatcattagttgagcgcgtacggcaagagctgaaacatgagcttaaacaggggtacagagaaaagcttgtggacattagggaagagatactccgaaagcgaagagctggaaaactcccaggagatacagcgtctactttgaaagcatggtggcaggctcactctaaatggccatacccaactgaggaggacaaggctcgcttggtgcaggaaacagggttgcaactaaagcagatcaataattggtttatcaaccaacgtaaacggaactggcacagcaatcctgcttcatcctcatcagacaaaagcaagagaaaaaggtgatggcaaggccgagcaatcttggtagaatgtggttggagaagaagtatatatatgtaaataatgcatccattgtgaagaatgccagtatatttattgctcccaagatggcgattcggacagaagcttcctggggctaatttatacgaaagaaattatgtcatgttataattttagtcatgtgaagctatagtgcgtatatatagtgacttaccagagagtagtttttatgtttgctgttggctagtgtgcatttgtagttgggacgtgctggctgtctctctacagctcggtacaaccatgtatttataacgtgttgtgaagcatatgttgtaaaatcgtggaatgggagtgttctgcgatccccatatgttgttgtaatgttgtatattgatgaccatgctgcaacggcagcatgtttgtaactcgttatatcctcaggctcttgtgttgttagaaattacagaactatattgtctttaacgagcatctcctgttgaattaataatagccagacagtcagatttttgttggatatttggataggaactttcttaaattgagattcctcgtccttttcatttctgtgatgatcctgaggtcgaaccggttgatgattgctgttcagaagattttttttttcattttgcaagtgtgaactgcaactgtgag

SEQ ID NO: 891 - DNA, 1568 bp, Oryza sativa
acccaacccaacccaacctcctctcctatcgtcatccgctcttcttcccctcttccccactcgcaccaaccccaacccccccaaccgccgccgccgccgccgacgacccaccggtcgccgcgtcgccggagtcgcgtaccggagaggggggcggagaggcaccagccgccccatggcgttccactacccggaccacggcctcgccatggacccgtcctccgccgcggcgtcgtcgcccaaccctagcttctcccccggaggcgggggcgggggcggggtcgggggaggggagagggagaaggcggccgtcgcggcgcacccgctctacgagcgcctgctcgaggcgcacgtcgcctgcctccgcgtcgccacccccgtggaccagctcccccgcatcgacgcgcagatcgccgcgcgcccgcctcccctcgcagccgcctccgccgccgccgccgccggtggcccctccggtggcgaggagctcgacctcttcatgacacattatgtgttgcttctttgctcattcaaggaacaacttcagcagcatgtgcgtgttcatgcaatggaagcagtgatggggtgctgggaacttgaacagtctttacaaagtctaacaggggcatctcctggtgaagggactggagcgactatgtctgatgatgaagataaccaagtggacagtgaagccaacatgtttgatggaaatgatgggtcagacggcatgggctttggtcccttaatgctgaccgagggtgaaagatccttggttgagcgtgtacggcatgagctgaagaacgagcttaagcaggggtacaaagaaaagcttgtggatattagggaagagatccttcgcaagcggagagctggtaaacttcccggtgatactgcatctatactaaaagcttggtggcaagctcattctaagtggccatacccaactgaagacgacaaggcccgcctggtgcaggaaacggggttacaactgaagcaaatcaacaattggttcattaaccaacgcaaacgaaactggcatagcaacccagcatcctctggtgaaaagaccaagaagaaaagaaacgttacaggtgatggtggtgctgagcaatcgtggtagattggttcaacatgaaactagatgtaaacagtaccttttattgtgaagagtgtagtacattctctcgtgctctggtgtgacaaaatctggagaccggcccattcacaagggaattgcgatcataggcgtaatcactgggcaaagaagtcatctgaaattgtagcataagcgcacaaaactgaggtgggtggtatttgactttcgcagtatagcatcgactgtctgctaatgtgattttgtgaaggaatgttctgtataaccgatgaacggaaggaagaattgtattgtgtatgtaattgtgtatcttatttatcatgtaatatatatatgatattaggagctttaagattcggattggatatgttctctgttttgatgcacgatgcagtgttgagatgtaacatgttttggtaattcactgtgtataaaatatcggagtatatgtgcgtaagct

SEQ ID NO: 892 - DNA, 1313 bp, Secale cereale
ccatggcgtaccagtaccaccaccaggaccacgcgctggggatggacgcggctgcggcggcggcggggaaccctggcggcggcttcgcgccagctttgggcgcggggggcggcgggtgggagagggagaaggcggccatcgaggcgcacccgctgtacgagcggctgctggaggcgcacgtcgcctgcctgcgcgtcgccacccccgtcgaccagctcccccgcatcgacgcgcagatcgccgcgcgcgccccgccgcccatgccccccgccgccgcgccctccggcggcgaggagctcgacctcttcatgacacactatgtgctgctgctctgttccttcaaggaacagctccagcagcatgtgcgcgtccacgccatggaagcggtgatggcctgctgggagctcgagcaaaccttgcagagtcttacaggggcatctcctggcgagggcaccggggcaactatgtctgatgacgaagacaacccggtcgacagcgagagcaacatgtttgatggaaacgatgtgtcggatggcatgggctttggaatgctaaccgagggtgagagatccttggtcgagcgtgtgaggcaggagctgaagcacgagcttaaacaggggtacagagaaaagcttgtggacatcagggaggagatactgcggaagcgaagagcgggaaagctcccaggagacacggcatctaccctgaaggcttggtggcaagcacacgccaaatggccgtacccaactgaggaggacaaggcgcggctggtgcaggagacggggctgcagctgaagcagatcaacaactggttcatcaaccagcgcaagcgcaactggcacagcaaccctacctcgtcctcgtcggacaagagcaagagaaaaaggaacaatgcaggtgacggcaacgccgagcagtcctggtagggcggggcgcggtcggagacgaacaatcaaacccgttatatgtacatagcgcttccatcttggagaaggcttgatatatttattggtccggagacgacggcggctattcgccctgcagtctcgccgacccaacaccatctgtacccccaaaagataaaaacatgtagtgatgttgtaatggagaattgccagaaatctgtagctgttttgtggcgcgccgtcgtgttgggaggcgcggtgtcgctgtgagtgtacacgggctgttccgtagtgtctgtggattgtgtgttgcgttgccgtgggattggtgcgaagtgttgtgtgggtgggtgctgtatgtatatttgtgtacctgtatgtgtgtactgaccatgatgcgctgtttgt

SEQ ID NO: 893 - DNA, 1190 bp, Avena sativa
ctcccccgaggtcagacttcagaggcggtaccactccatttttcgaagccgagccgcgccgcgcgctcggtcacctccacgcctcccagccggcggcgcgccctgcggacctccccgcgcgccgggtgatcgatcgattcaccgggcatggcgtaccactaccaccaggaccacgccgcggccgcgctggggatggaccccgcggcggcggcaggggcggggaaccctagcttcgctgctgttgggggcgtgggcgggggcgggtgggagagggagaagtcggccatcgaggcgcacccgctgtacgagcggctgctggaggcgcacgtcgcctgcctccgcgtcgccacccccgtcgaccagctgccccgcatcgacgcgcagattgccgcgcgggccccgccgcccatgccaaaccccgccggcgcgccctcaggcggcgaggagctcgacctcttcatgacacactatgtactgctcctttgttccttcaaggagcaactccagcagcatgtgcgcgttcacgccatggaagcagtgatggcttgctgggagctcgagcaaactttgcagagtcttacaggggcatctcctggtgaaggcaccggggcaactatgtctgacgatgaagacaatccggtcgacagtgagagcaacatgtatgatggaaatgacgtatcagatggtatgggctttggaatgctaaccgagggtgagagatccttagttgagcgcgtaaggcaagagctgaagcatgagcttaaacaggggtacagagaaaagcttgtggatattagggaagagatacttcggaagcgaagagctggaaagctcccaggagacacagcgtctactctgaaagcctggtggcaagctcatgcaaaatggccatacccaactgaggaggacaaggcccgcctggtgcaggaaacagggttgcaactgaagcagatcaacaattggttcatcaaccagcgcaagcggaactggcacagcaaccctacctcatcctcatcagacaaaagcaagagaaaaagaagcaacgcaggtgatggcaacgcggagcagtcttggtagggcacaggttggagaagaacacacatgtgtaaattaacacttccatcgtgcttgatatatttattctgccaggaacgaccatttggccatggtgtttcttggacccaaaatgt

SEQ ID NO: 894 - DNA, 1489 bp, Triticum aestivum
acctacacctacacccatccgtccgtccgtcctcctccacttgacccggtggtaccactcgcctcgtctcggagcagggcagcggataccaggcgggagctagcccgcgcacgcctctcctgcgcgcgcggcgagggtacggccatggcgtaccagtaccaccaccaggaccacgccgcggccgcgctggggatggacgccgcggcggcggcggcggcggccgcggggaaccccggcggcggcggcttcgcgccaggtttgggcgcgggcgggtgggagagggagaaggcggccatcgaggcgcacccgctgtacgagcggctgctggaggcgcacgtcgcctgcctgcgcgtcgccacccccgtcgaccagctgccccgcatcgacgcgcagatcgccgcgcgcgccccgccgcccatgccccccgccgccgcgcccgcgggcggcgaggagctcgacctcttcatgacacactatgtgctgctcctctgttccttcaaggagcagctccagcagcatgtgcgcgtccacgccatggaggcggtgatggcctgctgggagctcgagcagactttgcagagccttacaggggcatctcctggcgaaggcactggggcaactatgtctgatgatgaagacaacccggtcgacagcgagagcaacatgtttgacggaaatgatgtgtcagatggcatgggcttcggaatgctaaccgagggtgagagatccttggtcgagcgcgtgaggcaagagctgaagcatgagcttaaacaggggtacagagaaaagcttgtggacatcagggaggagatactgcggaagcggagagccggtaagctcccaggagacacggcgtccactctgaaggcgtggtggcaagcccacgccaaatggccgtacccaactgaggaggacaaggcgcggctggtgcaggagacggggctgcagctgaagcagataaacaactggttcatcaaccagcgcaagcggaactggcacagcaaccctacctcgtcctcgtcggacaagagcaagagaaaaaggaacaatgcaggtgacggcaacgccgagcagtcctggtagggcgggcgcggctggagagcgaagaacgaatgccccatatatgtacatagcgcttccatcttggagaaggcttgatactactatttattggtccgggaggcgacgagcctcccggacccaacaccgtctgtactgtaccccaaaaggaagaagaaaacatgtagtagtaatgttgtaacggagttacccgaaatctgtagctgttttgtggcgcggcgtcgctgtgagcgagtgtatacgggctgttccgtggtgtgcttgtgggtcgtgtgttgcgttgccgtgggactggcggaagtgtcgtgtgttgtgtgggtgggtgctgtgtatttgcgtacctgtacgtgtactgaccatgatgccttgtttgtgcgttctatctgtctgtagcctgcaccctcggttc

SEQ ID NO: 895 - DNA, 2045 bp, Brachypodium distachyon
agatccaaacgaacaaaggagtaattttttttcaaaacggacataatatgggtcgctctaagtctagtgtcaaaaagaaaaaaaaattgccttaaggctgatcctgagactgagtcacgtgcgaagaagcgcgagagcatacagagccagcaagcagccgtcactctcggactctcctccttgctctgcccccgagccgagccgaggtcccccattcctctgcttccaaagcaaacctacaggctacacccagcccatcccttctcctccagtccacaaattcgaggtggtaccactcgcgggagggggcaggtacacgctgctggctgctgcgcctgcgctgcgacccgccgcgggcaggtgcgcatggcgttccactaccaggaccacggcgccgccgccgccgccgcgctggccatggacgccgctgcggcgggggtgaaccctaacagcggcagcagcttcggcacgcccggaggcggtggcgtgggaggcgtggggtgggagagggagaaggcggcggtggaggcgcacccgctgtacgagcgcctgctggaggcgcacgtggcgtgcctccgcgtcgccacccccgtcgaccagctcccacgcatcgacgcgcagatcgccgcgcggccaccgcccgcgcccgtgccgcccgccgctgcgcactccggcggcgaggagctcgacctcttcatgacacattacgtgctgctcctttgttccttcaaggaacaactccagcagcatgtgcgtgttcacgccatggaagcggtgatggcctgctgggagcttgagcaaactttacagagtcttacaggggcttctcctggtgaaggcaccggggcaactatgtctgatgacgaagacaatccgatcgacactgagagcaacatgtttgatggaaatgacgggtcagatggtatgggctttggccccctgatgctaaccgagggtgagagatccttagttgagcgtgtaaggcaagaactgaagcatgagcttaaacaggggtacagagaaaagcttatcgatattagggaagagatacttcggaagcgaagagctgggaaactcccaggagacacagcatctactctgaaagcttggtggcaggcccatgcaaaatggccatacccaactgaggaggacaaggctcgtctggtgcaggaaacagggttgcaactaaagcagatcaataattggttcatcaaccaacgtaaacggaactggcacagcaaccctacctcgtcgtcatcagacaaaagcaagagaaaaaggagcaatgcaggtgatggcaacaccgagcaatcctggtaggacgcggttggaggatgcatatgtaatgtaaataacgcttccattggggaaaatggcttgatctatatttattgctccctgagtcgaccattccgacaggagtttcctggaccaaatatctgcaccaccacccccctgcagaaaacaaaacaaaacaagattaaccatgtgatatagcgggcttaccagaaagtagctttcgcgtttcggtactgtctattttgtggggttttgtagctgttaagggatggtgctgccttgtgttggtaacccagcaattcgggtgtgtacattgctgtcgtaatttgcttgtaaagtattgtgttgtattctgtggtcatgcgtgccttggtggtgttgtatatttgcattcgtgaacattgatcatgatgcttcgtaggctcagttgatgccattgttgttgttgacgttattgttgctagtttcctacctgattgtttgtcaattgagcaaagtcgcttataagagtctctatcaagtgtcaacggaaccatcatgaggttccttcagcaagcaaacctcaaagcagatgatcacctggaaatgcctgaatgttcaatgtaaagctgctctgaagtctgtagcctgtaggcagattccattccattgtcacgcataaaatcctggcttttaatgatttcatctggcggtagggttgccgcagcaaacatttttcgtttgagagttccaacaacaaaaaatgg

SEQ ID NO: 896 - DNA, 1978 bp, Brachypodium distachyon
aaggctgatcctgagactgagtcacgtgcgaagaagcgcgagagcatacagagccagcaagcagccgtcactctcggactctcctccttgctctgcccccgagccgagccgaggtcccccattcctctgcttccaaagcaaacctacaggctacacccagcccatcccttctcctccagtccacaaattcgaggtggtaccactcgcgggagggggcaggtacacgctgctggctgctgcgcctgcgctgcgacccgccgcgggcaggtgcgcatggcgttccactaccaggaccacggcgccgccgccgccgccgcgctggccatggacgccgctgcggcgggggtgaaccctaacagcggcagcagcttcggcacgcccggaggcggtggcgtgggaggcgtggggtgggagagggagaaggcggcggtggaggcgcacccgctgtacgagcgcctgctggaggcgcacgtggcgtgcctccgcgtcgccacccccgtcgaccagctcccacgcatcgacgcgcagatcgccgcgcggccaccgcccgcgcccgtgccgcccgccgctgcgcactccggcggcgaggagctcgacctcttcatgacacattacgtgctgctcctttgttccttcaaggaacaactccagcagcatgtgcgtgttcacgccatggaagcggtgatggcctgctgggagcttgagcaaactttacagagtcttacaggggcttctcctggtgaaggcaccggggcaactatgtctgatgacgaagacaatccgatcgacactgagagcaacatgtttgatggaaatgacgggtcagatggtatgggctttggccccctgatgctaaccgagggtgagagatccttagttgagcgtgtaaggcaagaactgaagcatgagcttaaacaggggtacagagaaaagcttatcgatattagggaagagatacttcggaagcgaagagctgggaaactcccaggagacacagcatctactctgaaagcttggtggcaggcccatgcaaaatggccatacccaactgaggaggacaaggctcgtctggtgcaggaaacagggttgcaactaaagcagatcaataattggttcatcaaccaacgtaaacggaactggcacagcaaccctacctcgtcgtcatcagacaaaagcaagagaaaaaggagcaatgcaggtgatggcaacaccgagcaatcctggtaggacgcggttggaggatgcatatgtaatgtaaataacgcttccattggggaaaatggcttgatctatatttattgctccctgagtcgaccattccgacaggagtttcctggaccaaatatctgcaccaccacccccctgcagaaaacaaaacaaaacaagattaaccatgtgatatagcgggcttaccagaaagtagctttcgcgtttcggtactgtctattttgtggggttttgtagctgttaagggatggtgctgccttgtgttggtaacccagcaattcgggtgtgtacattgctgtcgtaatttgcttgtaaagtattgtgttgtattctgtggtcatgcgtgccttggtggtgttgtatatttgcattcgtgaacattgatcatgatgcttcgtaggctcagttgatgccattgttgttgttgacgttattgttgctagtttcctacctgattgtttgtcaattgagcaaagtcgcttataagagtctctatcaagtgtcaacggaaccatcatgaggttccttcagcaagcaaacctcaaagcagatgatcacctggaaatgcctgaatgttcaatgtaaagctgctctgaagtctgtagcctgtaggcagattccattccattgtcacgcataaaatcctggcttttaatgatttcatctggcggtagggttgccgcagcaaacatttttcgtttgagagttccaacaacaaaaaatggagtctcgtgatttcataacttgggcc

SEQ ID NO: 897 - DNA, 1374 bp, Triticum aestivum
cggccatggcgtaccagtaccaccaccaggaccacgcgctggggatggacccggcgcggcggcggcggggaaccccggcggaggcttcgcgccaggtttgggcgcgggcgcgggcggggtttttgggaagagggagaaaaggcggccatcgaggcgcacccgctgtacgagcggctgctggaggcgcacgtcgcctgcctccgcgtcaccacccccgtcgaccagctcccccgcatcgacgcgcagatcgccgcgcgcgccccgccgcccgtgccccccgccgccgcgcccgccggcggcgaggagctcgacctcttcatgacacactatgtgctgctcctctgttccttcaaggaacagctccagcagcatgtgcgcgtccacgccatggaggcggtgatggcctgctgggagctcgagcaaactctgcagagtcttacaggggcatctcctggtgaaggcaccggggcaactatgtccgatgacgaagacaatccggtcgacagtgagagcaacatgtttgacgggaatgatgtgtcagatggcatgggcttcggaatgctaaccgagggtgagagatccttggtcgagcgcgtgaggcaagagctgaagcatgagcttaaacaggggtatagagaaaagcttgtggacatcagggaggagatactgcggaagcgaagagccggaaagctcccaggggacacggcgtctaccctgaaagcttggtggcaagcccacgccaaatggccgtacccaactgaggaggacaaggcgcggctggtgcaggagacggggctgcagctgaagcagatcaacaactggttcatcaaccagcgcaagcggaactggcacagcaaccctacctcgtcctcgtcagacaagagcaagagaaaaaggaacaatgcaggtgagggcaacgccgagcagtcctggtagggcgggtgcggtcggtcggagagcgaagaacgaagaacgaatgcccccatatatgtacatagcgcttccatcttggagaaggctttgatactgctatttattgctcgggagacgacgtcggccgctattcgcgcgcggcgtctccccgaggacccaaccatctgtgttccccaaaaagaaaaaaaaaacatggtagtagtaatgtaatgctgtaatggaattacccgagatgtgtactagctgttttgtggcgcgccgcggcgtcgctgtgagcgagtgtgtacgggctgttccgtggtgtgtgtgtctgtggatgattgtgtgttgcgttgccgtgggactggtgcaagtgtcgtgtgatgtggtatgtgttgtgtgtgggtgggtgctgtatatttgcgtacctctatgtgtactgaccgtgatgcgttgtttgtc

SEQ ID NO: 898 - DNA, 1442 bp, Secale cereale
ttgacccggtggtaccactccgagcaacaccggataccaagctcccgcctcgcctctcctcccctctcctctcctgtcctgcgcgcgcgccgagggtacggccgcctgatcgaccatggcgtaccagtaccaccaccaggaccacgccgcggccgcgctggggatggacccggctgcggcggggaaccctggcggcggcttcgcgccagctttgggcgcggggggcggcgggtgggagagggagaaggcggccatcgaggcgcacccgctgtacgagcggctgctggaggcgcacgtcgcctgcctgcgcgtcgccacccccgtcgaccagctcccccgcatcgacgcgcagatcgccgcgcgcgccccgccgcccatgccccccgcgccgcgccctccggcggcgaggagctcgacctcttcatgacacactatgtgctgctgctctgttccttcaaggacagctccagcagcatgtgcgcgtccacgccatggaagcggtgatggcctgctgggagctcgagcagactttgcagagtcttacaggcgcatctcctggcgagggcaccggggcaacgtatgtctgatgatgaagacaaccctgtggacagcgagagcaacatgtttgatggaaacgatgtgtcagatggcatgggctttggaatgctaaccgagggtgagagatccttggtcgagcgtgtgaggcaggagctgaagcacgagcttaaacaggggtacagagaaaagcttgtggacatcagggaggagatactgcggaagcgaagagcgggaaagctcccaggagacacggcatctaccctgaaggcttggtggcaagcacacgccaaatggccgtacccaactgaggaggacaaggcacgacagggtataggagagaggctgcagctgaagcagatcacaactggttcatcaaccagcgcaagcgcaactggcacagcaaccctctcgtcctcgtcggacaagagcaagagaaaaaggacaatgcaggtgacggcaacgccgagcagtcctggtagggcggggcgcggtcggagacgaacaatcgaacccgttatatgtacatagcgcttccatcttggagaaggcttgatatatttattggtccggagacgacggcggctattcgccctgcagtctcgccgacccaacatcatctgtacccccaaaagataaaaacattactgtctaatgttgtaatggagaattgccagaaatctgtagctgttttgtggcgcgccgtcgtgttgggaggcgcggtgtcgctgtgagtgtacacgggctgttccgtagtgtgtatgtggattgtgtgttgcgttaccgtgggattggtgggaagtgttgtgtgggtgggtgctgtgtgtatatttgtgtacctgtatgtgtgtactgaccatgatgcgctgtttgtccgttttatctct

SEQ ID NO: 899 - DNA, 1858 bp, Setaria italica
cagacagctgccctgcacagctgagctgaatagctgatgcgcctgcgcggcgacgaaagaaaaaccaacccaacccaagtcgtagagccttccaaccaaaaccaacccacactaccatcatccgtccatccatccatccatccatccgcttgtccctcccaccaccaccaaccaaaacctccaaccgccggggtcgttgcgctcgctcgcttgcgccgcccccccgcctcgccggccggcgactccgccccgtccccgccccgcggcgatgtcgttccactaccccgaccacggcctcaccatggacgccgcggctgctgctgctgcggcggcggccgcggccgcggccgcgtcgtcgccgaaccctagcggcttctcccccggcggcgtcggcggggagagggagaaggccgccatcgcggcgcacccgctctacgagcgcctcctggaggcgcacgtcgcctgcctccgcgtcgccacccccgtcgaccagctcccccgcatcgacgcgcagatcgccgcgcggcccccgcccctcgcggccgcagctggggccgcggccgcgggagggccatccggcggcgaggagctcgacctcttcatgacacattacgtgttgctcctttgctcgttcaaagaacaactccagcagcatgtacgtgttcatgcaatggaagcagtgatgggttgttgggagcttgaacaatctttacaaagcctcacaggggcatctcctggtgaaggcacaggagcgaccatgtctgatgatgaagataaccaggtggatagtgaggccaacatgtttgatgggaacgaaggatcagatggtatgggctttggccccctgatgctgacagagggtgagcgatccttggttgaacgtgtacggcaggagcttaaaaatgagcttaagcaggggtacaaagaaaagcttgttgatatcagagaagaaattctccgcaagcgcagagctggtaaactccctggggataccgcatctatattgaaagcctggtggcaggctcattccaagtggccataccctactgaagacgacaaggctcgactggtgcaggaaacaggattacagctgaagcagatcaacaactggttcattaaccagcgcaaacggaactggcacagcaacccaacatcctctggtgaaaagaccaagaagaaaaggtgatgacgaccggccctgagcagtcttgacgaagctagacgtacactataccttattgccaagtacattctccctcccactctgtagccaacaagtatggagaccgacctgttcggagggaactttatgaagtaatgaagatatgcgtcaccgggggaccttagcgggtcacctaatggccctagtttgaccacgtggtggaagtgggagttggtaatgactttgcagtatagcatttgtgctaatgtgatatgtggatcatgtgttgtatgaccgacgaagaacgggagggagtaagttatgttgtattgtaattgcgtatcctaccatgtaatgatattctagggaggattccaagattcagattggccgtttacagtactctccggtgttaaaggtgctggttcaaagtttacctgaagggaatgtaatggttcatacgttgtacgccatgtaagcagcttgctcttcgtgcgactcgtgtctactcgattggattcgtaggatgctgtggattaaccttgggtgtgtgggtccaaatcctaatacgccgtttaataagaaacggaggaaaagctaggtagttgcctgtagttttgcagtatagttgagggattcttaaaacaaattgtatttggacgaagctgaagatgtgaatttagacgacagttggtg

SEQ ID NO: 900 - DNA, 1979 bp, Setaria italica
cgtaagtgtagcaattagcacacaccccctttgacaagtgtcggcccccacgttgccgcttgtggtcagtggtcacagacagctgccctgcacagctgagctgaatagctgatgcgcctgcgcggcgacgaaagaaaaaccaacccaacccaagtcgtagagccttccaaccaaaaccaacccacactaccatcatccgtccatccatccatccatccatccgcttgtccctcccaccaccaccaaccaaaacctccaaccgccggggtcgttgcgctcgctcgcttgcgccgcccccccgcctcgccggccggcgactccgccccgtccccgccccgcggcgatgtcgttccactaccccgaccacggcctcaccatggacgccgcggctgctgctgctgcggcggcggccgcggccgcggccgcgtcgtcgccgaaccctagcggcttctcccccggcggcgtcggcggggagagggagaaggccgccatcgcggcgcacccgctctacgagcgcctcctggaggcgcacgtcgcctgcctccgcgtcgccacccccgtcgaccagctcccccgcatcgacgcgcagatcgccgcgcggcccccgcccctcgcggccgcagctggggccgcggccgcgggagggccatccggcggcgaggagctcgacctcttcatgacacattacgtgttgctcctttgctcgttcaaagaacaactccagcagcatgtacgtgttcatgcaatggaagcagtgatgggttgttgggagcttgaacaatctttacaaagcctcacaggggcatctcctggtgaaggcacaggagcgaccatgtctgatgatgaagataaccaggtggatagtgaggccaacatgtttgatgggaacgaaggatcagatggtatgggctttggccccctgatgctgacagagggtgagcgatccttggttgaacgtgtacggcaggagcttaaaaatgagcttaagcaggggtacaaagaaaagcttgttgatatcagagaagaaattctccgcaagcgcagagctggtaaactccctggggataccgcatctatattgaaagcctggtggcaggctcattccaagtggccataccctactgaagacgacaaggctcgactggtgcaggaaacaggattacagctgaagcagatcaacaactggttcattaaccagcgcaaacggaactggcacagcaacccaacatcctctggtgaaaagaccaagaagaaaaggtgatgacgaccggccctgagcagtcttgacgaagctagacgtacactataccttattgccaagtacattctccctcccactctgtagccaacaagtatggagaccgacctgttcggagggaactttatgaagtaatgaagatatgcgtcaccgggggaccttagcgggtcacctaatggccctagtttgaccacgtggtggaagtgggagttggtaatgactttgcagtatagcatttgtgctaatgtgatatgtggatcatgtgttgtatgaccgacgaagaacgggagggagtaagttatgttgtattgtaattgcgtatcctaccatgtaatgatattctagggaggattccaagattcagattggccgtttacagtactctccggtgttaaaggtgctggttcaaagtttacctgaagggaatgtaatggttcatacgttgtacgccatgtaagcagcttgctcttcgtgcgactcgtgtctactcgattggattcgtaggatgctgtggattaaccttgggtgtgtgggtccaaatcctaatacgccgtttaataagaaacggaggaaaagctaggtagttgcctgtagttttgcagtatagttgagggattcttaaaacaaattgtatttggacgaagctgaagatgtgaatttagacgacagttggtggcgtttggtatatggccaggcgcggaacgaaattggttggcaggga

SEQ ID NO: 901 - DNA, 2024 bp, Zea mays
agctgccctgcagagccgatgcgcctgagcctgggcccgcctgcgcggcgacaaaagaaaaccaaccccgatccgggagagattggcaattttactattattatttataggtttcattaatatatcatcaaactcacaaataaataaataataaacacagatgatcacactaattatacacacgagatgatataataataaacaactaaaattaagactgataaaattacaaatttctcgacccgtggagccttgcaaccaaaaccaacctacgccatcatcatccatccatccgcttgtccctcgcaccaccaccaaccaaaaacccccaactgccgaggtcgccggcgactccgtccgctccgcgccacgggtatgtcgttccactaccccgaccatgggctatccatggacgccgcggcagcggcggccgccgccgccgccgcgtcgtcgccgaaccctagcggcttctcccccggcgtcggcggggagagggagaaggcggccattgcggcgcacccgctgtacgagcgccttttggaggcgcacgtcgcctgcctccgcgtcgccacccccgtcgaccagctccctcgcatcgacgcgcagatcgccgcgcgccccccgccactagccgccgccgccggggccgcggcagcgggagggccgtccggcggcgaggagctcgacctcttcatgacgcactatgtattgctcctttgctcattcaaggaacaactccagcagcatgtacgtgttcatgcaatggaagcagtgatgggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgttgatatcagggaagagattatgcgcaagcgcagagctgggaaacttcctggagatactgcatctgtgctgaaagcttggtggcaagctcattccaagtggccatacccaactgaagacgacaaggcacgactggtgcaggaaacgggattgcagctaaagcagattaacaactggttcatcaaccaacgcaaacggaactggcacagcaacccaacatcctcgggtgaaaagactaagaagaaaaggtgatattgatccagagcaatcttgacgatgctaaacgtccactgtgtactttatggcgaagtacattaccctccctccgtagccaggagcggagatgtgcatcttgggtggcccagtggtcacttaatgccccaagtttgaccacgttgtgggactggtgctagtagtgacctctgcagtatagtaatattcactaatgttgtgggaatcatgtggtgtataaccggcgaacgggagggagtaatttatgttttattgtaattgtgtatctttaccttgtaatgatattttagggagaatcccaagatctcagaatggccgttcactgtattgtcggtggtaaaagtggtgggcaatcatcgtgttcagattacctccagaagggtatgcaatggctcgaatgttccatgtcgtgtttagctggttgtcgtttgtcttacttcctgctgagttggatacttgattccttcgaagatgtaaagcacccatcgatgcagattttgtcgttctgatgtgggagcatattttgttgctcagatatgctccgagcatctcgaggagcccctgttcttaaattagggcttctaatttttattttaaggatttttcctttatttttaaggtcttaattttttagttgttccaatataagtcctctaatagggaatgggcattagcccgggtggctagtcgtagccggcctgcgttcgagcgctgcccaaccggtatacacacacgagcgcgcattc

SEQ ID NO: 902 - DNA, 1750 bp, Secale cereale
tcagcgtcagccgcgacaaggacgccaacccaccttgccatccgtcatccactccgcccgtccctcccacccccaccaaccaaaacccacaaccgccgaggtcgttgcgcctcctctccccctcccccccgagcgccccgcccccgcctccgcctgcccccctccccctcgccacctgacgacgcggcgacggaggactcgatgtcgttccactacccggaccacgggcttgcaatggacgcggcggccgccgcggccgctgcctcgtcgccaaaccctagcttctccccccggcggcggcggcggggagagggagaaggcggccatcgcggcccacccgctgtacgagcggctcctggaggcccacgtcgcctgcctccgcgtcgccacacctgtcgaccagctcccccgcatcgacgcgcagatcgcggcccgcccgcccccgctcgccgccgccgccgccgcgggcgggccctccggaggcgaggagctcgacctcttcatgacacattatgtattgcttctctgttcatttaaagaacaactccagcagcatgtacgtgttcatgcaatggaagcagtgatgggttgttgggagcttgaacaatccttacaaagtctaacaggggcatctcctggtgaaggtactggggcgactatgtccgatgatgaagataaccaagtggatagtgagaccaacatgtttgatggaaatgatgggtcagatggtatgggctttggccccctgatattgaccgagggtgaacggtctttgattgaacgtgttcgacatgagctgaagagtgagcttaaacagggttacaaagaaaagctggttgatatcagggaggagatcatgcgcaagaggagagctggtaaacttcccggggatactgcagctacattgaaagcctggtggcaagctcattccaagtggccgtaccctacggaagacgacaaggctcgcctggtgcaggagacggggttacaactgaagcagatcaacaattggttcatcaaccaacgcaaaaggaactggcacagcagcaacacagcttcctctagcgaaaagaccaagaagaaaagaaacgttacaaaaggtaatgacggcacggagcaatcgtggtagactgggtcccagatgaaacaaactagatgtaaactatacttttatcatgaagattgctgcagtatatcctctccctctctctcttctttctttctggtggggcaactagatacgaagacgacctgttcacaagcaagttcattggcaaagaagtcatcaataatagttgaccaaaagtggtagcgactccggacgtacagtgtgagtgttttgctaatgtaatttgtgtaagcccgtgttgtataaccgaggaacggaagggagcattgtgttggtgtatgtacttgtatattcgattcatcatgtaacaatatgttagacggattgggtcttctgtgggtgtgatgtacggtgtggcatggtctggaacgaaaccgttttgtttgagatgtactggaagtgtggaaggctaagttatgcagtagtgtttgtaagctcatatatacagatgataacttgcataattacctgtgaatatggtggctctgctcagtggttcgtccgttctgccttcaggtgatatatgtgtaaattagagtcttgagtcatatatgtagttttgtagattgagttgtattgtgttgattaaccaaactgaatatgtaaccactggttaaaaca

SEQ ID NO: 903 - DNA, 1959 bp, Brachypodium distachyon
tctatacctcggtgctttgacgacgtcttccttccccacacacacaggcagtcgtgagctgcgggcagcgacagcgacagcaacccaccctgctgccatccgtcatccactccgctccccacccccaccaaccaaaacccccaaccgccgagagtcgttgcgcctgcgcctagccttcccccacccagcgccgctctcccctcccctccaccccccgcgcgcccacccggggacggacggacggaggactcgatgtcgttccactaccccgaccacgggctcgccatggacgcggcggcggcggcggcagcggccgcctcgtcgcccaaccctagcttctcccccggcggcggcgggggcctgggcgtgggcgtgggcggggagagggagaaggcggccatcgcggcccacccgctgtacgagcggttgctggaggcccacgtcgcctgcctccgcgtcgcaaccccagtcgaccagctcccccgcatcgacgcgcagatcgcggcccgcccacccccgctcgtcgccgccgccggctctgccggggggccctccgggggcgaggagctcgacctcttcatgacacattatgtattgctgctttgttcatttaaagaacaactccagcaacacgttcgtgttcatgcaatggaagctgtcatgggttgctgggagcttgaacaatctttacagagtctaacaggggcatctcctggtgaaggcactggggcaaccatgtctgatgatgaagacaatcaagtggatagcgagaccaacttgtttgatgggaatgatgggtcagatggtatgggctttggtcccctgatattgaccgagggtgaacgatctttgattgaacgtgtacgacatgagctgaagagtgagcttaagcaggggtacaaagaaaaactagttgatatcagggaagagatcatgcgaaagcggagagctggtaaacttcccggggatactgccgctacgttgaaagcttggtggcaagcacattccaagtggccataccctactgaagacgacaaggctcgcctggtgcaggagacagggttacaactgaagcagatcaataattggttcattaaccagcgcaaacggaactggcacagcagcaacgcatcatcctctagtgaaaagaccaagaagaaaaggtaatgacggcacggagcaatcatggtagactgtggtctgagaagacactagacgtaaacaataccttcatcatgaagaatgcagtatattctctctctcgcgtgtgccccctctggggcaactagatgtgaagacaacccattcacaaggaagttcagtgatgcagtcttttggcaaagaagtcatcaatagttgactgaaaggtggtagtgactctggaagtacagtgtgactgtttgctaatgtgattttatgtaagcacttattgtataaccgaggaatgggtgggagcattgtgcggtgtatgtaactatgtgctctatttatttttgacaggaagtgttgtaatctatttatcatgtaacaaaatcataggaagagtctgaagacatactggggtgttctgtgggtgtgtacggtatggtatgatgtcgctggtctgaaacgacttgggaaaccattctgtttaaactgtatttggaagtctaaattaagctcatatgtgcatactccaattatggaatattttgtaagctcattctccctccgttcttaaaattgatgtcattgcattcgtattcaaaaaattgatgtcattgcattcgtattcaaaaggcgtatattgcttcctttcaacgaccaagaggaagcttctcttcagcttaaagcattgttgtatttgaaatcactacgcaggagcggtatgcctgaagagttacaccagatgttttaacattcactgacccattttaatccgatcggatatctatgactagtgatctatgtatattggag

SEQ ID NO: 904 - DNA, 2096 bp, Brachypodium distachyon
acgcgaaactagtctgggcccagctttttgccatataaggcccgtgggccgttccggcacaacacgaaaccattttcgggccgtaggccgtgccgggccggcgccgatggacaccagtaaactccgtagagtgcacgtctatacctcggtgctttgacgacgtcttccttccccacacacacaggcagtcgtgagctgcgggcagcgacagcgacagcaacccaccctgctgccatccgtcatccactccgctccccacccccaccaaccaaaacccccaaccgccgagagtcgttgcgcctgcgcctagccttcccccacccagcgccgctctcccctcccctccaccccccgcgcgcccacccggggacggacggacggaggactcgatgtcgttccactaccccgaccacgggctcgccatggacgcggcggcggcggcggcagcggccgcctcgtcgcccaaccctagcttctcccccggcggcggcgggggcctgggcgtgggcgtgggcggggagagggagaaggcggccatcgcggcccacccgctgtacgagcggttgctggaggcccacgtcgcctgcctccgcgtcgcaaccccagtcgaccagctcccccgcatcgacgcgcagatcgcggcccgcccacccccgctcgtcgccgccgccggctctgccggggggccctccgggggcgaggagctcgacctcttcatgacacattatgtattgctgctttgttcatttaaagaacaactccagcaacacgttcgtgttcatgcaatggaagctgtcatgggttgctgggagcttgaacaatctttacagagtctaacaggggcatctcctggtgaaggcactggggcaaccatgtctgatgatgaagacaatcaagtggatagcgagaccaacttgtttgatgggaatgatgggtcagatggtatgggctttggtcccctgatattgaccgagggtgaacgatctttgattgaacgtgtacgacatgagctgaagagtgagcttaagcaggggtacaaagaaaaactagttgatatcagggaagagatcatgcgaaagcggagagctggtaaacttcccggggatactgccgctacgttgaaagcttggtggcaagcacattccaagtggccataccctactgaagacgacaaggctcgcctggtgcaggagacagggttacaactgaagcagatcaataattggttcattaaccagcgcaaacggaactggcacagcagcaacgcatcatcctctagtgaaaagaccaagaagaaaaggtaatgacggcacggagcaatcatggtagactgtggtctgagaagacactagacgtaaacaataccttcatcatgaagaatgcagtatattctctctctcgcgtgtgccccctctggggcaactagatgtgaagacaacccattcacaaggaagttcagtgatgcagtcttttggcaaagaagtcatcaatagttgactgaaaggtggtagtgactctggaagtacagtgtgactgtttgctaatgtgattttatgtaagcacttattgtataaccgaggaatgggtgggagcattgtgcggtgtatgtaactatgtgctctatttatttttgacaggaagtgttgtaatctatttatcatgtaacaaaatcataggaagagtctgaagacatactggggtgttctgtgggtgtgtacggtatggtatgatgtcgctggtctgaaacgacttgggaaaccattctgtttaaactgtatttggaagtctaaattaagctcatatgtgcatactccaattatggaatattttgtaagctcattctccctccgttcttaaaattgatgtcattgcattcgtattcaaaaaattgatgtcattgcattcgtattcaaaaggcgtatattgcttcctttcaacgaccaagaggaagcttctcttcagcttaaagcattgttgtatttgaaatcactacgcaggagcggtatgcctgaagagttacaccagatgttttaacattcactgacccattttaatccgatcggatatctatgactagtgatctatgtatattggag

SEQ ID NO: 905 - DNA, 1240 bp, Pseudoroegneria spicata
gtttgggcgcgggcgcgggcggcggcggctgggagagggagaaggcggccatcgaggcgcacccgctgtacgagcggctgctggaggcgcacgtcgcctgcctgcgcgtcgccacccccgtcgaccagctcccgcgcatcgacgcgcagatcgccgcgcgcgccccgccgcccatgccgcccgccggcgcgccctccggcggcgaggagctcgacctcttcatgacacactatgtactgctgctctgttccttcaaggaacaactccagcagcacgtgcgcgtccacgccatggaagcggtgatggcttgctgggagctcgagcaaactttacagtctcttacaggggcatctcctggcgaaggcaccggggcaactatgtctgatgatgaagacaatccggtcgacagtgagagcaacatgtttgatggaaatgatgtgtccgatggcatgggcttcggaatgctaaccgagggtgagagatccttggtcgagcgcgtcaggcaagagctgaagcacgagcttaaacaggggtacagagaaaagcttgtggatatcagggaagagatactccggaagcgaagagccggaaagctcccaggggacacggcgtccactctgaaagcttggtggcaagcccacgcgaaatggccatacccaactgaggaggacaaggcgcggctggtgcaggagacggggctgcagctgaagcagatcaacaactggttcatcaaccagcgcaagcggaactggcacagcaaccctacctcatcctcatcggacaaaagcaagagaaaaaggaacaatgcaggtgacggaaacgccgagcagtcctggtagggcgcggtcggagaagaagaagaatcgaacccgttatatgtacatagcgcttccatcttggagaaggcttgttactatttattggtccggagacggcggcggctattcgccccggagtctcctggacccaacaccgtctgtactgtaccccaaaaatagaaaaaacatgtagtggtaatgttgtaatgggccgtgtgatgcggtggcttaccagaaacctgtagtagctgttttgtggcgcgctgcgtgttgggaggcgcggcgtcgtcgagtgtatacggctgttccgtaatgtgtgtcgtggatttgtgtgttgcgttaccgtgggatttgtatgtatatttgcgtacctgtatctgtattactgaccatgatgtgctgtttgtccgttttattatcca

SEQ ID NO: 906 - DNA, 2134 bp, Panicum virgatum
cggagcctgcgcggcgaccaaagaaaaaaccaacccaacccaacccactccccatcatcacccatccatccgcttgtccctcccaccaccacggcaccaccaaccaaaaccccccaactgccggggtcgctgcgcccgcgccgcccccgctcgactcgccgccggcgaccccgcccgccccgggacggcgatgtcgttccactaccccgaccacgggctctccatggacgccgccgcggcggcggcggcggccgttgcggccgcgtcctcgccgaaccctagcggcttctcccccggcggcgtcggcggggagagggagaaggcggccatcgcggcgcacccgctgtacgagcgcctcctggaggcgcacgtcgcctgcctccgcgtcgccacccccgtcgaccagctcccgcgcatcgacgcgcagatcgccgcgcggccccctccgctcgcggccgccgctggggccgcggccgcgggggggccctccggcggcgaggagctcgacctcttcatgacacattatgtgttgcttctttgctcattcaaggaacaactccagcagcatgtacgtgtacatgcaatggaagcggtgatgggttgctgggagcttgaacaatctttacaaagcctgacaggggcatctcctggtgaaggcacaggagcgaccatgtctgatgatgaagataaccaggttgatagtgaggccaacatgtttgatggaaacgaaggatcagatggtatgggctttggccccctaatattgacagagggtgagcgatccttggttgaacgtgtaaggcaggagctgaaaaatgagcttaagcaggggtacaaagaaaagctcgttgatatcagagaagaaattctccgcaagcgcagagctggtaaacttcctggggataccgcatccatattgaaggcttggtggcaggctcattccaagtggccatacccaactgaagacgacaaggctcgactggtgcaggaaacaggattacagctgaagcagatcaacaactggttcattaaccaacgcaaacggaactggcacagcaacccaacatcctctggtgaaaagaccaagaagaaaaggtgagggcggccgaagcaatcttgacgaggctagatatacacagtactatactttattggcacgcacgttcgccctcactctagagatttggagacctacctgttgggagggaactttatggagtaatgaagacacgggtcacccggggaccttagctgtcacctaatgccctagtttgaccacgtggtggaagtggatgttggtaatgacttttgcagtatagcgtttgctaatgtgatatggtgaatcatgtgttgtatggcccacggaacggtaggcagtaatttatgttgtattgtacttgtgtatcctaccttgtaatgatgttttaggaaggattccaagattcagattgtccgtctgcagttgtaaaaatgtgctggctcaaagcttacccggaggtgctggctcaaagtttacctgaagggtatgtaatggttcatgttgtttgccatgtatgtgtaggctgcttgttctctgtgcaactggcgtctgctcggttggattcgtgagaagctgtaggttagccttgaatgcgtttgcctagatcatacgccatataggaacggaggaaaaagcatgtgccactcggattaaaacaagctgctgcctgctttacagagaacaagtcaagcggcgatcgagcaggtagggttgaaaatgggacgggaaaatcccgttccgaccggctccgtttaccgtttaaaccgaccgtaaactgtttccgcgaaaaaatgggaaaatgggaaaacaaaacgggaaaacgggcgggaacgggaacggttggggtgttttcccgaccgttttcccggttcccgttttcagccgggaaaatttccgcgggaattctcgtatttgtcgtagtcggctgtgttacctgtgttggaaatgtgaattgttgtttgcatgtgttccaatgtgaattgtgaattcgtgattcactttacctgtgtttcttagttatacgagtcttgtttctatgttatttatgcatagttgtaattattttatcgagttaaatgtttgaagtggttgtat

SEQ ID NO: 907 - DNA, 1655 bp, Hordeum vulgare
ctccaccccgcggtcccctctgccgctgcaccgctccgccccgcccgcctgctactgctactgctacctgcacccgcacccacacccatccctcctcctccacttgacccggtgccggtggtaccacctcctcccaaggcagcagcggatacatacgaagcgggagctatagcccgcgcgcgcaggcctgttcggccatggcgtaccagtaccaccaccaccaggaccacgcgctggggatggacgcggcggcggcggcggcggcgggggggaaccctggcggcggcggcttcgcgccgggcttaagcgcgggcggcgcgtgggagggggagaaggcggccgtcgaggcgcacccgctgtacgagcggctgctggaggcgcacgtcgcctgcctccgcgtcgccacccccgtcgaccagctcccccgcatcgacgcgcagatcgccgcgcgcgccccgcctcccatgccccccgccagcgcgctctccggcggcgaggagctcgacctcttcatgacacactacgtgctcctcctctgttccttcaaggaacagctccagcagcatgtgcgcgtccacgccatggaagcggtgatggcttgctgggagctcgagcagactttacagagtcttacaggggcatctcctggcgaaggcaccggggcaactatgtctgatgatgaagacaacccggtcgacagcgagagcaacatgttcgacggaaacgacgtgtccgatggcatgggcttcgggatgctaaccgagggtgagagatccttggtcgagcgcgtcaggcaagagctgaagcacgagcttaaacaggggtacagagaaaagcttgtggacatcagggaagagatactccggaagcgaagggccgggaagctcccgggagacacggcgtccaccctgaaggcttggtggcaagcccacgcgaaatggccgtacccaactgaggaggacaaggcgcggctggtgcaggagacggggctgcagctgaagcagatcaacaactggttcatcaaccagcgcaagcggaactggcacagcaacccgacctcgtcctcgtcggacaagagcaagagaaaaaggtgacggcaacgcggagcagtcctggtagggcggccggagacgaagaacgatcgaacccgttgtatgtacatagcgcttccatcttggagaaggcttgatatatttattggtccggggagatacgacacgacgcgacggcggtcatttgcgccggagtcgtctcccggacctcaacaccgtctccgtctgtactgtaccccaaaaagaaaaaagaaaaaacatgtagtggtaatgtacccgtagctgtttttgtggcgtgctgcgtgttgggaggacgcggcgtcgtgagtttgtatacgggctgttccgtaacgtgtgtcgtggatttgtgtgttgtgttgtgttgcgttaccgtgggaacggtggcaagggctgcgtgggtgatgtatgtttgtgtacctgtatttgtattactgaccttgattgatgcgtcgtcggtgctgtgctgtttgtccgtttcatctctctgcatcccgtgtatttttttttcctgtgatcaggtgacggttttccgtcagaagtgttgtagaatgaatgcaaagagagacaaataaagagttcaaa

SEQ ID NO: 908 - DNA, 1420 bp, Saccharum officinarum
cgcttgtccctcccaccaccaccaaccgaaaccccccaaccgccgaggtcgccggcgactccggccgctccgctccgctccgcgccgcggggatgtcgttccactaccccgaccacgggctgtccatggacgctgccgccgcgtcgtcgccgaaccctagcggcttctcctcccccggcgtcggcggggagagggagaaggcggccatcgcggcgcacccgctgtacgagcgcctcctggaggcgcacgtagcctgtctccgcgtcgccacccccgtcgaccagctcccccgcatcgacgcacagatcgccgcgcggcccccgccgctggcagccgccgctggggccgccgccgcgggagggccgtccggcggcgaggagctcgacctcttcatgacacactatgtgttgctcctttgctcattcaaggaacaactccagcagcatgtacgtgttcatgcaatggaagcagtgatgggttgctgggagcttgaacaatctttacagagcctaacaggggcatctcctggtgaaggcactggagcaaccatgtctgatgatgaagataaccaggtggatagtgaagccaacatgtttgatggaaatgatgggtcagatggtatgggctttggccccctaatactgacagagggtgaacgatccttagttgagcgtgtacggcaggagctgaagaatgagcttaagcagggttacaaagaaaagcttgttgatatcagggaagagattatgcgcaagcgcagagctggtaaacttcctggagatactgcatctgtactgaaagcttggtgggaagctcattccaagtggccatacccaactgaagacgacaaggcccgactggtgcaggaaactggattgcagctaaagcagatcaacaactggttcattaaccaacgcaaacggaactggcacagcaacccaacatcctcgggtgaaaagactaagaagaaaaggtgatgatggcccagagcaatgttgacgaagctagatatgtccactatactttatggtgaagtacattctcccttaccgtaggcaagagggaagatatgcagcttgggtgacctagtggtcacctaatgcccaagtttgaccgcgtggtggggactggagttggtagtgacctctgcagtatagccttctctaatgtgatgtgggaatcacgtgttgtataactggcgaatgggagggagttaatttatgttgtattgtaattgtgtattttctttaccttgtaatgatattttagggagaatcccaagattcagattggccgttcactgtattatcggtggtaaaagtggtgggcaatcatcgtgttcagagttcacctcctgaagggtatgtaatagctcgtatgttggatgacatgcatgttttagctgattgtcttttgtgct

SEQ ID NO: 909 - DNA, 1769 bp, Sorghum bicolor
ctttttttgcgacgcaagtgttagcaattagcacacccactttgacaagtgtcgtcggtccccacgcagcggatatggtcacactcacacacagctgcgctgcacagctgacgcgcctgagcctgggcccacctgcgcctgcgcgcccgcgcggcgacgaaaggaaaaccaaccccacagtccgtggagccttccaaccaaaaccaacccccacgccatcatccatccatccattcatccgcttgtccctcccaccaccaccaaccaaaacccccaaccgccgaggtcgccggcgactccgtccgctccgctcctcgccgcggggatgtcgttccactaccccgaccacgggctgtccatggacgctgccgcggcagcggcagcggctgcggcggccgcggcagccgcgtcgtcgccgaaccctagcggcttctcctcctccggcgtcgtcggcggggagagggagaaggcggccatcgcggcgcacccgctgtacgagcgcctcctggaggcgcacgtcgcctgcctccgcgtcgccacccccgtcgaccagctcccccgcatcgacgcgcagatcgccgcgcgtcccccgccgctcgccgccgccgctggggccgcggccgcgggagggccgtccggcggcgaggagctcgacctcttcatgacacactatgtgttgctcctttgctcattcaaggaacaactccagcagcatgtacgtgttcatgcaatggaagcagtgatgggttgctgggagcttgaacaatctttgcaaagcctaacaggggcatctcctggtgaaggcactggggcaaccatgtccgatgatgaagataaccaggtggatagcgaagccaacatgtttgatggaaatgatggatcagatggtatgggctttggccccctaatactgacagagggtgaacgatccttagttgagcgtgtacggcaggagctgaagaatgagcttaagcagggttataaagaaaagcttgttgatatcagggaagagattatgcgcaagcgcagagctggtaaacttcctggagatactgcatctgtactgaaagcttggtggcaagctcattccaagtggccatacccaactgaggacgacaaggctcgactggtgcaggaaacgggattgcagctgaagcagatcaacaactggttcattaaccaacgcaaacggaactggcacagcaacccgacatcctcgggtgaaaagactaagaagaaaaggtaatgatggcccagggcaatcttgacaaagttagatgtccactatactttatggtgaagtacattctccctcactccgtagccaagagggaagatatgcatcatgggtggcctagtggtcacctaatgcccccaagtttgaccacgtggtggggattggagttggtagtgacctctgcagtatagcattcgctaatgtgatgtgggaatcacgtgttgtataactggcgaatgagaggaagtaatttatgttgtattgtacgtaattgtgtattttctttaccttgtaatgatattttggggagaatcccaagattcagattggccgttcactgtattgccggtggtaaaagtggggtgggtaatcatcgtgtttagagttctcctcctgaagggtatgtaatagctcgtatgttggatgccatgcatgttttagctgattgtcgtttgtgttacttctgcctgctgagatcgatgcttggaatgcatattttgtagaacgcccttggggtgcatattttgtcgtt

SEQ ID NO: 910 - DNA, 1943 bp, Panicum virgatum
ccactccccatcatcatccatccatccgcttgtccctcccaggcctcccacccgccaaccaaaacccccaaccgccggggtcgttgcgcccgcgccgcccccctctactcgccgccggcgactccgcccgcccagcgacggcgatgtcgttccactaccccgaccacgggctcaccatggacgccgcggcggcggcggcagcggcggcggcggctgctgctgcggccgcgtcgtcgccgaaccctagcggcttctcccccggcgtcggcggggagagggagaaggcggccatcgcggcgcacccgctctacgagcgcctcctggaggcgcacgtcgcctgcctccgcgtcgccacccccgtcgaccagctcccacgcatcgacgcgcagatcgccgcgcggccccctccgctcgcggccgccgctggggccgcggccgcgggggggccctccggcggcgaggagctcgacctcttcatgacacattatgtgttgctcctttgctcattcaaggagcagctccagcagcatgtacgtgtacatgcaatggaagcggtgatgggttgctgggaccttgaacaatctttacaaagcctgacaggggcatctcctggtgaaggcacaggagcgaccatgtctgatgatgaagataaccaggttgatagtgaggccaacatgtttgatggaaacgaaggatcagatggtatgggctttgggcccctaatactgacagagggtgagcgatccttggttgaacgtgtacggcgggagctgaaaaatgagcttaagcagggatacaaagaaaagctcgttgatatcagagaagaaattctccgcaagcgcagagctggtaaacttcctggggataccgcatccatattgaaggcttggtggcaggctcattccaagtggccatatccaactgaagacgacaaggctcgactggtgcaggagacaggattacagctgaagcagatcaacaactggttcattaaccaacgcaaacggaactggcacagcaacccaacatcctcgggtgaaaagaccaagaagaaaaggtgaggacggccggagcaatcttgacgaagctagatatacacagtactatactttattggcacgcacgttctccctccctctagagatttggagacctacctgttgggagggaactttatggagtaatgaagatacgcgcgtcaccgggggaccttagcggtcacccattgccctagtttgacactttgaccacgtggtgggagtggaagttgtttatgacttttgcagtatagcgtttgctaatgtgatatggtgaatcatgtgttgtatgaccgaccgaacgggaggcagtaatttattttgtattgtacttgtgtatcctaccgtgtaatgatgttttaggaaggtttccaagattcagatcgtccgtttacagtatttgccggtgtaaaaatgtgctggctcaaagtttacccgaaggtgctggctcaaagtttacctgatgccatgtatgtgtaggctgtttgttgatgttctctgtgcaacttgtgtctgctcggttggattcgtggaaagctgtaggctacccttgaatgcgtttgcttacgtcttgtagaaacggaggaaaaaccgaaaagcatgtatcagtcggacaaacgaagctgctgcctactttacagagaccaagtcaagcggcgacggagcaggtgaagtccaaccctgcggcctcaggataatcgatcaccagtccatccatctccatcctttcgcttccccggctaagcttcctcctgatttttccgccgcactcgtcgtttccgctgacaagacccggccggagcacgaattttcttttccccttccacggcgtctccgtcgccccgagagcaaagcttcctcgctgtccagctccaagtgagtctgtccaggggaggattccagcat

SEQ ID NO: 911 - DNA, 921 bp, Leymus cinereus x Leymus triticoides
ctgcgcctgctgattgatcggccggccggccggccggacatggcgtaccagtaccaccaacaggaccacgggctggggatggacgcggcggcggcggggaaccccggcggcttcgcgcccggcctgggcgcgggcggggctggcgggtgggagagggagaaggcggccatcgaggcgcacccgctgtacgagcggctgctggaggcgcacgtcgcctgcctgcgcgtcgccacccccgtcgaccagctgccgcgcatcgacgcgcagatcgccgcgcgcgccccgccgcccatgccccccgccggcgcgccctccggcggcgaggagctcgacctcttcatgacccactatgtcctcctcctctgttccttcaaggaccaactccagcagcatgtgcgcgttcacgccatggaagcggtgatggcttgctgggagctcgagcaaactttccagagtcttacaggggcatctcctggcgaaggcaccggggcaactatgtctgatgatgaagacaatccggtggacagcgagagcaacatgtttgatggaaacgatgtgtccgatggtatgggcttcggcatgctaaccgagggcgagagatccttcgtcgaccgcgtcaggcaagagctgaagcatgagcttaaacaggggtacagagaaaaccttgtggacatcagggacgagatactccgcaagcgaagagcgggaaagctccccggagacacggcgtccaccctgaaagcttggtggcaagcccacgcaaaatggccctacccaactgaggaggacaaggcccggctggtgcaggaaacagggctgcagctgaagcagatcaacaactggttcatcaaccagcgcaagcggaactggcacagcaacccgacctcgtcctcatcggacaaaagcaagagaaaaaggaac

SEQ ID NO: 912 - DNA, 2153 bp, Zea mays
gcgcacaagaatcaagatagcctaacttcaattatttatacattttttagacaaaagtgtatcaattcacacccactttgacaagtgtcggtccccacgcagcggatatggcatactcacgacaactgcactgctgatgcgactgagcctgggcccgcctgtgctctgctgtgcggcgaaagaaaaccaacccaaagtcccaaacctgtgtagccttccaaccaaaccaacccacgccatcatcttccgtcaatccatccatccgcttgtccctaccacctccaccaaccaaaacccccaaccgccgaggtcaccggcgactccgtcctcgccgcgccgcgccgcgccgtgaggatgtcgttccactaccacgaccacgggctgtccatggacgccgcggcggcggcggccgccgccgccgcgtcgtcgccgaaccctagcggcttctcccccggcatcggcggggagagggagaaggcggccatcgcggcgcacccgctgtacgagcgcctcctggaggcgcacgtcgcctgcctacgcgtcgccacccccgtcgaccagctcccccgcatcgacgcgcagatcgccgcgcgccccccgccgctcgccgcggccgccggggccgcggccgccggggccgcggccgcgggaggcccgtccggcggggaggagctcgacctcttcatgacgcactatgtattgctcctttgctcattcaaggaacagctgcagcagcatgtacgtgttcatgcaatggaagcagtgatgggttgctgggagcttgaacaatccttacaaagcctaacaggggcatctccgggtgaaggcactggaggaaccatgtctgacgatgaagataaccaggtggatagtgaagccaacatgttcgatggaaatgatggatcagacggtatgggctttggccccctgatactaacagagggtgaacggtccttagttgagcgtgtacggaaggagctgaagaacgagcttaagcagggttacaaggaaaagcttgtcgatatcagggaagagatcatgcgcaaacgcagggctgggaaacttcctggagataccgcatctgtactgaaagcttggtggcaagctcattccaagtggccgtacccaactgaagacgacaaggccagactggtgcaggaaacggggttgcagctaaagcaaatcaacaactggttcattaaccaacgcaagcggaactggcacagcaacccaacatcctcggctgaaaagaccaagaagaaaaggtgatgatggcccagagcaatcttggcaaaaagctagagatgtccactatactttattatggcgaagtacattctccctcacttcgtaggcaagagggaaaggtatcttgggtgacttgagtggccacctaatgcgcaagtttgacgacgtggtggggctggagttggtagtgacctcagcagtatagcattcgctaacgtgatgtgggtgaatcacgtgttgcagtagaaccggcgagcgggaggggggtaatttatgttgtattgtaattgtgttttttattaccttgtaatgatattttagggagaatcccaagattcatattcgcatgttttgtcgtccagatgtgggagcagagcttgccgcatgttttgtcgcccacatatgcgctgagctcccctccttcgcattggcgcgcagaagattgagcatagagacgcatgttttgtgttgtggtaggacttgctcgctggccacaggttgaggttgtccttaggccctgttgggttgttgtttgggattagagccctggattaatttctagctggattatttctctaatttatatagattttagtgagctggaatgaattctggcttattccggtgcaaccgaacggggccttaaggattgctttctttgaagtcgaaatggcagtgagtgaagctcgttagcgcaaagaaaacaaccgagcacgaaggcgacaagcgaagcgggttactctacagcctaaagggaccgggtcaagcggtgaccaagcaagccaaaccaccatgcttgcgtacttgcgtaatattttgttccccttcccccgccgccgtaagaaccaatcactcacccagcagcaagcacagcacacatgcatctcacaaggaaaatcaaagcc

SEQ ID NO: 913 - DNA, 2440 bp, Panicum virgatum
ccttctcctagcatatccacccattacccccgcctctatatattgcacaggcgcagcgccccctgtcctgggtcactcaccggcgcggctcgccaccagacaagcggctgccgagaagttggagggggagtgtgcgcttcggtttggcgcgatggtgttcgcgtccggcgccggcgccggcggcccgcaggtgctgacggcgcggttcgtccgtcaggtggtgcttggccggtggttcatggtgttcgcgtgcctgctcatcctgtcggcgtcgggggcgacgtacatcttcagcatctactccaaggtgctcaagtcatcgctggggtacgaccagcgcacgctcaacacgctctccttcttcaaggacctgggcgccaacgtcggcgtcctctcggggctcatcaacgaggtcacgccgccgtgggtcgtgctcgccatgggcgccgccatgaacctcgcgggctacctcatgatctacctcgtcatcgacgggcgcaccgcgcggccccccgtgtggctcatgtgcatctacatctgcgtgggggccaactcgcagtccttcgccaacaccggggcgctcgtcacctgcgtcaagaacttcccggagagccgcggcatcgtgctgggcctgctcaagggcttcgtcggcctcagcggcgccatcttcacgcagctctacctcgccatctacggcgacgacgccaagtcgctcgtgctgctcatcgcctggctccccgccgccatctccatcctcttcgtccacaccgtccgcatcatgccgtacccgcgccccagccgccggcgcggcgccgcgggctcgtcggcggcgaccagcaacgacgccttcttctgcttcctctacatctccatcgcgctcgccacctacctcctcgtcatgatcgtcgtgcagaagcaggtcaacttctcgcacgccgcctacggggtgtcggccgcggcgctgctcctcgtcctcttcctgccgctcgccgtcgtcgtcaagcaggagtacaagatccagaaggagctcgaggagtccctccgcgagccccccacggtgaccgtcgagaaaccagctgcctcgctgcagatggcggcggcagccaagagccagcagagcaccaccacagaggcgaggccgccgccgccgccgtccagcagctgcctggggtcgtgcctgaggcacatgttcagcccgccggcgcagggggaggacttcaccatcctgcaggctctggtgagcgtggacatgctggtgctgttcctggcgaccatctgcggcgtcggcggcacgctgacggcgatcgataacatgggccagatcggccagtccctgggctacccggccaagagcatcaacaccttcgtgtccctcatcagcatctggaactacgccgggcgcgtcacctccgggttcgcctccgagatcttcctggcgcgctacaagttcccgcggccgctgatgctgacgctggtgctcctgctctcgtgcgtcggccacctcctcatcgccttcggcgtgccgcagtcgctgtacgcggcgtcggtggtgatcggcttctgcttcggcgcgcagtggccgctgctcttcgccatcatctccgaggtgttcgggctcaagtactactccacgctctacaacttcgggtccgtggcgagccccatcggcgcctacgtcctcaacgtccgcgtcgccggcgccctctacgacgccgaggccgcgaagcagcacggcgggtcgctggacgccggcggcgacaagacctgcatcggcgtgcagtgcttccgcaaggcgttcctcatcatcacggccgccacggtggccgccgtgctcgtgtcgctggtgctggtgtggcggaccaggaacttctacaagggcgacatctacgccaagttcagggacaacgccgacgccgccgatgaggaggaggaggatccgaagcggccgaaggaggtggaggcggaggcggagtcaacatcggtcaacgggaggaagggctagcgtccatgccggccggcgcctgcgttgactcggtccaagcacgcgcgcacagtctcacaatgagctgtcgctcggttttgacttggtatacggcttgtctcccaatcccaatccttgctgttctcaagctcaaagggagctcaaccgaacggcaatggagggctcagtcagagcgcagctgtcattgcatacggcaggtgattgggtgcgcgattagtgtgtaattttagcagacgagtagcgatgatgacaacaagtgctttcttgttactgctgtttggatgtagtatactactgttacagccactcttaaatattctactaattttttttagaaacaagattttcccgctttatttcgaagaaacaaagcaccgagtgtagaaaattctgttacagcaaattcaattcaacgtattctactaattcgagagaaaa

SEQ ID NO: 914 - DNA, 2427 bp, Zea mays
gggctctggctctcttccttctgcctctcctccacagaagagtcagtcatcacaactcacacgagccacttgaccagcgagtcacagtcagcgcaggccgctccccttcggcttatcatatattccacagacgcgcgagctatgtcactcaccgggccagggccagagaagcggcaaagcagagagtcggcgaggacgagactacgagaggaggaggagcgcgtgtgctttggtttggagcgagcgatggtgttcgcgtccgggtccgccgccggcgggccgcaggtgctgacggcgcggttcgtgcggcaggtggtgcagggccggtggttcatggtgttcgcgtgcctgctcatcttgtcggcgtcgggcgccacctacatcttcagcatctactccaaggtgctcaagtcgacgctggggtacgaccagcgcacgctcaacacgctctccttcttcaaggacctgggcgccaacgtgggcgtcatttcgggcctcatcaacgaggtcacgccgccgtgggtggtgctcgccatgggcgccgccatgaacctggcgggctacctcatgatctacctcgccatcgacgggcgcaccgccaggccccccgtctggctcatgtgcatctacatctgcgtgggcgccaactcccagtccttcgccaacaccggcgcgctcgtcacctgcgtcaagaacttcccggagagccgcggcgtcgtgctcggcctcctcaagggcttcgtcggcctcagcggcgccatcttcacgcagctctacctcgccatctacggcgacgacgccaagtcgctcgtgctgctcatcgcctggctccccgccgccgtcaccatcctcttcgtccacaccgtccgcatcatgccgtacccgcgcgccagccgacgccggggcccgtcagcggcagccaccagcaacgacgccttcttctgcttcctctacatctccatcgcgctcgcgacctacctcctcgtcatgatcgtggtgcagaagcaggtcaacttctcgcacgccgccttcgcggtctcggccgcggcgctgctcctcatcctcttcctgccgctcgccgtcgtcgtcaagcaggagtacaagatccagaaggagctggaggagtccctccgcgaggaccccacggtgaccgtggagaaaccggccaccgcagcttcgctgcagctggtggcagcagcagcagcagcacctgaaccagcggtggctcagagcatgactacgggaacagaggccaagcggtccagctgcctggggtcttgccttcggcacatgttcagcccgccggcgcagggggaggactacaccatcctgcaggcgctggtgagcgtggacatgctggtgctgttcctggccaccatctgcggcgtgggcggcacgctgacggcgatcgacaacatggggcagatcgggcagtccctgggatacccggccaagagcatcaacacgttcgtctccctcatcagcatctggaactacgccgggcgcgtcaccgccgggttcgcgtcggaggtgttcctggcgcggtacaagttcccgcggccgctcatgctcacgctggtgctcctgctctcgtgcgtcggccacctcctcatcgccttcggcgtgccgcagtcgctgtacgtggcctccgtggtgatcggcttctgcttcggcgcgcagtggccactgctgttcgccatcatctccgaggtgtttgggctcaagtactactccacgctctacaacttcgggtccgtggccagccccatcggcgcctacgtgctcaacgtccgcgtcgcgggggcgctctacgacgtggaggccgccaagcagcacggcggctccctggcgggcggcgcagacaagacctgcatcggcgtgcagtgcttccgcaaggcgttcctcattatcacggccgccacggtcgccggcgcgctcgtgtcgctggtgctggtgtggcggaccaggaacttctacaggggcgacatctacgccaagttcagggacagcgccgacgcggacgccgccgaggaaagggcggaggcggagatcgggtcaacggaggttaacgggaggaagcagtagggtagtatagtacagatatagagcacggctcgcactaatgtccatggcggccgccggccggggcccggcggttgcgttgactcggtctaggtcgaagcagccacacacccacaccgtcagtccgtcacacagtgctagctaacgcttcttctgactttggcatacgtgtcatcatctgtcatctcccaatcctagctgttcttgttctggagcccaaattggatggcaactggctgtggaaggcctcagcaggagcagtctaatgggtctctgaaagtagctgtcactgctaactgaaggcgattaggtactttgttaataatattcaactaaggtgatgag

SEQ ID NO: 915 - DNA, 2601 bp, Zea mays
gccatgacagaacagacacacatagtgaagatgcagggccacataatgttcctatggtcaaggttcaaccctggagcttgaggagtgactgagtgaggtgcgagataatttggcgctcacacacaaactactaaccaacctctgggctctggctctcttccttctgcctctcctccacagaagagtcagtcatcgcaactcacacgagcaacttgaccagcgagtcacagtcagagtcagcgcaggccgctccccttcggcttatcatatattccacaggcgcgcgagctatgtcactcaccgggccagagccagagaagcggcaaagcagagagtcggcgaggacgagactacgagtggaggaggagcgcgtgtgctttggtttggagcgagcgatggtgttcgcgtccgggtccgccgccggcgggccgcaggtgctgacggcgcggttcgtgcggcaggtggtgcagggccggtggttcatggtgttcgcgtgcctgctcatcttgtcggcgtcgggcgccacctacatcttcagcatctactccgaagtgctcaagtcgacgctggggtacgaccagcgcacgctcaacacgctctgcttctacaaggacctgggcgccaacgtggacgtgggcgtcatttcgggcctcatcaacgaggtcacgccgccgtgggtggtgctcgccatgggcgccgccatgaacctggcgggctacctcatgatctacctcgccatcgacgggcgcaccggcaggccccccgtctggctcatgtgcatctacatctgcgtgggcgccaactcccagtccttcgccaacaccggcgcgctcgtgacctgcgtcaagaacttcccggagagccgcggcgtcgtgctcggcctcctcaagggcttcgtcggcctcagcggcgccatcttcacgcagctctacctcgccatctacggcgacgacgccaagtcgctcgtgctgctcatcgcctggctccccgccgccgtcaccatcctcttcgtccacaccgtccgcatcatgccgtacccgcgcgccagccgacgccggggcccgtcagcggcagccaccagcaacgacgccttcttctgcttcctctacatctccatcgcgctcgcgacctacctcctcgtcatgatcgtggtgcagaagcaggtcaacttctcgcacgccgccttcgcggtctcggccgcggcgctgctcctcatcctcttcctgccgctcgccgtcgtcgtcaagcaggagtacaagatccagaaggagctggaggagtccctccgcgaggaccccacggtgaccgtggagaaaccggccaccgcagcttcgctgcagctggtggcagcagcagcagcagcacctgaaccagcggtggctcagagcatgactacgggaacagaggccaagcggtccagctgcctggggtcttgccttcggcacatgttcagcccgccggcgcagggggaggactacaccatcctgcaggcgctggtgagcgtggacatgctggtgctgttcctggccaccatctgcggcgtgggcggcacgctgacggcgatcgacaacatggggcagatcgggcagtccctgggatacccggccaagagcatcaacacgttcgtctccctcatcagcatctggaactacgccgggcgcgtcaccgccgggttcgcgtcggaggtgttcctggcgcggtacaagttcccgcggccgctcatgctcacgctggtgctcctgctctcgtgcgtcggccacctcctcatcgccttcggcgtgccgcagtcgctgtacgtggcctccgtggtgatcggcttctgcttcggcgcgcagtggccactgctgttcgccatcatctccgaggtgtttgggctcaagtactactccacgctctacaacttcgggtccgtggccagccccatcggcgcctacgtgctcaacgtccgcgtcgcgggggcgctctacgacgtggaggccgccaagcagcacggcggctccctggcgggcggcgcagacaagacctgcatcggcgtgcagtgcttccgcaaggcgttcctcattatcacggccgccacggtcgccggcgcgctcgtgtcgctggtgctggtgtggcggaccaggaacttctacaggggcgacatctacgccaagttcagggacagcgccgacgcggacgccgccgaggaaagggcggaggcggagatcgggtcaacggaggttaacgggaggaagcagtagggtagtatagtacagatatagagcacggctcgcactaatgtccatggcggccgccggccggggcccggcggttgcgttgactcggtctaggtcgaagcagccacacacccacaccgtcagtccgtcacacagtgctagctaacgcttcttctgactttggcatacgtgtcatcatctgtcatctcccaatcctagctgttcttgttctggagcccaaattggatggcaactggctgtggaaggcctcagcaggagcagtctaatgggtctctgaaagtagctgtcactgctaactgaaggcgattaggtgcacgtttactgtgtagtcctttatcataaaaaaactgttttttacttctgc

SEQ ID NO: 916 - DNA, 2625 bp, Setaria italica
gctcactttctgcagtgtccataagagtttagtcacacacccttctcctaccatccacccatccccttctatatattgcacaggcgcgccgcgctctgtgtgcctgtgtcactcaccggctcgccaccagacaggcggcggcgaagcagagcgccgccgagaaagtaggacgagtggcgcgatggcgttcgcgtccggggacggcggcggcggcgggccgcaggtgctgacggcgcggttcgtccggcaggtggtgttgggccgttggttcatggtgttcgcgtgcctgctcatcctgtcggcgtcgggggcgacgtacatcttcggcatctactccaaggtgctcaagtcgtcgctgggctacgaccagcgcacgctcaacacgctctccttcttcaaggacctgggcgccaacgtcggcgtcctctcgggcctcatcaacgaggtgacgccgccgtgggtggtgctcgccatgggcgccgccatgaacctggttggctacctcatgatttacctcgccatcgacgggcgtacggcgcggccccccgtgtggctcatgtgcatctacatctgcgtgggcgccaactcgcagtccttcgccaacacgggcgcgctcgtcacctgcgtcaagaacttccccgagagcaggggcatcgtgctgggcctgctcaagggcttcgtcggcctcagcggcgccatcttcacgcagctctacctcgccatctacggcgacgatgccaagtcgctcgtgctgctcatcgcctggctccccgccgccgtctccatcctcttcgtccacaccatccgcatcatgccgtacccgcgccccacccggcgtggcgccgccgccggcgcgtcgtcggcgaccagcaacgacgctttcttctgcttcctctacatctccatcgcgctcgcgacctacctcctcgtcatgatcgtcgtgcagaagcaggtcaacttctcgcacgccgcctacggggtgtccgccgccgcgctgctcctcgtcctcttcctgcccctcgccgtcgtcgtcaagcaggagtacaagatccagaaggagctccaggagtccctccgcgagcaccccaccgtgaccgtcgagaagccagctgctgacctgcagatggtggcagctgatgagccggcggccaacaagagccagctgcagagcaccactgaacaaacagaggagacgtcgccgccgccgtccggctgcctgggctcgtgcctccggcacatgttcagcccgcccgcgcagggggaggactacacgatcctgcaggcgctggtgagcgtggacatgctggtgctgttcctggcgaccatctgcggcgtgggcggcacgctgacggcgatcgacaacatgggccagatcgggcagtccctggggtacccggccaagagcattaacaccttcgtctccctcatcagcatctggaactacgcggggcgcgtcacctccgggttcgcctcggagatcttcctgacccggtacaggttcccgcggccgctgatgctgacgctggtgctcctgctctcgtgcgtgggccacctcctcatcgccttcggcgtgccgcagtccctctacgcggcgtcggtggtgatcggcttctgcttcggcgcgcagtggccgctgctgttcgccatcatctccgaggtgttcgggctcaagtactactccacgctctacaacttcgggtccgtcgcgagccccatcggcgcctacgtgctcaacgtccgcgtcgccggcgggctctacgacgccgaggccgccaggcagcacggcgggtccctcgccggcggcgacaagacctgcatcggcgtgcagtgcttccgcaaggcgttcctcatcatcaccgccgccacggtggccggggcgctcgtgtcgctggtgctcgtgtggcggaccaggaagttctacaagggagacatctacgccaagttcagggacaacgccgccgctgccgccgccgacgccgaggaggaggatctcaagcggcccaaggagacggagggggagtcaacggaggtcaacgggaggacgggctagtgtactagactactagtgtcgtgccggccgggcgcttgcgttgactcggtcgaagcaagcagccacacccacacacagcgagctaacgctcggttttgacttggtatacgtgtcgtctcccagtccacgccgtcctcaatcaagctcaaagagagctcaaccgaacagcggcaatggaggcctggagggctctgtcagagtgcagctatcactgcattacggcaggtgattgggtgcacgattagtgtgtaatctttttagcagaagagcagtagtgacagtatagaacaagtcctttcttcttgctgctgtatggatgtatacttgttactgccactcttaatcttctactaattcgagagagaggagagaagaggccaagttccatggttaaaatgttcttgataagctgcatgacgaacccggacgacattacacgactgcaggcgattgtgattggctccatactctgtccgaccgacagtattacgagtgctccttggacttgcgattagcgatgacgcgagaagttgagacatgagacggctgcttttcaagcttcatgcttgtctcct

SEQ ID NO: 917 - DNA, 2577 bp, Setaria italica
ctcactttctgcagtgtccataagagtttagtcacacacccttctcctaccatccacccatccccttctatatattgcacaggcgcgccgcgctctgtgtgcctgtgtcactcaccggctcgccaccagacaggcggcggcgaagcagagcgccgccgagaaagtaggacgagtggcgcgatggcgttcgcgtccggggacggcggcggcggcgggccgcaggtgctgacggcgcggttcgtccggcaggtggtgttgggccgttggttcatggtgttcgcgtgcctgctcatcctgtcggcgtcgggggcgacgtacatcttcggcatctactccaaggtgctcaagtcgtcgctgggctacgaccagcgcacgctcaacacgctctccttcttcaaggacctgggcgccaacgtcggcgtcctctcgggcctcatcaacgaggtgacgccgccgtgggtggtgctcgccatgggcgccgccatgaacctggttggctacctcatgatttacctcgccatcgacgggcgtacggcgcggccccccgtgtggctcatgtgcatctacatctgcgtgggcgccaactcgcagtccttcgccaacacgggcgcgctcgtcacctgcgtcaagaacttccccgagagcaggggcatcgtgctgggcctgctcaagggcttcgtcggcctcagcggcgccatcttcacgcagctctacctcgccatctacggcgacgatgccaagtcgctcgtgctgctcatcgcctggctccccgccgccgtctccatcctcttcgtccacaccatccgcatcatgccgtacccgcgccccacccggcgtggcgccgccgccggcgcgtcgtcggcgaccagcaacgacgctttcttctgcttcctctacatctccatcgcgctcgcgacctacctcctcgtcatgatcgtcgtgcagaagcaggtcaacttctcgcacgccgcctacggggtgtccgccgccgcgctgctcctcgtcctcttcctgcccctcgccgtcgtcgtcaagcaggagtacaagatccagaaggagctccaggagtccctccgcgagcaccccaccgtgaccgtcgagaagccagctgctgacctgcagatggtggcagctgatgagccggcggccaacaagagccagctgcagagcaccactgaacaaacagaggagacgtcgccgccgccgtccggctgcctgggctcgtgcctccggcacatgttcagcccgcccgcgcagggggaggactacacgatcctgcaggcgctggtgagcgtggacatgctggtgctgttcctggcgaccatctgcggcgtgggcggcacgctgacggcgatcgacaacatgggccagatcgggcagtccctggggtacccggccaagagcattaacaccttcgtctccctcatcagcatctggaactacgcggggcgcgtcacctccgggttcgcctcggagatcttcctgacccggtacaggttcccgcggccgctgatgctgacgctggtgctcctgctctcgtgcgtgggccacctcctcatcgccttcggcgtgccgcagtccctctacgcggcgtcggtggtgatcggcttctgcttcggcgcgcagtggccgctgctgttcgccatcatctccgaggtgttcgggctcaagtactactccacgctctacaacttcgggtccgtcgcgagccccatcggcgcctacgtgctcaacgtccgcgtcgccggcgggctctacgacgccgaggccgccaggcagcacggcgggtccctcgccggcggcgacaagacctgcatcggcgtgcagtgcttccgcaaggcgttcctcatcatcaccgccgccacggtggccggggcgctcgtgtcgctggtgctcgtgtggcggaccaggaagttctacaagggagacatctacgccaagttcagggacaacgccgccgctgccgccgccgacgccgaggaggaggatctcaagcggcccaaggagacggagggggagtcaacggaggtcaacgggaggacgggctagtgtactagactactagtgtcgtgccggccgggcgcttgcgttgactcggtcgaagcaagcagccacacccacacacagcgagctaacgctcggttttgacttggtatacgtgtcgtctcccagtccacgccgtcctcaatcaagctcaaagagagctcaaccgaacagcggcaatggaggcctggagggctctgtcagagtgcagctatcactgcattacggcaggtgattgggtgcacgattagtgtgtaatctttttagcagaagagcagtagtgacagtatagaacaagtcctttcttcttgctgctgtatggatgtatacttgttactgccactcttaatcttctactaattcgagagagaggagagaagaggccaagttccatggttaaaatgttcttgataagctgcatgacgaacccggacgacattacacgactgcaggcgattgtgattggctccatactctgtccgaccgacagtattacgagtgctccttggacttgcgattagcgatgacgcgaga

SEQ ID NO: 918 - DNA, 1548 bp, Sorghum bicolor
tcccgttaacctcgctctccgcctccgccgtctccttgggccgcttcagatcctccgcctccgcctcggcggcgtccgcgctttccctgaacttggcgtagatgtcgcccttgtagaagttccatgtccgccacaccagcaccagcgacacgagcgcgccggcgaccgtggcggcggtgatgatgaggaacgacttgcggaagcactccacgccgatgcaggtcttgtcgccggcgcccaccagggacccgccgtgctgcttggcggcctcgacgtcgtagagcgcccccgcgacgcggacgttgagcacgtaggcgccgatggggctggccacggacccgaagttgtagagcgtggagtagtacttgagcccgaacacctcggagatgatggcgaacagcagcggccactgcgcgccgaagcagaagccgatcaccacggaggacacgtagagcgactgcggcacgccgaaggcgatcagcaggtggccgacgcacgagagcaggagcaccagcgtcagcatcagcggccgcgggaacttgtaccgcgccaggaacacctccgacgcgaacccggcggtgacgcgaccggcgtagttccagatgctgatgagggagacgaaggtgttgatgctcttggccgggtaccccagcgactgcccgatctgacccatgttgtcgatcgccgtcagcgtgccgcccacgccgcagatggtggccaggaacagcaccagcatgtccacgctcaccagcgcctgcaggatggtgtagtcctccccctgcgccggcgggctgaacatgtgccgaaggcaagaccccaggcagctgctggagctggacgacggcctcgacggctcggcggcggcctctgtcgttcccgtcgtcatgctctggctctgaggtggtgctgctgccagctgcagcgaggctggtttctccacggcgatgagcagcacgagcgacttggcgtcgtcgccgtagatggcgaggtagagctgcgtgaagatagcgccgctaaggccgacgaatcccttgaggatgccgagcacgacgccgcggtcctccgggaagttcttgacgcaggtgacgagcgcgccggtgttggcgaaagactgggagttggccccaacgcagatgtagatgcacatgagccagacgggtggcctggcggtgcgcccgtcgatggcgaggtagatcatgaggtagcccacaaggttcatggcggcgcccatggcgagcaccacccacggcggcgtgacctcgttgatgaggcccgagatgacgcccacgttggcgcccaggtccttgaagaaggagagcgtgttgagcgtgcgctggtcgtaccccagcgacgacttgagcaccttggagtagatgctgaagatgtacgtcgccccggacgccgacaggatgagcaggcatgcgaacaccatgaaccaacggcccagcaccacctgccgcacgaaccgcgccgtcagcacctgcgggccgccggcggcgccggacccggacgcgaacaccatcgcgcgcgcgccaaactaaagctcct

SEQ ID NO: 919 - DNA, 2817 bp, Oryza sativa
accggacaagccaagcgcgcggcgcgtccacacacatttgcatagccacagccaagaagcgacgcgatggtgacggcggagtcgggcgtcgccggcggcggccgtggcgcggcggcgctgctgcgggaggtggcgacggcgcggttcgcgcggcaggtggtgctggggcggtggttcatggtgttcgcgtgcctgctgatcctgtcggcgtcgggggcgacgtacatcttcgggatctactccaaggtgctcaagtcgtcgctgggctacgaccagcggacgctgaacacgctctccttcttcaaggacctcggcgccaacgtcggcgtcatctccggcctcatcaacgaggtgacgccgccgtgggtggtgctcgccatgggcgccgccatgaacctcgcgggctacctcatgatctacctcgccatcgacggccgcacggcgcggccccccgtgtggctcatgtgcatctacatctgcgtcggcgccaactcgcagtcgttcgccaacaccggcgcgctcgtcacctgcgtcaagaacttcccggagagccggggcatcgtgctcggcttgctcaaggggttcgtcggcctcagcggcgccatcttcacgcagctctacgtcgccatctatggcgacgacgccaagtcgctggtgctgctcatcgcgtggctccccgccgccatctccatcctgttcgtccacaccgtccgcatcatgccgtacctccccagccgccgccgccgcgccgacggcgagctcgaggcctccgccgccaccagcaacgacgccttcttctgtttcctctacatctccatcgcgctcgccacctacctgctcaccatgatcgtggtgcagaaccagaccaacttctcgcacactgcctacgtcgtgtcggccaccgcgctcctcctcgtcctcttcctcccgctcgtcgtcgtcatcaagcaggagtaccagatcaagaaggagctcgacgactccctccgcgagccccccacggtgaccatcgaaaagccagccgccgccgccatgcaaatgtcagcgatcaccaccaagcccaaaaccgagacaccgtcgtcgtcgtctccggcgccggcgccgccgtcttgctgcctcggttcttgcctgaagcacatgttcaacccgccggcgcagggggaggactacaccatcctgcaggcgctggtgagcgtggacatgctggtgctgttcctcgccaccatctgcggcgtcggcggcacgctgacggcgatcgacaacatggggcagatcgggcagtcgctggggtacccggcgaagagcatcaagacgttcatctcgctcatcagcatctggaactacgcgggccgcgtcacctcgggcttcgcgtcggagatgttcctcgcccgctacaggttcccgcggccgctgatgctcacggcggtgctcctcctcgcctgcgtcggccacctcctcatcgcgttcggcgtcgcgcagtctctctacgccgcctccgtcatcatcggcttctgcttcggggcgcagtggccgctcctcttcgccatcatctccgaggttttcggcctcaagtactactccacgctctacaacttcggctccgtggcgagccccgtcggcgcctacgtcctcaacgtccgcgtcgccggctacctctacgacgtcgaggcggccaggcagcacggcggctcgctcgccggcggcgacaagacctgcctcggcgtgcagtgcttcaggaaggccttcctcatcatcaccgccgccaccgtcgccggcgcgctcatctccctcgtgcttgtctggaggacaaggaacttctacaagggggacatctacgccaagttccgcgagaacaccgccaccgacgaagctaccaccaacggtaactccgccgatacagcggcggaaaaaaggtcaaccttagtcaatgacgaggacagtaaaaaggggtagtaatgtagtttactgatacaaaaattactacaccaaaagacaagagcttgttacttcttattagcagaaaagtcaaaaaatggtaggcttgctgctaatataagttaccagatatctgtaaaaaattttggggctagaaagaaagagtctactactagtggagtaaacaagattaggcagcagctctgtgcttgtacccattacaagcaacagtaagctgcaagctagagtaaaatactgtcactgtaagaagttgggtgattaaggccctgtttagatgggactaaaagttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcatgaattagcttttatttatgtaattagttttgtaagtagtctatatttaatactctaaattagtgtctaaagacagggactaaagttaagtcactggatctaaacaccacctaactgatgaaacattggcttctgcctctgctcaagatgggcttaattatgctgtaattaattaccttggcaaaggccggtttgaccattaaaatggatgagacggatgaagccatggatgaatgccggccacagcctgggctagtgacggtgatgtctaaacatgaggtggagctttttttggctgctgctgaatcactccatcatatgcaaacgtttgtttctttgcatcatgcataagctttgaattttgatgagaaccagg

SEQ ID NO: 920 - DNA, 768 bp, Saccharum officinarum
ttagagccaggagaagagaaaaataactcggaaaagaaagagacgccgaaaattcgaagggggaagaggaggaggagaggggaaagcgaagcaaatggcggagcccccgagcaagatcgaatccatgaggaagtgggtcgtcgaccacaagctccgagccgtaggttgcctctggttaggtgggatcagcagttcgatcgcctacaactggtcgcggcccaatatgaagactagcgtcaagatcatccacgcaaggttgcatgcgcaggctctaactctagctgcattaattggttctgcatgcgtggagtactatgacaataagtatggttcttctgggccaaaggtggacaaatacacaagccaatacctggcccattcgcataaagattaagatctccatgttggttcctgcataccggattaaaatttgggctcatctcttggtgctcatgacccgcctggggatgctggatgtttattctttttgcttcttattaattacaaaatgatggatgtttattctttttgtcttcttattaattacaaaatgatggtgtacttaccagggaaatgataatgagggtataatgcaaaaattgtcgtcataatttggcctcatggtgcactatctaacctcactttgttgactgtcaacatctttgaatatttttatgttttttgagaaaaggaaaagggatcctgatttgtgcctaaaatttgaattcttgtgcccctgtacttttgttcttggtcctgggttgttga

SEQ ID NO: 921 - DNA, 634 bp, Zea mays
agccaaaaaaaaaaagaataaatcggaaaagcaagagacgccgaaaattcgaagggggaagaggagaagaggggaaagaagcaaatggcggaggccccgagcaagatcgaatccatgaggaagtgggtcgtcgagcacaagctccgagccgtaggttgcctctggctaggtgggatcagcagttcgatcgcctacaactggtcgcggcccaatatgaagactagcgtcaagatcatccacgcaaggttgcatgcgcaggctctaaccctagctgcattagttggttctgcatgcgtggagtactatgaccagaagtatggttcttctgggccaaaggtggacaagtacacaagccaatatctggcccattcgcataaagattaaggtccccatgttggttcatctcttgactcttggtgctcatgacccgcccgtggatgctggatgtttattctttttgtcttcttactttaaaaatggtgtacttgccagagaaatgataatgggggatataatgcagataattatcatcataatttagcgttatgttgcattgtctaaccgctctgttgactctcagcatcttcgaatattctttttatattttttgagaaaaggaaagaagatcctgatt

SEQ ID NO: 922 - DNA, 934 bp, Panicum virgatum
tggatactaagctaattcgaacatatttcagggactaaaacacaaacagtgcggtatataacaagagccagacagactttcccccatcaaagcgatagaacaacgagaactcggtcctctcaaaaaaaaacaacgagaactcgggaaaggagagggcgaaaatccgaaaggaagaagaggagagcgcgaagcaaatggcggaggcccccagcaagatcgaatccatgaggaaatgggttgtcgagcacaagctccgagccgtaggttgcctctggcttactgggatcagcagttcgatcgcctacaactggtcgcggcccaatatgaagactagcgtcaagatcatccacgcaaggttgcacgcgcaggctctaactcttgctgcattggttggttctgcatgtgtcgagtactatgataacaaatatggttcttctgggcctaaggtggacaaatacacaagccaatacttggcacattcgcataaagattaagatctccatgttggctcctgcataccggattaattttgggtgctcatgaaccatgtacctggatgctggatagttattctttgtctccccttaatgcaaaatgacagcgtacttgccagggtattcctggaaaatgacattaaggttgtagtgcagatattatcttcataatttagcctcaggttgcgttatgtaacatcacattgtggacagtcctgggatatttgtacttcttttttccaagaaaagcaaaggagagagatcctgatttgtgctgaaactgtgttttctctttctctttgttcgtgtgtgcttctatgattttctcactccctcgatcgactagagaacaatcatgcaatgtgaagtgctacaaagatgaccagctctcatgtgtattttctggagtagaaacataagtgaatgaattagaacttcac

SEQ ID NO: 923 - DNA, 660 bp, Setaria italica
accagaacgagagaggaagaactcgaaaaagacagaaggcgaaaattcgaaggaaagaagaagaggagaacgcgaagcaaatggcggagggcccgagcaagatggaatccatgaggaagtgggtcgtcgagcacaagctccgtgccgtaggttgcctctggctcactgggatcagcagttcgatcgcctacaactggtcgcggcccaatatgaagcctagcgtcaagatcatccacgcaaggttgcatgcgcaggctctaacccttgctgcattggttggttctgcatgtgtggagtactatgataacaaatatggttcttctgggcctaaggtggacaagtacacaagccaatacctggcacactcgcataaagattaagatctccatgttcattcctgcatagcggattaattttgggctcatttctgggtgctcaactgctcattaactatgtccctggatgctggatggttctctttgcccccttattaatgcaaaatgacagtgtacttgccagggcattcctgggaaatggcatagagggtgtaatggtgatatcaccttcataatttagcctcaggttgcattatgcaacatcacattgtgaaccttccttggatgtttttatcttttttccccaaagaaaagcaaaggagag

SEQ ID NO: 924 - DNA, 836 bp, Setaria italica
accagaacgagagaggaagaactcgaaaaagacagaaggcgaaaattcgaaggaaagaagaagaggagaacgcgaagcaaatggcggagggcccgagcaagatggaatccatgaggaagtgggtcgtcgagcacaagctccgtgccgtaggttgcctctggctcactgggatcagcagttcgatcgcctacaactggtcgcggcccaatatgaagcctagcgtcaagatcatccacgcaaggttgcatgcgcaggctctaacccttgctgcattggttggttctgcatgtgtggagtactatgataacaaatatggttcttctgggcctaaggtggacaagtacacaagccaatacctggcacactcgcataaagattaagatctccatgttcattcctgcatagcggattaattttgggctcatttctgggtgctcaactgctcattaactatgtccctggatgctggatggttctctttgcccccttattaatgcaaaatgacagtgtacttgccagggcattcctgggaaatggcatagagggtgtaatggtgatatcaccttcataatttagcctcaggttgcattatgcaacatcacattgtgaaccttccttggatgtttttatcttttttccccaaagaaaagcaaaggagagagatcctggtttttgccgaactgttttgtgttctctgtctcttgttcatgcgtgcttgtatgctgctggcaacgcaaatcagagatgcttttaacgatgatttgtagttgtggatatgtactactcgcaaattacaactttattataataaaattcagcctatgctctatacaaaa

SEQ ID NO: 925 - DNA, 777 bp, Pennisetum glaucum
ggtggtttcggaatggtctcaaatggaagagttgaacgagagagaaaaagaactcgaaaaagagaggaggcggaaattcgatggaaggaagaaaggagaacgcgaagcaaatggcggagggcccgagcaagatggaatccatgaggaagtgggtcatcgaccacaagctccgtgccgtaggttgcctctggctcactgggatcagcagttcgatcgcctacaactggtcgcgtcccaacatgaagcctagcgtcaagatcatccacgcaaggttgcatgcacaggctctaacccttgctgcattggttggttctgcatgtgtggagtactatgataacaaatatggttcttccgggcctaaggtggacaagtacacaagccagtacttggcacactcgcataaagattgagatctccatgttggctcctgcatagcggattaattttgggcccatttctgggtgctcattaacatatccctggttctggatgggtattctttgtctccttagtaatgcaaaatacagtgtacttgccagggcattccggggaaatggcattgagggtataacagtgatattatcttcataaatttagcctcaggttgcattatgcaacatcacattgtggaccgaccttggatgtttttatctttttttccccacaaagaaaagcaaaggagagggatccctggttttgccgaactgtgttatgtgttctcttgttcatgtgtgcttgtatgcttctggcaaggcaaatcagaaatgctttaaatga

SEQ ID NO: 926 - DNA, 550 bp, Echinochloa colona
cgaaaatccgaagggaagaagaggagaacgcgaagcaaatggcggaagccccgagcaagatcgaatccatgaggaagtgggtcatcgaccacaagctccgagccgtaggttgcctctggctcactgggatcagcagttcaatcgcctacaactggtcgcggcccaatatgaagcctagcgtcaagatcatccacgctaggttacatgcgcaggctttaacccttgctgcattggttggttctgcatgtgttgagtactatgaccagaaatatggttcttctgggcctaaggtggacaagtacacaagccaatacctggcacactcgcataaagattaagatctccatgttggttcctgcatactggattaattttgggctcatttctgggtgctcagagcttatgtccctagatgctggatggttaatctttttgtctccttaattgcaaaatgatggtgtactcgccagggcattttctgggatttgacagtgagggtgtaatacaggtattatcttcataatcctcaggttgcgttatgtaacatcac

SEQ ID NO: 927 - DNA, 701 bp, Cynodon dactylon
gaattcggccattacggccggggatatcgagacgagagaaaagggacttcatcagaaaaaagagaggagggcgaaaattaggagggaagaacaagaggagaaggcgaagcaaatggcggaaacccccagcaagatcgaatccatgaggaagtgggtcgtcgaccacaagctccgtgccgtaggttgcctctggctcactgggatcagcggttccatcgcgtacaactggtcgcggcccaacatgaagaccagcgtcaagatcatccacgcaaggttgaatgcacaggctctaactctggctgcactggttggttctgcatgcgtggagtactatgaccagaaatatggttcttctggaccaaaggtggacaaatacacaagccaataccttgcacactctcataaagagtaggacctccatgtttgtgctggacgccggattagttttgggttcacttctggggtgccgatgaggcatgggatatgttcctggatgccggatggttcctttttgtttaaactgcaaatggtagttcttgccagttgccagggcattcctgggaaatgggaatgagggtgtaatgcagatattaatcttcataatttaacttggggttgctttatgtaaagtaaagttgcattgttgcaaatattggatatcattatcttcttcaaagaaaaaagagagtaaatttgcatcc

SEQ ID NO: 928 - DNA, 661 bp, Echinochloa colona
aaaacgagagagaaagaactccgaacagggagagaagccgaaaatccgaagggaagaagaggagaacgcgaagcaaatggcggaagccccgagcaagatcgaatccatgaggaagtgggtcatcgaccacaagctccgagccgtaggttgcctctggctcactgggatcagcagttcaatcgcctacaactggtcgcggcccaatatgaagcctagcgtcaagatcatccacgctaggttacatgcgcaggctctaaccgttgctgcattggttggttctgcatgtgtggagttctatgaccagaaatatggttcttctgggcctaaggtggacaagtacacaagccaatacctggcacactcgcataaagattaagatctccatgttggtttcctgcatactggattaattttgggctcatttctgggtgctcagagcttatgtccctagatgctggatggttaatctttttgtctccttaattgcaaaatgatgatgtactcgccagggcattcctgggattggacagtgagggtgtaatgcagatattatcttcataatcctcaggttgcgttatgtaacatcacattgtggtcagtccttggatgcttttatcttttttccccaagaaaagcaaaagagcaatcctggttaatgcca

SEQ ID NO: 929 - DNA, 761 bp, Oryza sativa
gcaattttgcaacgagagagaagaaaagagctcgaaaaaaaaaagaaagaagaaaaacaaagcgcgtaaagagaagcgagagaaatcggagaggaagatgggggaagaggcggcgaagcaaatggcggaagccccgggcaagattgaatccatgaggaagtgggtcatcgaccacaagctccgcgccgtaggttgcctatggcttactgggatcagcagctcgattgcgtacaactggtcgaggcccaatatgaagactagcgtcaagatcatccatgcaaggttgcatgctcaagccctaacactagcagcgttagtgggatctgcaatggtagagtactatgacgcgaagtacggcacatctggaccgaaggtggacaagtacacaagccaatacctggcgcattcacataaagattaagatcttcatattcgctgttggatggcgggttattttaggttcattttggggttcctatgagctccccatgatgattattttgtctccttaactacaaatgaaacttgccagggcattcctgagcaacgagggtgtaatacagggttgatctgcatagatcaatttcagattgcgatatgtaacctcacttgctgacaatcttattttattatttttcaacgaggaaaagtgttcctgtcttgcattgaatctgtcttagttttctgcagttgaatctgccgtaagatagaatggtccacggattttgttcttactgtttgtaatgcaggagcattcccca

SEQ ID NO: 930 - DNA, 529 bp, Secale cereale
taaacagagagagaaacagagcgcctaacttggaacgcgaacagcggagcagaggcggcgaagcaaatggcggaggccccgagcaagatcgaatccatgcggaagtgggtggtcgatcacaagctccgagccgtaggttgcctgtggcttagtgggatctccggctccatcgcgtacaactggtcgcggcccaacatgaagaccagcgtcaagctcatccacgcaaggttgcacgcgcaagctctgacactcgctgccttaggtggttgtgcattagtagagtactatgagcagaactacggctcttcaggaccaaaggtggacaaatatacaaggcattacatgtcacactcgcacaaagattaattatctgcatggtcggtgctggatcccggattagttttgggttctttcctgagctccatcaaggggctctgaggggcgagggttcctttcagttcttctttattgtgaaacgtaaatgtatactttgcctggttccctttccttggagtcaaacgttgaagta

SEQ ID NO: 931 - DNA, 1896 bp, Triticum aestivum
tcctcatcaccctcgccatggccaccgtcaagttggtgccgggggtcagcgggtacatcgccgccgagaagagcaaggttgttgagcagttgcagtcaggcagtgcatccgccaagaagaacctgcgaaccgagctgcccgccgtcggggatcccgacggagtcataggcgagctccaggcgctcaaagacaaggatgtgagatggcagggcaaatgctccggcactgtttatatcgctgggagcgagtctgaaggccatttttcacttataaacaaggcctactctatgttttcacacacaaatccactgcatcaggatgtattcaagagtgtggcacagttagaggctgaagtagttgcaatgacagctgctttgcttggcagcaaagaaaaagcgtctggtggacaaatttgtggcaatatgacgtcaggcggaactgaaagcatattgttggccgtcaaaacatcacgcgattatatgcagtcaaagaagggaatcacaaagcctgaaatgattattgctgaatcagctcattctgcctatgacaaagctgcccaatatttcaatattaaagtgcggcgtgtacctgtgaataaagaatttcttgcagatgtaaaaggattcaaacggtgcataaatggaaacaccataatgatggttggatctgcaccaggatttccccacggtttaattgaccccatcgaggaacttggggagttggcttcacaatatggcatttgcttgcatgttgatctatgccttggtggctttgtattgcctttcgcccataagcttgggtatccaattcctccttttgatttttctgtcaaaggtgttacgtcgatctcaacagatgttcataagtatgggctagccccaaaaggcaccagtactgtcctatacaggaatcatgaaattagaaagcaccaatttgttgctgtgactgaatggactggtgggctctatatttcccctactatggctggaagcaggccaggtggactagtcgcaggagcttgggctgcgatgatgtctcttggattgaatggttatttggaaagtactgggaaaatcatggaagtctcaaagaagatacaaaaaggaattgatgacatctcaggtttatttgtgattgggaagccagacatgaccgtcgtggcctttgggtcggacgcagtcgacatatttgaggtgaatgacataatgtcatcgaaaggatggcacctcaatgctcttcagagacccaacagtctgcacatctgcgtgacgcttcaacacacggctatctatgaggaattcctcaaggacctcgaggattccgtgaacacagtgaaagcgaatccagggcctatcagtggggggatggctcccatctatggcgccgctgggaagatgccggacagaggcacggtcaaggagttgcttgtggagttcatggacagctcttgctaaccattgattggttatctctctgtaacatgtatacgtacaagccgcagtgacagtgttgtgtgatcttctatatttggtttggctgcaaaactgaaggcacacaaggcctccaatatagacatgtatctatgtatcagttacattggttgcaataaagttacattttcagcctattgctcctatatactacttccttgctctctctgacaatcgcaattatgaccaagtttcgatgttatatttaccagccctttccagtttcctcagccatccagcgtcgccgcccttttcgcggacaagttcttccagcgcagctctaacatcagcaggcattttggtagaagaccccgcgacgtatattgcggcaccagcgcataacatgttcaacacccttgctctctgctccctgatcttgtgttgcacatacaccttctcaggttga

SEQ ID NO: 932 - DNA, 1909 bp, Secale cereale
cttcctctgcctaggctaccagtacactagcactatataacaattcaatcccatccaccaaccacaccaagaaaatcgctcgctcgctcgggatccagcttgaagttgccatggaggcggccgccgagctggcgcagcgcctgcgggccgccgccaacgaccggctggcggggcaggagccgctcctcctcgtcgccgcgccgctgctcgcgctcctcgccgcgcgcgccgtccacgccgccgccgccgacgtcgccgaccgcggcctccgcaccgtcctcatcaccctcgccatggccgccgtcaagttggtgccgggggttagcgggtacatcgccgccgagaagagcaaggttgttgagcagttgcagtcaggaagtgcatcctccaagaagaacctgcgaaccgagctgcccgccgtcggggatcccgacggagtcataggcgagctccaggcgctcaaagacaaggatgtgagatggcagggcaaatgctctggcacagtttatatcgctgggagcgagtccgaaggccatttttcactgataaacagggcctactctatgttttcacacacgaatccactgcatcaggatgtattcaagagtgtggcacagttagaggctgaagtagttgcaatgacagctgctttgcttggcagcaaagataaggcgtcaggtggacaaatttgtggcaatatgacgtcaggtggaactgaaagcatattattggccgtcaaaacaacacgcgattatatgcagtcaaagaagggaatcacaaagcctgaaatgataattgctgaatcagctcattctgcctatgacaaagctgctcaatatttcaatattaaagtgcggcgtgtacctgtgaataaggaatttcttgcagatgtaaaaggattcaaacggtgcataaatggaaacaccataatgatggttggatctgcaccaggatttccccatggtttgattgatcccattgaggaacttggggagttggcttcacaatatggtatttgcttacatgttgatctatgccttggtggcttcgtattgcctttcgcccgtaagcttgggtaccctattccaccttttgatttttctgtcaaaggtgttacgtcgatctcaacagatgttcataagtatgggctagccccaaaaggcaccagtactgtcctatacaggaatcatgaaattagaaagcaccaatttgttgctgtgactgaatggactggtgggctctatgtttcccctactatggctggaagcaggccaggtggactgatcgcaggagcttgggctgcgatgatgtctcttggattgaatggttatttggaaagtaccggtcaaatcatggaagtctcaaagaagatacaaaaaggaattgatggtatctcaggtttatttgtgattgggaagccagacatgaccgtcgtggcctttgggtcggacgcagtcgacatatttgaggtgaatgacataatgtcatcaaaaggatggcacctcaatgctcttcagagacccaacagtctgcacatctgcgtgacgcttcaacacacggctatctatgaggaattcctcaaggacctcgaggattccgtgaacacggtgaaagcgaatccagggcctatcagtggggggatggctccgatctacggcgcggctgggaagatgccggacagaggcacggtcaaggagttgcttgtggagttcatggacagctcttgctaaccattgcctataccccattggttatctccctgtgacatgtatacctacaagccgcagtgacagtgttgtgtgatcttctatatttggtttggctgcaaaactgaaggcacacaatgcctccaatatatacatgcatctatgtatcagttacattggttgcaataaagttgcattttcag

SEQ ID NO: 933 - DNA, 2158 bp, Secale cereale
gactgcttgaccgtacataggcacgcagtaataaacgcaagaatagagaagaattatgtcaagttttcattgcggaaagctggattatcatacactcttccccctcgtttatatacgctgacccggcgaccccggatccatcttcctcaacctcggtccagaatctcggagccggccgggagggaaggtcagctcctcggaccatcgtcgtcgtccctccatcctctttgccgccccccttcctctggccggctactactaccagtactagtagcagtatataacaattcaatcccgtccaccaaccacacctaagaaaatcgcgagcgagcttgggatccagcttccagttgccgttccatggaggcggccgccgagctggcgcagcgcctgcgggccgccgccaacgaccggctcgcggggcaggagccgctcctcctcgtcgccgcgccgctgctcgcgctcctcgccgcgcgcgccgcccacgccgccgccgccgacgtcgccgaccgcggcctccgcaccgtcctcatcaccctcgccatggccgccgtcaagttggtgccgggggttagcgggtacatcgccgccgagaagagcaaggttgttgagcagttgcagtcaggaagtgcgtcctccaagaagaacctgcgaaccgagctgcccaccgtcggggatcccgacggagtcataggcgagctccagacgctcaaagacaaggatgtgagatggcagggcaaatgctctggcacagtttatatcgctgggagcgagtccgaaggccatttttctctgataaacaaggcctactctatgttttcacacacaaatccactgcatcaggatgtattcaagagtgtggcacagttagaggctgaagtagttgcaatgacagctgctttgcttggcagcaaagataaggcgtcaggtggacaaatttgtggcaatatgacgtcaggtggaactgaaagcatattattggccgtcaaaacaacacgcgattatatgcagtcaaagaagggaatcacaaagcctgaaataataattgctgaatcagctcattctgcctatgacaaagctgctcaatatttcaatattaaagtgcggcgtgtacctgtgaataaagaatttcttgcagatgtaaaaggattcagacggtgcataaatggaaacaccataatgatggttggatctgcaccaggatttccccatggtttaattgatcccattgaggaacttggggagttggcttcacagtatggtatttgcttgcatgttgatctatgccttggtggctttgtattgcctttcgcccgtaagcttgggtatcctattcctccttttgatttttctgtcaaaggtgttacgtccatctcaacggatgttcataagtatgggctagctccaaaaggcaccagtactgtcctatacaggaatcatgaaattagaaagcaccaatttgttgctgtgactgaatggactggtgggctctatgtttcccctactatggctggaagcaggccaggtggactaatcgcaggagcttgggctgctatgatgtctcttggactaaatggttatttggaaagtaccggtcaaatcatggaagtctcgaagaagatagaaaaaggaattgatggtatctcaggtttatttgtgattgggaagccagacatgaccgtcgtggcctttgggtcggacgtggtcgacatatttgaggtgaatgacataatgtcatcaaaaggatggcacctcaatgctcttcagagacccaacagtctgcacatctgcgtgacgcttcaacacacggctatctatgaggaattcctcaaggacctcgaggattccgtgaacacggtgaaagcgaatccagggcctatcagtggggggatggctccgatctacggcgcggctgggaagatgccggacagaggcacggtcaaggagttgcttgtggagttcatggacagctcttgctaaccattgcctataccccattggttatctccctgtgacatgtatacctacaagccgcagtgacagtgttgtgtgatcttctatatttggtttggctgcaaaactgaaggcacacaatgcctccaatatatacatgcatctatgtatcagttacattggttgcaataaagttgcattttca

SEQ ID NO: 934 - DNA, 1804 bp, Secale cereale
ccatggaggcggccgccgagctggcgcagcgcctgcgggccgccgccaacgaccggctcgcggggcaggagccgctcctcctcgtcgccgcgccgctgctcgcgctcctcgccgcgcgcgccgtccacgccgccgccgccgacgtcgccgaccgcggcctccgcaccgtcctcatcaccctcgccatggccgccgtcaagttggtgccgggggtcagcgggtacatcgccgccgagaagagcaaggttgttgagcagttgcagtcaggaagtgcatcctccaagaagaacctgcgaaccgagctgcccgccgtcggggatcccgacggagtcataggcgagctccaggcgctcaaagacaaggatgtgagatggcagggcaaatgctccggcacagtttatatcgctgggagcgagtccgaaggccatttttcactgataaacaaggcctactctatgttttcacacacaaatccactgcatcaggatgtattcaagagtgtggcacagttagaggctgaagtagttgcaatgacagctgctttgcttggcagcaaagataaggcgtcaggtggacaaatttgtggcaatatgacgtcaggtggaactgaaagcatattattagccgtcaaaacaacacgcgattatatgcagtcaaagaagggaatcacaaagcctgaaataataattgctgaatcagctcattctgcctatgacaaagctgctcaatatttcaatattaaagtgcggcgtgtacctgtgaataaagaatttcttgcagatgtaaaaggattcagacggtgcataaatggaaacaccataatgatggttggatctgcaccaggatttccccatggtttaattgatcccattgaggaacttggggagttggcttcacaatatggtatttgcttgcatgttgatctatgccttggtggcttcgtattgcctttcgcccgtaagcttgggtaccctattcctccttttgatttttctgtcaaaggtgttacgtctatctcaacggatgttcataagtatgggctagctccaaaaggcaccagtactgtcctatacaggaatcatgaaattagaaagcaccaatttgttgctgtgacggaatggactggtgggttgtatgtttcccctactatggctggaagcaggccaggtggactaattgcaggagcttgggctgcgatgatgtctcttggattgaatggttatttggaaagtaccggtcaaatcatggaagtctcaaagaagatacaaaaaggaattgatggtatctcaggtttatttgtgattgggaagccagacatgaccgtcgtggcctttgggtcggacgtggtcgacatatttgaggtgaatgacataatgtcatcaaaaggatggcacctcaatgctcttcagagacccaacagtctgcacatctgtgtgacgcttcaacacacggctatctatgaggaattcctcaaggacctcgaggattccatgaacacggtgaaagcgaacccagggcctatcagcggggggatggctcccatctatggcgcggctgggaagatgccggacagaggcacggtcaaggagttgcttgtggagttcatggacagctcttgctaaccattgcctataccccattggttatctctctgtagcatgtgtacatacaagccgcagtgacagtcttgtgtgatcttctatatttggtttggctgcaaaactgaaggcacacaatgcctccaatatagacatgcatctatgtatcagttacattggttgcaataaagttacattttcagcca

SEQ ID NO: 935 - DNA, 2025 bp, Lolium multiflorum
agcaaggaaaaaataggcctcatttattgctctcgcagcacagctcgctttcttgcttgcttgtttgatcgtagatatctgccctctgaattcagctgagttcagagtttttcctctttgccggccggcccttcctccctcctctctgctcagtatataacaattcaatccggattccgtcaccaaccacacagacaacagtctcgccccctccctcgggatccatctcaagctcccatggaggcggccacccagctggcgctgcgcctgcgcgccgccgccaacgaccgcctcgcgggccacgagccgctcctgctcgccgcggccccaatcctcaccctcctcgccgcgcgcgccctccacgccgccgccggccacgttgccgaccgtggcctccgcaccgtcctcatcacgctagtcatggccgccctcaagatggtgccgggggttagcgcctacattgccgcgcagaagagcaaggtcgttgagcagctgcagtcaggcagcggatcggccaagaagaacctgcggaccgagctgccggacgtcggggtccccgacaaggtcatcgacgatctccaggtgctcaaggataaggacgtgaaatggcaggggaagtgctccggcacagtttatatcgctgggagcgagtccgatggccatttcgccctgataaacagggcttactctatgttttcacacacaaatcctctgcatcaggatgtattcaagagcgtggcacagttagaggctgaggtagttgcaatgacagctgctttgcttggcagcaaagaaaaggcatccggtggacaaatctgtggcaatatgacatcaggaggaacagagagcatattattagccgtcaaaacatcacgcgactatatgcaatcaaagaagggaatcacaaagcctgaaatgataattgctgaatcagctcattctgcctatgacaaagctgctcaatatttcaatattaaagtgagacgtgtacctgtgaataaagaatttcttgcagatgtaaaaggattcagacggtgcataaatggaaacactataatgatggttggatctgcaccaggatttccccatggtttaattgatcctatcgaggaacttggggagttggcttcacaatatggtatttgtttgcatgtcgatctatgccttggtggctttgtgttgcctttcgcccgcaaacttgggtatcctattcctccttttgatttttctgtcaaaggtgttacgtcaatctcgacagatgttcataagtatgggctagccccaaaaggcaccagtactgtcctgtacaggaatcatgaaatcagaaagcaccaatttgttgctgtgactgaatggactggtgggctctatgtttcccctactatggctggaagcaggccaggtggactaatcgcaggagcttgggcttctatgatgtctcttggactaaatggttatttggaaagtacaggccaaatcatggaagtctcaaagaagatacagaaaggaattgatgatatcccagggttatttgtgatcgggaagccagacatgacagttgtggcctttggatcggatgtggttgacatatttgaggtgaacgacataatgtcatcaaaaggttggcacctcaatgctctgcagagacctaacagcttgcacatttgcgtgacacttcaacacacaaccatctacgtggaattcctccaggatctcaagaattccgtagacactgtgaaagcaaatccaggccctatcagcggggggatggctccaatctacggtgcagctgggaagatgccggacagaggcacggtcaaggagttacttgtggagttcatggacagttcttgctaatcattgactctcttggctctctatctgtaacatgtatgtacgagcagcagttccagtgtgtttgccaatctattggttgcaaaattgaacgcacacaatgacacatgcctacaatggatgtatgtatgtatcagttacatttgttgcaataaagttacattttcagtc

SEQ ID NO: 936 - DNA, 1552 bp, Avena sativa
accgcggcctccgcgccgtcctcgtcgccctggtcatggccgccatcaagctggtgccgggagttagcgcctacatcgccgccgagaagagcaaggtcgttgagcagctgcagtcaggcagtggatcggccaggaagaacctgcgcacccagctgccggacgtcggggttcccgacggggtcatcggcgaactccaggcgctcaaggataaggatgtcaggtggcaggggaagtgctccggcacagtctatatctccgggagcgagtccgatggccatttcgcgctcatcaacaaggcctactccatgttttcacacacaaacccgctgcatcaggacgtattcaagagcgtggcgcatttggaggctgaggtagttgcgatgacagctgctttgctcggcagcaaagagaaggcgtccggtggacaaatctgtggcaacatgacatcaggtggaacggaaagcatactattagctgtcaaaacatcgcgtgactatatgcagtcgaagaagggaatcacaaagcctgaaatgataattgctgaatcagctcattctgcctacgacaaagctgctcagtatttcaatattaaagtgcggcgcgtacctgtgaataaagaatttcttgcagatgtaaaaggattcagacggtgcataaatgggaacaccataatgatggttggatctgcaccaggatttccccatggtttaattgatcctatcgaggaacttggggagttggcttcacaatatggtatttgcttgcatgtcgatctatgccttggtggcttcgtattgcctttcgcccgtaagcttgggtatcccatacctccttttgatttttctgttaaaggtgttacgtcaatttcaacagatgttcataagtatgggctagccccaaaaggcaccagtactgtcctgtacaggaaccatgagattagaaagcaccaatttgttgctgtgaccgaatggactggtgggctctatgtttcccctactatggctggaagcaggcctggtggattaattgcaggagcttgggctgctatgatgtctcttggactaaatggttatttggaaagtacgagtcaaatcatggaagtctcaaagaagatacagaaaggaattgatgatatcccaggtttatttgtgattgggaagccggacatgacagttgtggcctttgggtcagatgctgttgacatatttgaggtgaatgacataatgtcatcaaaaggatggcacctcaatgctctgcagagacccaacagtctgcacatctgtgtgacgcttcagcacgtggctatctacgaggagttccttggggatctcggggattccgtgaacacagtgaaagcgaatccagggcctatcagcaggggtatggcaccgatctacggcgcggctgggaagatgcctgacagaggcaccgttagggagttgcttgtggagttcatggacagctcttgttgatcattgattatatagcccaactggttatctttctgtaacatgtatgtacaggcagcattggcagttgtgtgatagatctg

SEQ ID NO: 937 - DNA, 1968 bp, Lolium multiflorum
tcctctttgccggccggcccttcctccctcctctctgctcagtgagtatataacaattcaatccggattccgtcaccaaccacacagacaacaatctcgtccccaacctcgggatccatctcaagctcccatggaggcggccacccagctggcgctgcgcctgcgcgccgccgccaacgaccgcctcgcgggccacgagccgctcctgctcgccgcggccccaatcctcaccctcctcgccgcgcgcgccctccacgccgccgccggccacgttgccgaccgtggcctccgcaccgtcctcatcacgctagtcatggccgccctcaagatggtgccgggggttagcgcctacattgccgcgcagaagagcaaggtcgttgagcagctgcagtcaggcagcggatcggccaagaagaacctgcggaccgagctgccggacgtcggggtccccgacaaggtcatcgacgatctccaggtgctcaaggataaggacgtgaaatggcaggggaagtgctccggcacagtttatatcgctgggagcgagtccgatggccatttcgccctgataaacagggcttactctatgttttcacacacaaatcctctgcatcaggatgtattcaagagcgtggcacagttagaggctgaggtagttgcaatgacagctgctttgcttggcagcaaagaaaaggcatccggtggacaaatctgtggcaatatgacatcaggaggaacagagagcatattattagccgtcaaaacatcgcgtgactatatgcaatcaaagaagggaatcacaaagcctgaaatgataattgctgaatcagctcattctgcctatgacaaagctgcccaatatttcaatattaaagtgcgacgtgtacctgtgaataaagaatttcttgcagatgtaaaaggattcagacggtgcataaatggaaacactataatgatggttggatctgcaccaggatttccccatggtttaattgatcctatcgaggaacttggggagttggcttcacaatatggtatttgtttgcatgtcgatctatgccttggtggctttgtattgcctttcgcccgcaaacttgggtatcctattcctccttttgatttttctgtcaaaggtgttacgtcaatctcgacagatgttcataagtatgggctagccccaaaaggcaccagcactgtcctgtacaggaatcatgaaatcagaaagcaccaatttgttgctgtgactgaatggactggtgggctctatgtttcccctactatggccggaagcaggccaggtggactaatcgcaggagcttgggcttctatgatgtctcttggactaaatggttatttggaaagtacaggccaaatcatggaagtctcaaagaagatacagaaaggaattgatgatatcccagggttatttgtgatcgggaagccagacatgacagttgtggcctttggatcggatgtggttgacatatttgaggtgaacgacataatgtcatcaaaaggttggcacctcaatgctctgcagagacctaacagcttgcacatttgcgtgacacttcaacacacaactatctacgtggaattcctccaggatctcaagaattccgtagacactgtgaaagcaaatccaggccctatcaagggggggatggctccaatctacggtgcggctgggaagatgccagacagaggcacggtcaaggagttgcttgtggagttcatggacagttcttgctaatcattgactctcttggctctctgtctgtaacatgtatgtacaagcagcagttccagtgtgtttgctaatctattggttgcaaaattgaacgcacacaatgacacaacgcctaaaatggatgtatgtatgtatgtatgtatcggttacatttgttgcaataaaattacatcttcagtactaaaaaaaaaaaaaagtaacctggcccgggcggccgctcg

SEQ ID NO: 938 - DNA, 1641 bp, Avena sativa
gcctccgcgccgtcctcgtcgccctggtcatggccgccatcaagctggtgccgggagttagcgcctacatcgccgccgagaagagcaaggtcgttgagcagctgcagtcaggcagtggatcggccaggaagaacctgcgcacccagctgccggacgtcggggttcctgacggggtcatcggcgatctccaggcgctcaaggataaggatgtcaggtggcaggggaagtgctccggcacagtctatatctccgggagcgagtccgatggccatttcgcgctcatcaacaaggcctactccatgttttcacacacaaacccgctgcatcaggacgtattcaagagcgtggcgcatttagaggctgaggtagttgcgatgacagctgctttgctcggcagcaaagagaaggcgtccggtggacaaatctgtggcaacatgacatcaggcggaacggaaagcatactattagctgtcaaaacatcgcgtgactatatgcagtcgaagaagggaatcacaaagcctgaaatgataattgctgaatcagctcattctgcctacgacaaagctgctcagtatttcaatattaaagtgcggcgcgtacctgtgaataaagaatttcttgcagatgtaaaaggattcagacggcgcataaatgggaacaccataatgatggttggatctgcaccaggatttccccatggtttaattgatcctatcgaggaacttggggagttggcttcacaatatggtatttgcttgcatgtggatctatgccttggcggcttcgtattgcctttcgcccgtaagctcgggtatcccatacctccttttgatttttctgttaaaggtgttacgtcaatttcaacagatgttcataagtatgggctagccccaaaaggcaccagtactgtcctgtacaggaaccatgagattagaaagcaccaatttgttgctgtgactgaatggactggtgggctctatgtttcccctactatggctggaagcaggcctggtggactaatcgcaggagcttgggctgctatgatgtctctcggactaaatggttatttggaaagtacgagtcaaatcatggaagtctcaaagaagatacaaaaagggattgatgatatcccaggtttatttgtgattgggaagccgaacatgacagttgtggcctttgggtcagatgctgttgacatatttgaggtgaatgacataatgtcatcaaaaggatggcacctcaatgctctgcagagacctaacagcctgcacatctgcgtgacgctccagcatgtggctatctatgaggagttcctcggggatctcagggattccgtgaacactgtgaaggcgaatccagggcctatcagcgggggtatggctccgatctatggcgcggctgggaagatgcctgacagaggcaccgttagggagttgcttgtggagttcatggacagctcttgttgatcattgattatatagcccaactggttatctttatgtaacatgtatgtacaggcagcatttactgtggtgtgattgatctgtttttagcttgaaggtacacaaatgcctacaagatatgtatgtatgaatgtatcagtggtggcatctgttgcaataaagttacaatttcagtcta

SEQ ID NO: 939 - DNA, 2045 bp, Brachypodium distachyon
attcaattcaattccttccattcctcctctttgcccccctcccttgccgctgccagcttcttcttcttcttcttcgcttcggatcatcggaggagtcgctggagtatataaacaacagattcaatcgcatctcccatcccaccaaacccatcgttcgagctcaggatcgccgagggatccagttccaggtctagttcattcgggggcagaaggagggatggaggcggccaccaacctccatctggcgctgctgcgcttccgcgccgccgccaaccagcacctcgcgcaccaggagccgctcttcctcgtcgccgctccgctcctcgctctcctcgtcgcccgcgccgtccacgccgctacggcccacgtcgccgaccgcggcctccgcgccgtcgtcatctctctagccatggccgccgtcaagttggtgccgggggttagcggctacatcgctgctcagaagagcaaggttgttgagcagttgcaatcaggcagtgcatccaccaagaagaacctgcgaaccgagctgcccgctgtggggattcccgacggagtcataaaagatctccagacactcaaagataaagatgtaaaatggcagggaaaatgctccggcactgtttatatcgccgggagtgagtccgaaggccattttgcattgataaacaaagcctattctatgttttcacacacgaacccgctgcatcaggatgtattcaagagtgtggcacagatggaggctgaagtagttcaaatgacagctgctttgcttggcagcaaagagaaggcgtctggtggacaaatttgtggcaacatgacatcaggtggaactgaaagcatactattagccgtcaaaacatcacgcgactatatgcaatcaaagaagggaatcaaaaaacctgaaatgataattgctgaatcagctcattctgcctatgacaaagctgctcaatatttcaatattaaggtgcggcgtgtacctgtgaataaagattttctcgcggatgcaaaaggattcaaacggtgcataaatggaaacaccataatgatggttggatctgcaccaggatttccacatggtttaattgatcctattgaggaacttggggagttggcttctcagtatggtatttgcttgcatgttgatctatgccttggtggcttcgtattgcctttcgcccgtaagcttgggtatcctattcctccttttgacttttctgtcaaaggtgttacatcgatctcaacggatgttcataagtatgggctagccccaaagggcaccagtattgtcttgtacaggaatcatgaaattagaaagaaccaatttgtggctgtgactgagtggactggtgggctctatgtttcccctactatggctggtagcaggccaggcggactaatcgcaggagcttgggctgcaatgatgtctgttggattaaatggctatttggaaagtacgggtcaaatcatggaagtctcgaagaagatacaaaaaggaattgaagatattccagggttattcgtgattgggaagccagacatgacggtcgtggcatttgggtcggatgtcgtcgacatatttgaggtgaatgacataatgtcatcgaaaggttggcacctcaatgctctgcagagacccaacagcctgcacatctgcgtgacgcttcaacacgtggcgatttacgaggaattcctcaaggatctggaggattccgtgaacacggtgaaagcaaatccagggcctatcagcggtgggatggctcctatctacggtgccgcagggaagatgccagatagaggcactgtcaaggagttgcttgtggagtttatggacacctcttgctaatctttcattatatagaccccattgcttatgtttctgtaacaacatgtatatctatgcattgtgcaacaagcagcagttgccagacattgttgtgctctattttattttatttttggttcggcacacagaatgatatggttgcgagatttgagggctgcaacaatatatgtatatatgtgtctcggctacatttggtaga

SEQ ID NO: 940 - DNA, 2088 bp, Brachypodium distachyon
gacccagctgccaaatctctccattcaattcaattccttccattcctcctctttgcccccctcccttgccgctgccagcttcttcttcttcttcttcgcttcggatcatcggaggagtcgctggagtatataaacaacagattcaatcgcatctcccatcccaccaaacccatcgttcgagctcaggatcgccgagggatccagttccaggtctagttcattcgggggcagaaggagggatggaggcggccaccaacctccatctggcgctgctgcgcttccgcgccgccgccaaccagcacctcgcgcaccaggagccgctcttcctcgtcgccgctccgctcctcgctctcctcgtcgcccgcgccgtccacgccgctacggcccacgtcgccgaccgcggcctccgcgccgtcgtcatctctctagccatggccgccgtcaagttggtgccgggggttagcggctacatcgctgctcagaagagcaaggttgttgagcagttgcaatcaggcagtgcatccaccaagaagaacctgcgaaccgagctgcccgctgtggggattcccgacggagtcataaaagatctccagacactcaaagataaagatgtaaaatggcagggaaaatgctccggcactgtttatatcgccgggagtgagtccgaaggccattttgcattgataaacaaagcctattctatgttttcacacacgaacccgctgcatcaggatgtattcaagagtgtggcacagatggaggctgaagtagttcaaatgacagctgctttgcttggcagcaaagagaaggcgtctggtggacaaatttgtggcaacatgacatcaggtggaactgaaagcatactattagccgtcaaaacatcacgcgactatatgcaatcaaagaagggaatcaaaaaacctgaaatgataattgctgaatcagctcattctgcctatgacaaagctgctcaatatttcaatattaaggtgcggcgtgtacctgtgaataaagattttctcgcggatgcaaaaggattcaaacggtgcataaatggaaacaccataatgatggttggatctgcaccaggatttccacatggtttaattgatcctattgaggaacttggggagttggcttctcagtatggtatttgcttgcatgttgatctatgccttggtggcttcgtattgcctttcgcccgtaagcttgggtatcctattcctccttttgacttttctgtcaaaggtgttacatcgatctcaacggatgttcataagtatgggctagccccaaagggcaccagtattgtcttgtacaggaatcatgaaattagaaagaaccaatttgtggctgtgactgagtggactggtgggctctatgtttcccctactatggctggtagcaggccaggcggactaatcgcaggagcttgggctgcaatgatgtctgttggattaaatggctatttggaaagtacgggtcaaatcatggaagtctcgaagaagatacaaaaaggaattgaagatattccagggttattcgtgattgggaagccagacatgacggtcgtggcatttgggtcggatgtcgtcgacatatttgaggtgaatgacataatgtcatcgaaaggttggcacctcaatgctctgcagagacccaacagcctgcacatctgcgtgacgcttcaacacgtggcgatttacgaggaattcctcaaggatctggaggattccgtgaacacggtgaaagcaaatccagggcctatcagcggtgggatggctcctatctacggtgccgcagggaagatgccagatagaggcactgtcaaggagttgcttgtggagtttatggacacctcttgctaatctttcattatatagaccccattgcttatgtttctgtaacaacatgtatatctatgcattgtgcaacaagcagcagttgccagacattgttgtgctctattttattttatttttggttcggcacacagaatgatatggttgcgagatttgagggctgcaacaatatatgtatatatgtgtctcggctacatttggtagaataaagttgcatacattttcc

SEQ ID NO: 941 - DNA, 1692 bp, Panicum virgatum
ggctacatcgcggcggagaagaagaaggttgttgacaagatgcaatctggtgggacctcgtccaagaacaaccggcgagctgagttgccaaccattggccttggtgaggaagtgataaaggatcttgaaacattgaaggccaaagatgtagactggcagggaaagtgctctggcacagtatatatcgctggaagtgagtctgagggccattttgaattgataaacaaagcttactctatgttttcacacactaatccgctgcatcaagatgtattcaagagtgtggcacacatggaagctgaagtagttgcaatgacagctgctttgcttggcagcaaagaaaaatcatccggtggacaaatttgcggcaacatgacatctggtggaactgaaagcatattattagcagtcaaaacatcgcgtgactatatgcgatcaaagaaaggaattacaaagcctgaaatgataattgctgaatcagcacattctgcatatgacaaggctgctgaatatttcaatattaaagtgcgtcgtgtgcctgtgaacaaagagtttcttgcagatgtgaaaggattcaagcgatgcataaatggaaacaccataatgatggttggatctgcaccaggatttccgcatggtttaattgatcctattgaggaactgggggagctggcttcacgctatgacatttgcttgcatgttgatttatgccttggtggcttcgtattgccttttgcctgtaagcttgggtaccctattcctccttttgatttttctgtcaagggtgttacatcaatctcatcagatgttcataagtatggattagccccaaagggcacaagtgttgtcctgtacagaaatcatgaaattagaaagcatcaatttgttgctgttaccgagtggaccggtgggctttatatttctcccaccattgctggaagcaggccaggtggattaattgcaggagcttgggctgctatgatgtctcttggactgaatggctacttggacagtacaagtcgtatcatggaagtttcaaagaaaatacaaagagggattgatgagatcccaggactgtttgtgattgggaaaccagacatgaccgttgtggcattcggctcagatgttgtcgacatatttgaggtgaatgacataatgtcatcgaaaggctggcaccttaatgctctgcagagacctaacagtttacacatttgcgtgaccctccaacacacaactgtttatggggagttcctgaaggacctgcaagattctgtgaacactgtgaaagcaaacccgggcccaatcagcggggggatggctcctatctacggtgccgcagggaagatgccagacagaggcacggtgaaggagcttcttgtggagttcatggacagctcttgctgaaactgattatggcttgtgaataacagtcgaattgttgtgatttgtttgttgtctcaacaacacaaagttacttaccattggaaaggggaaacaggcagtgagggcgttacaccatatgcatacaggaccacaacaactgagtgagcatagctgtgcaatggagtgtctgtatgattgtacatcaataacagagcatgcctatgcaaatgcattgtacccaccagatttacacatgtatcttttccaataaaacatgggtcacatttcaggcgtatttttttagataaa

SEQ ID NO: 942 - DNA, 1927 bp, Oryza sativa
gattggcgtcgtgttcgtgtagctcctcttctcctcattgctggcttggcctttggctataccttcccttcatcacctcctagtataaagcaattcaattcccaatccccccggcccgaagtgaaggaagcggatcatggagctcgccatggattttgcgctccgcctccgcgacgccgccaaccaccacctctcccgctacgagcctctcgtgctcctcgccgcgcccctcctcgccctcctcgctgcccgcaccctccacgccgccgctgccgccgtcgccgaccgcggtctccgcaccgtcctcctcgctctagccatgacagccatcaagttgcttccgggagttagcgcctacatcaacgctgagaagaggaaggttgttgaccagctgcagtcaggtggcacgtccacaaaaagtactctgcggaccgagttgccaactgttgggctttccaaccaagtgataaacgatctcgaaacactgaaagctagagatgtaaactggcagggaaaatgctctggcacagtttatattgctgggagtgaatccgaaggtcattttgcattgataaacaaggcttactctatgttttcacacaccaacccacttcaccaggacgtattcaagagtgtggcacaattagaggctgaagtagttgcaatgacagctgctttgcttggcatcaaagaaaaatcatccggtggacagatttgtggtaatatgacatcgggcggaactgaaagcatattattagcagtaaaaacatcacgcgactatatgcgaacaaagaagggcattacaaagcctgaaatgataattgccgaatcagcacattctgcatacgataaagctgctcaatatttcaatattaaagtgcggcgtgtgccagtgaacaaagagtttcttgcagatgtgaaaggattcaaaaggtgtataaacggaaatacgataatgatggtggggtctgcaccaggatttcctcatggtttaattgatcctattgaggaacttggggagttggcttcacgatatgacatttgcttgcatgttgatctctgccttggtggatttgtattgcctttcgctcgtaagcttgggtaccctattcctccattcgacttctgtgtcaagggagttacatcaatctcaactgatgttcataagtatggattagccccaaaagggacaagcattgtcctatataaaaatcatgaaattagaaagcatcaatttgttgctgttactgaatggactggtgggctctatgtttcacctactattgctggaagtaggcctggtgggttgatagcgggagcttgggctgctatgacgtctcttggactgaacggttatatggaaaatacaggtcatatcatggaagtgtcgaagaaaatacaaagagggattgaagatatcccagggttgtttgtgattggaaagccagacatgactgtcgtggcatttggctcagattcggttgatatatttgaggtgaacgacataatgtcatcaaaaggctggcaccttaatgctctgcagagacccaacagtttacacatttgtgtgacactgcagcacacggtcatatatgaggaattcctgaaggatctgaaagattcagtggacactgtaaaagcaaatccagggcctattagcggggggcgagctccgatttacggagctgctggcaagatgccggacagaggcatggtcagggagctgctggtggagttcatggacgcgtcttgctgaacatataatatatcccctgttcttgttattgtggcattgctgattactgttgtactagtattatcatcatgttcatgtactcaccatagaaccaaaacatagccatagaataaaatgcttatttgatccaataataataaaatatagctgcatgcagttcagttcatttca

SEQ ID NO: 943 - DNA, 1425 bp, Leymus cinereus x Leymus triticoides
cagtttatatcgctgggagcgagtccgaaggccatttttcccttataaacaaagcctactctatgttttcacacacaaatccactgcatcaggatgtattcaagagtgtggcacaattagaggctgaagtggttgcaatgacagctgctttgcttggcagcaaagaaaaggcgtctggtggacaaatttgtggcaatatgacgtcaggcggaactgaaagcatattattggccgtcaaaacatcacgcgattatatgcagtcaaagaagggaatcacaaagcctgaaatgataattgctgaatcagctcattctgcctatgacaaagctgctcaatatttcaatattaaagtgcggcgtgtacctgtgaataaagaatttcttgcagatgtaaaaggattcaaacagtgcataaatggaaacactataatgatggttggatctgcaccaggatttccccatggtttaattgatcctatcgaggaacttggggagttggcttcacaatatggtatttgcttgcatgttgatctatgccttggtggcttcgtattgcctttcgcccgtaagcttgggtatcctattcctccttttgatttttctgtcaaaggtgttacgtcgatctcaacagatgttcataagtatggactagccccaaaaggcactagtactgtcctgtacaggaatcacgaaattagaaagcaccaatttgttgctgtgactgaatggactggtgggctctatgtttcccctactatggctggaagcaggccaggtggactaatcacaggagcttgggctgcgatgatgtctcttggattaaatggttatttagaaagtacgggtcagatcatggaagtctcgaagaagatacaaaaaggaattgatgatatctcagggttatttgtgatcgggaagccagacatgaccgtcgtagcctttgggtcggatgccgtcgacatatttgaggtgaatgacataatgtcatcaaaaggatggcacctcaatgctctgcagagacctaacagtctgcacatctgcgtgacgcttcaacacacggctatctaccaggaattcctcaaggatctcgaggattctgtgaacaccgtgaaatctaatccagggcctatcagcggggggatggctccgatctacggcgctgctgggaagatgccggacagaggcacggtcaaggagttgcttgtggagttcatggacagctcttgctgaccgttgactataccctattggttctctctctgtaacatgtatgtacaagccgcagtgacagtgttgtgtgatcttctacacttagtttggcaaacaaagtgatggctgcaaaattgaaggcacacaatgcctgcaatatagacatgtatctatgtttcagtgacatttgttgcattaaagctacattttcagccta

SEQ ID NO: 944 - DNA, 2411 bp, Setaria italica
ctccaactctccgctgctgcgctgatcgttcccgttcagaattcctctttgccgggcgcggcggctgccactgctcaccagccaagtccccgaccccgcagctcctcctccggtcccccacctccacggctcgtcggctccaccaccacttcctccttctcctcctcctcctcctccacgccttatataacaattcaatccggcccggctctccgctcctcaactagctagctcgatccccatcccgcccgctcgcccgctcggtcccctccgcaacacgacaccaccgcaccacgacaccacgccgcaccaatccgatcgaatcggagtgcctcgagcgacgacgccggccatggaggcggcggcggagctggcgctgcgcctccgggcggcggccaacgaccgcctcgcccggtacgagccgctggcgctcgtcgccgcgccgctcctcgcgctcctcgtcgcccggaccctccacgccgccgcgtcggccgtcgccgaccgggggctcgtcgccatcgccatcgccgccgtcaagttgctgccgggagtctctggctacatcgcggcggagaagaagaaggttgttgacaagatgcaatctggtgggacctcgaccaagaacaaccggcgagctgagttgccaactattggccttggcgagcaagtgataaaggatcttgaaacattgaaagccaaagatgtagaatggcagggaaaatgctccggcacagtatatatcgctggaagtgagtccgagggccattttgaattgataaacaaggcttactctatgttttcacacaccaatccgctgcatcaagatgtattcaagagtgtggcacacatggaagctgaagtagttgcaatgacagctgctttgctgggcagcaaagaaaaatcatctggtggacaaatttgcggcaacatgacatctggtggaactgaaagcatactattagcagtcaaaacatcacgtgactatatgcgatcaaagaaaggaattacaaagcctgaaatgataattgctgaatcagcacattctgcatatgacaaggctgctgaatatttcaatattaaagtgcggcgagtgcctgtgaacaaagagtttcttgcagatgtgaaaggattcaagcgatgcataaatggaaacaccataatgatggttggatctgcaccaggatttccgcatggtttaatcgatcctatcgaggaacttggtgaactggcttcgcgctatgacatttgtttgcatgttgatttatgccttggtggctttgtattgccttttgcccgtaagcttgggtaccctattcctccttttgatttttctgtgaagggcgttacatcaatctcatcagatgttcataagtacggattagctccaaagggcacaagtgttgtcctgtacagaaatcatgaaattagaaagcatcaatttgttgctgttactgagtggactggtgggctttatgtttctcccaccattgctggaagcaggccaggtggattaattgcaggagcttgggctgctatgatgtatgtcggactgaatggctacttggacagtacaagtcgtatcatggaagtttcaaagaaaatacaaagagggattgaagagatcccagggttgtttgtgattgggaaaccagacatgaccgttgtggcattcggctcggatgttgtcgacatatttgaggtgaatgacataatgtcgtcaaaagggtggcaccttaacgctctgcagagacctaacagtttacacatttgcgtgaccctccagcacacgaatatttacggggaattcctgaaggatctgcaagattctgtgaacactgtgaaagcaaacccgggtcctattagcgggggaatggctcccatctatggtgccgcagggaagatgccggacagaggcacggtcagggagcttcttgtggagttcatggacagctcttgctgaattgattatggcttgtgaataacagtcgcagtgctgtgatttgtttgttgccttcgcacacaaagttaccattggaaaagggaaataggcagtgaggcattacaacttacaccatatgtatacaggcgttataactgcatagctgtgcaatggagtgtccgtatgattgtacatctaagatcagaacatgcgtataaaatgtaccatcagacttacatatgtatcatttccaataaaacatctgttacatttcaggtgtattgtccctatgaattctctctaaagtttcttttttcctttaggcagaagtcattcatctgacaaaaagaagaagaaaaacccattataatggtaatggcacatctcactaaaacgccatgatagaagccacactcaagagtatggtgtgagcatatgtgtgtcatttcttgtattaatgttactaaaataa

SEQ ID NO: 945 - DNA, 2280 bp, Setaria italica
cactgctcaccagccaagtccccgaccccgcagctcctcctccggtcccccacctccacggctcgtcggctccaccaccacttcctccttctcctcctcctcctcctccacgccttatataacaattcaatccggcccggctctccgctcctcaactagctagctcgatccccatcccgcccgctcgcccgctcggtcccctccgcaacacgacaccaccgcaccacgacaccacgccgcaccaatccgatcgaatcggagtgcctcgagcgacgacgccggccatggaggcggcggcggagctggcgctgcgcctccgggcggcggccaacgaccgcctcgcccggtacgagccgctggcgctcgtcgccgcgccgctcctcgcgctcctcgtcgcccggaccctccacgccgccgcgtcggccgtcgccgaccgggggctcgtcgccatcgccatcgccgccgtcaagttgctgccgggagtctctggctacatcgcggcggagaagaagaaggttgttgacaagatgcaatctggtgggacctcgaccaagaacaaccggcgagctgagttgccaactattggccttggcgagcaagtgataaaggatcttgaaacattgaaagccaaagatgtagaatggcagggaaaatgctccggcacagtatatatcgctggaagtgagtccgagggccattttgaattgataaacaaggcttactctatgttttcacacaccaatccgctgcatcaagatgtattcaagagtgtggcacacatggaagctgaagtagttgcaatgacagctgctttgctgggcagcaaagaaaaatcatctggtggacaaatttgcggcaacatgacatctggtggaactgaaagcatactattagcagtcaaaacatcacgtgactatatgcgatcaaagaaaggaattacaaagcctgaaatgataattgctgaatcagcacattctgcatatgacaaggctgctgaatatttcaatattaaagtgcggcgagtgcctgtgaacaaagagtttcttgcagatgtgaaaggattcaagcgatgcataaatggaaacaccataatgatggttggatctgcaccaggatttccgcatggtttaatcgatcctatcgaggaacttggtgaactggcttcgcgctatgacatttgtttgcatgttgatttatgccttggtggctttgtattgccttttgcccgtaagcttgggtaccctattcctccttttgatttttctgtgaagggcgttacatcaatctcatcagatgttcataagtacggattagctccaaagggcacaagtgttgtcctgtacagaaatcatgaaattagaaagcatcaatttgttgctgttactgagtggactggtgggctttatgtttctcccaccattgctggaagcaggccaggtggattaattgcaggagcttgggctgctatgatgtatgtcggactgaatggctacttggacagtacaagtcgtatcatggaagtttcaaagaaaatacaaagagggattgaagagatcccagggttgtttgtgattgggaaaccagacatgaccgttgtggcattcggctcggatgttgtcgacatatttgaggtgaatgacataatgtcgtcaaaagggtggcaccttaacgctctgcagagacctaacagtttacacatttgcgtgaccctccagcacacgaatatttacggggaattcctgaaggatctgcaagattctgtgaacactgtgaaagcaaacccgggtcctattagcgggggaatggctcccatctatggtgccgcagggaagatgccggacagaggcacggtcagggagcttcttgtggagttcatggacagctcttgctgaattgattatggcttgtgaataatagtcgcagtgctgtgatttgtttgttgccttcgcacacaaagttaccattggaaaagggaaataggcagtgaggcattacaacttacaccatatgtatacaggcgttataactgcatagctgtgcaatggagtgtccgtatgattgtacatctaagatcagaacatgcgtataaaatgtaccatcagacttacatatgtatcatttccaataaaacatctgttacatttcaggtgtattgtccctatgaattctctctaaagtttcttttttcctttaggcagaagtcattcatctgacaaaaagaagaagaaaaacccattataatggtaatggcacatctcactaaaacgccatgatagaagc

SEQ ID NO: 946 - DNA, 2011 bp, Panicum virgatum
aacgatttaaaaaaaattgcattttgcgttttgggatcgctgatacgttcttgcattttgcgccacggagtccgtcagtttccttttcgatgctacactgctacagaacccttctccattaaaatctggtccagtattcgcatcttatagctagctgctttcgtgcacggtaccttccttaaggcttgcgctgcttgatcaatgttgtttattaaagagtactacctttatataaaatctaacaggatatcctcaaaatatcacgacgtctccttgctgctactgtggcaggttgttgacaagatgcaatctggtgggacctcgtccaagaacaaccggcgaactgagttgccgacaattggccttggtgaggaagtgataaaggatcttgaaacattgaaagccaaagatgtagactggcagggaaagtgctctggcacagtatatatcgctggaagtgagtctgagggccatttcgaattgataaacaaagcttactctatgttttcacacaccaatccgctgcatcaagatgtattcaagagtgtggcacacatggaagctgaagtagttgcaatgacagctgctttgcttggcagcaaagaaaaatcatccggtggacaaatttgcggcaacatgacatctggtggaactgaaagcatattattagcagtcaaaacatcgcgcgactatatgcgatcaaagaaaggaattacaaagcctgaaatgataattgctgaatcagcacattctgcatatgacaaggctgctgaatatttcaatattaaagtgcgccgtgtgcctgtgaacaaagagtttcttgcagatgtgaaaggattcaagcgatgcataaatggaaacaccataatgatggttggatctgcaccaggatttccgcatggtttaatcgatcctattgaggaattgggggaactggcttcacgctatgacatttgcttgcatgttgatttatgccttggtggcttcgtattgccttttgcccgtaagcttgggtaccctattcctccttttgatttttctgtcaagggtgttacgtcaatctcatcagatgttcacaagtacggattagccccaaagggcacaagtgttgtcctgtacagaaatcatgaaattagaaagcatcaatttgttgctgtaaccgagtggaccggcgggctttatatttctcccactattgctggaagcaggccaggtggattaattgcaggagcctgggctgctatgatgtctatgggactgaatggctacttggacagtacaagtcatatcatggaagtttcgaagaaaatacaaagagggattgaagagatcccaggactgtatgtgattgggaaaccagacatgaccgttgtggcatttggctcagatgttgtcgacatatttgaggtgaatgacataatgtcgtcgaaaggttggcaccttaatgctctgcagagacctaacagtttacacatttgcgtgaccctccaacacacgactgtttacggggagttcctgaaggacctgcaagattctgtgaacactgtgaaagcaaacccgggccctatcagcggggggatggctcctatctacggtgccgcagggaagatgccggacagaggcacggtgagggagcttcttgtggagttcatggacagctcttgctaaaactgattatggcttgtgaataacagtcgcattgttgtgatttgtttgttgccttggcaacacaaagttacttaccattggaaaggggaaataggcagtgaggcgttacaccgtatgtatacaagatcacaagaactgagtgagcatagctgtgcaatggagtgtctgtatgattgtacatcaatatcagagcatgcctatgcaaatgcaatgtacaatgcacccaccagacttacacatgtatctttttccaataaaacattgtcacatttcaggtgtattttttaaaaataaatcatttcaggtgtatttataatggcacctgacagaagaagagacagaa

SEQ ID NO: 947 - DNA, 1685 bp, Echinochloa colona
ccgccagcgccgtcgccgaccggggcctcgtcgccatctgcatcgccgccgccaagttgctgccgggagtctccggttacatcgcggcggagaagaagaaggttgttgacaagatgcaatctggtgggacctcgaacaagaaccatcgccgagctgagttgccgaccattggccttgccgagcaagtgataaaggatcttgaagcattgaaagccaaagacgcggcctggcaggggaaatgctccggcacggtatatatcgccggaagcgaatcggagggccattttgaattgataaacaaggcatactctatgttttcacacaccaatccgctgcatcaagatgtattcaagagtgtggcacaaatggaagctgaagtagttgcaatgacagctgctttgcttggcagcaaagaaaaatcatccggtggacaagtgtgcggcaacatgacatctggtggaactgaaagcatattattagcagtcaaagcaacacgtgactatatgcaatcaaagaaaggaattacaaagcctgaaatgataattgctgaatcggcacattctgcatatgacaaggctgctcaatatttcaatattaaagtgcggcgtgtgcctgtgaacaaagaatttcttgcagatgtgaaaggattcaagcgatgcataaatagaaacaccataatgatgattggatctgcaccaggatttccgcatggcttaattgatcctattgaggaacttggggaactggcttcacgctatgacatttgcttgcacattgatttatgccttggtggcttcgtattgccttttgcccgtaagcttgggtaccctattcctccttttgacttttctgttaagggtgttacatcaatttcatcagatgttcataagtatggattagcgccgaagggcacaagcattgtcctgtacagaaatcatgaaattagaaagcatcaatttgttgctgttaccgagtggactggtgggctatatatttctcccactatggctggaagcaggccaggtggattaattgcgggagcttgggctgctatgatgtctcttggactgaatggctacttggacattacaagtcgtatcatggaagtttcgaagaaaatacagagagggattgaagagatcccaggactctttgtgatcgggaaaccagacatgaccatagtggcattcggctcagatgttgtcgacatatttgaggtgaatgacataatgtcgtcaaaaggttggcacctcaatgctctacagagacctaacagtttacacatttgtgtgaccctgcaacacacgtctatttatggggaattcctgaaggatctgcaagattctgtgaacactgtgaaagcaaacccgggccctattagcgggggaatggctcctatctacggtgccgcagggaagatgccggacagaggcacggtgagggagcttctagtggagttcatggacagctcttgctgaactgattatgggcttatggcttgtgaaaaacagttagtgtgctgtgatttgttttacttggcatacgaagttatcatagataacggggaaaaagaggcgttacaaccatactgtatacaagattgctaatgagcatagctgtacaatggagtatccgtatgattgattgtacatcaatatcagatcatgcataggcaatgtaccacc

SEQ ID NO: 948 - DNA, 1545 bp, Echinochloa colona
atcgccatcgccgccgtcaagttgctgccgggagtctcaggttacatcgcggcggagaagaagaaggttgttgacaagatgcaatctggtgggacctcgaacaagaaccatcgccgagctgagttgccaactattggccttgccgagcaagtgataaaggatcttgaagcattgaaagccaaagatgcggcctggcaggggaaatgctccggcacggtatatattgccggaagcgaatcagagggccattttgaattgataaacaaggcatactctatgttttcacacaccaatccgctgcatcaagatgtattcaagagtgtggcacaaatggaagctgaagtagttgcaatgacagctgctttgcttggcagcaaagaaaaatcatccggtggacaaatttgcggcaacatgacatctggtggaactgaaagcatattattagcagtcaaagcaacacgtgactatatgcaatcaaagaaaggaattacaaagcctgaaatgataattgctgaatcggcacattctgcatatgacaaggctgctcaatatttcaatattaaagtgcggcgtgtgcctgtgaataaagaatttcttgcagatgtgaaaggattcaagcgatgcataaatagaaacaccataatgatgattggatctgcaccaggatttccgcatggcttaattgatcctattgaggaacttggggaactggcttcacgctatgacatttgcttgcacattgatttatgccttggtggcttcatattgccttttgcccgtaagcttgggtaccctattcctccttttgacttttctgttaagggtgttacatcaatttcatcagatgttcataagtatggattagccccaaagggcacaagcattgtcctgtacaggaatcatgaaattagaaagcatcaatttgttgctgttaccgagtggactggtgggctatatatttctcccactatggctggaagcaggccaggtggattaattgcgggagcttgggctgctatgatgtctctcggactgaatggctacttggacattacaagtcgtatcatggaagtttcgaagaaaatacagagagggattgaagagatcccaggactctttgtgatcgggaaaccagacatgaccatagtggcattcggctcagatgttgtcgacatatttgaggtgaatgacataatgtcgtcaaaaggttggcacctcaatgctctacagagacctaacagtttacacatttgcgtgaccctgcaacacacgtctatttatggggaattcctgaaggatctgcaagattctgtgaacactgtgaaagcaaacccgggccctattagcgggggaatggctcctatctacggtgccgcagggaagatgccggacagaggcacggtgagggagcttctagtggagttcatggacagctcttgctgaactgattatgggcttatggcttgtgaaaaacagttagtgtgctgtgatttgttttacttggcatacgaagttatcataggtaaatggggaaaagaggcgtta

SEQ ID NO: 949 - DNA, 1681 bp, Pennisetum glaucum
gccgccgtcaagttgctgccgggagcctccggctacatcgcggcggagaagaagaaggttgttgacaagatgcaatctggtgggacctcgaacaagaacaaccggcgagctgagttgccaactattggctttggcgagcaggtgataaaggatcttgaaacattgaaagccaaagatgtagaatggcagggaaaatgctccggcacagtatatatcgctggaagtgagtccgagggccattttgaattgataaacaaggcttattctatgttttcacacaccaatccactgcatcaagatgtattcaagagtgtggcacacatggaagctgaagtagttgcaatgacagctgctttgctgggcagcaaagaaaaatcatctggcggacaaatttgcggcaacatgacatctggtggaactgaaagcatactattagcagtcaaaacatcacgtgactatatgcggtcaaagaaaggaattacaaagcctgaaatgataattgctgaatcagcacattctgcatatgacaaggctgctgaatatttcaatattaaagtgcggcgagtgcctgtgaacaaagagtttcttgcagatgtgaaaggattcaagcgatgcataaatggaaacaccataatgatgattggatctgcaccaggatttccgcatggtttaattgatcctattaaggaacttggggaactggcttcccactatgacatttgcttgcatgttgatttatgccttggtggcttcgtattgccttttgcccgtaagcttgggtaccctattcctccttttgatttttctgtgaagggtgttacatcaatctcatcagatgttcataagtacggtttagccccaaagggcacaagcgttgtcctgtacagaaatcatgaaattagaaagcatcaatttgttgctgttactgagtggactggcgggctctatgtttctcccaccattgctggaagcaggccaggtggattaattgcgggagcttgggctgctatgatgtctctcggtctgaatggctacttggacagtacaactcatatcatggaagtttcaaagaaaattcaaagagggattaaagagatccctgggttgtttgtgattggaaaaccagacatgactgttgtggcattcggctcagatgttgttgacatatttgaggtgaatgacataatgtcgtcaaaagggtggcaccttaacgctctgcagagacctaacagtttacacatttgcgtgaccctccaacacgtgaatatttatggggaattcctgaaggacctactagattctgtgaacactgtgaaagcaaacccgggccctattagcggcggaatggctcctatctatggtgcggcagggaagatgccggacagaggcacggtcagggagcttcttgtggagttcatggacggctcttgctgaattgattatggcttgtgaataactgtcgcggtgctgtgatttgtttgttgctttggcacacaaagttaccataggaaaagggaaacaggcagtgaggcgttacaagttacaccatatgtatacaggaatataaccgagcatagctgtgcaaaggagtgtccgtatgattgtacatctgagatcagaaaatgagtataaaatgtaccatcagacttacacatgtatcatttccaatgaagcatttgct

SEQ ID NO: 950 - DNA, 1438 bp, Triticum aestivum
aagacaaggatgtgagatggcagggcaaatgctccggcactgtttatatcgctgggagcgagtctgaaggccatttttcacttataaacaaggcctactctatgttttcacacacaaatccactgcatcaggatgtattcaagagtgtggcacagttagaggctgaagtagttgcaatgacagctgctttgcttggcagcaaagaaaaggcgtctggtggacaaatttgtggcaatatgacgtcaggcggaactgaaagcatattgttggccgtcaaaacatcacgcgattatatgcagtcaaagaagggaatcacaaagcccgaaatgattattgctgaatcagctcattctgcctatgacaaagctgcccaatatttcaatattaaagtgcggcgtgtacctgtgaataaagaatttcttgcagatgtaaaaggattcaaacggtgcataaatggaaacaccataatgatggttggatctgcaccaggatttccccatggtttaattgatcccatcgaggaacttggggagttggcttcacaatatggtatttgcttgcatgttgatctatgccttggtggcttcgtattgcctttcgcccgtaagcttgggtaccctattcctccttttgatttttctgtcaaaggtgttacgtccatctcaacggatgttcataagtatgggctagctccaaaaggcaccagtactgtcctatacaggaatcatgcaattagaaagcaccaatttgttgctgtgactgaatggactggtgggctctatatttcccctactatggctggaagcaggccaggtggactagtcgcaggagcttgggctgcgatgatgtctcttggattgaatggttatttggaaagtactggtaagatcatggaagtctcaaagaagatacaaaaaggaattgatgatatctcaggtttatttgtgattgggaagccagacatgaccgtcgtggcctttgggtcggacgcggtcgacatatttgaggtaaatgacataatgtcatcaaaaggatggcacctcaatgctcttcagagacccaacagtctgcacatctgcgtgacgcttcaacacacggctatctatgaggaattcctcaaggacctcgaggattccgtggacacagtgaaagcgaatccagggcctatcagtggggggatggctcccatctatggcgcggctgggaagatgccggacagaggcacggtcaaggagttgcttgtggagttcatggacagctcttgctaaccattgactataccccattggttatctctctgtaacatgtatgactgttgtgtgatcttctatatttggtttggctgcaaaacagaaggcacacaatgcctccaatacagacatgtatctatgtatcagttacattggttgcaatgaagttacattttcagcctattgct

SEQ ID NO: 951 - DNA, 1959 bp, Zea mays
gccatcgccatcgccgccgtcaagttgctgccgggagtctccggctacatcgcggcggagaagaagaaggttgttgacaagatgcaatcaggtggggccaagaacaatcggcgagctgagttgccaactattggccttgccgagcaagtgatagaggaacttgaaacactgaaagccaaagatgtagactggcagggaaaatgctctggcacagtatatattgctggaagtgagtctgagggtcattttcaattgataaacaaggcgtactctatgttttcacacaccaatccgctccatcaagatgtatttaagagcgtagcaaacatggaagctgaagtcgttgcaatgacagcggctttacttggcagcaaagaaaaatcatctggtggacaaatttgcggcaacatgacatcaggtggaactgaaagcatattattagcagtcaaaacatcacgtgactatatgcgatcaaagaaaggaattacaaggcctgaaatgataattgctgaatcagcacattctgcatatgacaaagctgctcaatacttcaatattaaagtgcggcgtgtacctgtgaacaaagagtttcttgcagatgtgaaaggattcaaacgatgcataaatggaaacaccataatgatggttggatctgcaccaggatttccgcatggtttaattgatcctattgaggaacttggggaactggcttcgcgctatgacatttgcttgcatgttgatttatgccttggtggctttgtgctgccttttgctcataagcttgggtaccctattcctccctttgatttttctgtcaagggtgttacatccatctcatctgatgttcataagtacggattagcaccaaaaggcacaagcattgtcctgtacagaaatcatgaaattagaaagcatcagtttgttgctgttactgagtggaccggtggcctttacgtttctcccacaattgctggaagcaggccaggtggattgatagcgggagcttgggctgctatgatgtctctcggactgaacggctacttggacagtacaagccgtatcatggatgtttcaaagaaaatacaaagagggattggagagatcccagggttgtttgtgatagggaaaccggatatgaccgttgtggcgttcggctcagacgttgtcgacatatttgaggtgaacgacataatgtcatcaaaaggttggcatctcaatgctctgcagagacctaacagcttgcatatctgtgtgacccttcaacacacgactgtttacgaccaattcctgaaggatctgcaagactctgtcaacactgtgaaagcaaacccaggcccgattagcggcggaaaggctcctatctacggcgccgcagggaagatgccggacagaggcacggtgagggagctgctcgtggagttcatggacagctcttgctgaattcattatggcttgtgagaagaatttgttcttgtacatgaaacttctatttctttttcaactgaaaaggcagagctcctaccatttgtttaaaaaaaaaacattatggcttgtgaaaaacagtcgcagggctgtgatttgttggcctaggtatacaaagttgtcattaggaaaagcggggaaagtcattgaggcgatacaaccacatgtattcacgattacaagaagtttgtccgtatgattgtatatcaatatcacagcatgcatacgcaatgtgtctggttatatatttatctgttcctataaaacattggttgcatttcacgcgtactcacccccgtgaattctcggtaaaataaagatagaaatgactaataatagcacatatgtggtctcactaccggaatccggcgctttgtcaagtgccgcactcggcaaagtcttgctctcggtaacgatcgcgtttaccgagagcagaactctcggcataaaaatacacttggcaaagaagtctttgcc

SEQ ID NO: 952 - DNA, 2039 bp, Saccharum officinarum
caacacggcccggctctcctctcctctcctcagttcgatcgatcgcatcccaaacccggcgcgtccccccgctacaggacaccgctcaccaccacaccgcgctcgccgcctcgaggagtcccaccaaaccaatccgatcgaatagtcgagcaacggccatggaggcggcggcggagctggccctgagcctccgggcggccaccaacgaccgcctggcgcggtacgagccgctggcgctcgtcgccgcgccgctcctcgcgctcctcgtcgcgcgggccctccactccgccgccaacgccgtcgccaaccgcgggctcgtcgccatcgccatcgccgccgtcaagttgctgccgggagtctccggctacatcgcggcggagaagaagaaggttgttgacaagatgcaatccggtggggccaagaacgatcggcgagctgagttgccaactattggccttgccgagcaagtgatagaggagcttgaaacactgaaaaccaaagacgtagactggcagggaaaatgctctggcacagtatatattgctggaagcgagtctgagggtcattttgaattgataaacaaggcgtactctatgttttcacacaccaatccgctccatcaagatgtattcaagagtgtggcaaacatggaagctgaagtagttgcaatgacagctgctttacttggcagcaaagaaaaatcatctggtggacaaatttgcggcaacatgacatcaggtggaactgaaagcatattattagcagtcaaaacaacacgtgactatatgcgatcaaagaaaggaattacaaagcctgaaatgataatggctgaatcagcacattctgcgtatgacaaagctgctgaatacttcaatattaaagtgcggcgtgtacctgtgaacaaagagtttcttgcagatgtgaaaggattcaaacgatgcataaatggaaacaccataatgatgattggatctgcaccaggatttccgcatggtttaatcgatcctattgaggaacttggggaactggcttcgcgctatgacatttgcttgcatattgatttatgccttggtggctttgtactgccttttgctcgtaagcttgggtaccctattcctccctttgatttttctgtcaagggtgttacgtcaatctcatcagatgttcataagtatggatgagcaccaaaaggcacaagcattgtcctgtacagaaatcatgaaattagaaagcatcaatttgttgctgttactgagtggaccggtggactttatgtttctcccactatggctggaagcaggccaggtggattaattgcgggagcttgggctgctatgatgtctctcggactgaatggctacttggacagtacaagccgtatcatggaagtttcgaagaaaatacaaagagggattggagagatcccagggttgtttgtgattgggaaaccagatatgaccgttgtggcgttcggctcagatgttgtcgacatatttgaggtgaacgacataatgtcatccaaaggttggcatctcaatgctctgcagagacctaacagtttgcacatttgtgtgacccttcaacacacgactatttatgaccaattcctgaaggatctgcaagactctgtgaacactgtgaaagcaaacccaggccctattagtggtggaatggctcctatctacggcgccgcagggaagatgccagacagaggcacggtgagggagctgcttgtggagttcatggacagctcttgctgaactgattatggcttgtgaaaaacagtcgcagtgctgtgatttgtttgcctatacaaagttatcataggaaggaggggaaagtcattgaggcgatacaatcacatttattcatgattacaagaagtgtatgattgtatatcaatatcagagcatgcatgtgcaatgtaccaccaggcttacaaatgtagatctgttcctataaaacatttgttacatttcaggtgtactcaccctgtgaatcaggggataataataacaataatagaaaaagatttggta

SEQ ID NO: 953 - DNA, 2229 bp, Sorghum bicolor
tgccttccaaccttctgctgcgttgctgattgtccccttccgaattcttcgtctttgccgggcggcgggcgcggcgccttgccggcggctgcagcggcagcggagcgcagcaaccccctccgcggcaccccaccccactattcctccacgccgtatacaacaattcaacccggcccggctctcctctcctcagctcgatcgatcgcatccgccccccgctacgcgacaccgctcaccaccaccacaccgcgctcgccgccacgaggagtcccatcccatccagctcccaccagcaaaccaatccgatcgaatagtccgcgagcgaagccgaagcgaagcccatggaggcggcggcggagatggcgctgcgcctccgggcggcggccaacgaccgcctggcgggctacgagccgctggccctcgtcgccgcgccgctcctcgcgctcctcgtcgcgcggaccctccacgccgccgccaacgccgtcgccgaccggggcctcgtcgccatcgccatcgccgccgtcaagttgctgccgggagtctccggctacatcgcggcggagaagaagaaggttgttgacaagatgcaatccggtggggccaagaacgatcggcgagctgacttgccaactattggccttggcgagcaagtgatagaagagcttgaaacactgaaagccaaagatgtagactggcagggaaaatgctctggcacagtatatattgctggaagtgagtctgagggccattttgaattgataaacaaggcggtatctatgttttcacacaccaatccgctccatcaagatgtattcaagagtgtggcaaacatggaagctgaagtagttgcaatgacagctgctttacttggcagcaaagaaaaatcatctggtggacaaatttgcggcaacatgacatcaggtggaactgaaagcatattattagcagtcaaaacaacacgtgactatatgcgatcaaagaaagggattacaaagcctgaaattataatggctgaatcagcacattctgcgtacgacaaagctgctgaatacttcaatattaaagtgcggcgtgtacctgtgaacaaagagtttcttgcagatgtgaaaggattcaaacgatgcataaatggaaacactataatgatgattggatctgcaccaggatttccacatggtttaattgatcctattggggaacttggggaactggcttcacgctatgacatttgcttgcatattgatttatgccttggtggcttcgtactgccttttgctcgtaagcttgggtaccctattcctccttttgatttttctgtcaagggtgttacatcaatctcatcagatgttcataagtacggattagcaccaaaaggcacaagtattgttctgtacagaaatcatgaaattagaaagcatcaatttgttgctgttactgagtggaccggtgggctttatgtttctcccactatggctggaagcaggccaggtggattaattgcgggagcctgggctgctatgatgtctctcggactgaatggctacttggacaatacaaggtgtgtcatggaagtttcgaagaaaatacaaagagggattggagaaatcccagggttgtttgtgattgggaaaccagatatgaccattgtggcgtttggctcagatgttgtcgacatatttgaggtgaacgacataatgtcatcaaaaggttggcatctcaatgctctgcagagacctaacagtttgcacatctgtgtgacccttcaacacacgactatttacgaccaattcctgaaggatctgcaagattctgtggacactgtgaaagcaaacccaggccctattagcggcggaatggctcctatctacggcgccgcagggaagatgccagacagaggcacggtgagggagctgcttgtggagttcatggacagctcttgctgaactgattatggcttgtgaaaaacagtcccagtgctgtgatttgtttgcctaggtatacaaagttatcataggaaagaggggaaagtcattgaggcgatacaaacacatgtatttcacaattacaagaagtgtatctgtatgattgtatatcaatatcagagcatgcatatgtaatgtaccaccaagcttacaaatgtatctgttcctatatacaacatttgttacattttaggcgtactcaccctgtgaatcaggggataataataatagaatacaaaagattggg

SEQ ID NO: 954 - DNA, 1507 bp, Festuca arundinacea
actccaggtgctcaaggataaggacgtgaaatggcaggggaagtgctccggcacagtttatatcgctgggagcgagtccgatggccatttcgccctgataaacagggcctactctatgttttcacacacaaatcctctgcatcaggatgtattcaagagcgtggcacagttagaggctgaggtagttgcaatgacagctgctttgcttggtagcaaagagaaggcatccggtggacaaatctgtggcaatatgacatcaggcggaacagagagcatattattagccgtcaaaacatcgcgcgactatatgcaatcaaagaagggaatcacaaaacctgaaatgataattgctgaatcagctcattctgcctatgacaaagctgctcaatatttcaatattaaagtgcggcgtgtacctgtgaataaagaatttcttgcagatgtaaaaggattcagacggtgcataaatggaaacactataatgatggttggatctgcaccaggatttccccatggtttaattgatcctatcgaggaacttggggagttggcttcacaatatggtatttgcttgcatgtcgatctatgccttggtggctttgtattgcctttcgcccgcaaacttgggtatcctattcctccttttgatttttctgtcaaaggtgttacgtcaatctcgacagatgttcataagtatgggctagccccaaaaggcaccagtactgtcctgtacaggaatcatgaaatcagaaagcaccaatttgttgctgtgactgaatggactggtgggctctatgtttcccctactatggctggaagcaggccaggtggactaatcgcaggagcttgggcttctatgatgtctgttggactaaatggttatttggaaagtacgggccaaatcatggaagtctcaaagaagatacagaaaggaattgatgatatcccagggttatttgtgatcgggaagccagacatgacagttgtggcctttggatcggatgtggttgacatatttgaggtgaacgacataatgtcatcaaaaggttggcacctcaatgctctgcagagacctaacagcttgcacatttgtgtgacacttcaacacacaactatctacgtggaattcctccaggatctcaagaattcagtggacaccgtgaaagcaaatccaggccctatcagcggggggatggctccaatctacggtgcagctgggaagatgccggacagaggcacagtcaaggagttgcttgtggagttcatggacagttcttgctaatcattgactctcttggctctctctctgtaacatgtatgtacgagcagcagttccagtgtgtttgctaatctattggttgcaaaattgaacgcatacaataacacaatgcctacagtggatgtatgtatgtatgtatcagttacatttgttgcaataaagttacattttcagtctaaaaaaaaaaaaaaaaaaaaaaaaaaaggaaggaaaaaaaaaacaaaaaaa

SEQ ID NO: 955 - DNA, 1239 bp, Avena sativa
cagctgcagtcaggcagtggatcggccaggaagaacctgcgcacccagctgcccgacgtcggggctcctgacggggtcatcggcgatctccaggcgctcaaggataaggatgtcaggtggcaggggaagtgctccggcacagtctatatctccgggagcgagtccgatggccatttcgcgctcatcaacaaggcctactccatgttttcacacacaaacccgctgcatcaggacgtattcaagagcgtggcgcatttggaggctgaggtagttgcgatgacagctgctttgctcggcagcaaagagaaggcgtccggtggacaaatctgtggcaacatgacatcaggcggaacggaaagcatactattagctgtcaaaacatcacgtgactatatgcagtcgaagaagggaatcacaaagcctgaaatgataattgctgaatcagctcattctgcctacgacaaagctgctcagtatttcaatattaaagtgcggcgcgtacctgtgaataaagaatttcttgcagatgtaaaaggattcagacggtgcataaatgggaacaccataatgatggttggatctacaccaggatttccccatggtttaattgatcctatcgaggaacttggggagttggcttcacaatatggtatttgcttgcatgtggatctatgccttggcggcttcgtattgcctttcgcccgtaagctcgggtatcccatacctccttttgatttttctgttaaaggtgttacgtcaatttcaactgatgttcataagtatgggctagccccaaaaggcaccagtactgtcctgtacaggaaccatgagattagaaagcaccaatttgttgctgtgactgaatggactggtgggctctatgtttcccctactatggctggaagcaggcctggtggactaatcgcaggagcttgggctgctatgatgtctctcggactaaatggttatttggaaagtacgagtcaaatcatggaagtctcaaagaagatacaaaaagggattgatgatatcccaggtttatttgtgattgggaagccggacatgacagttgtggcctttgggtcagatgctgttgacatatttgaggtgaatgacataatgtcatcaaaaggatggcacctcaatgctctgcagagacctaacagcctgcacatctgtgtgacgctccagcatgtggctatctatgaggagttccgtcggggatctcagggattccgt

SEQ ID NO: 956 - DNA, 1951 bp, Elaeis guineensis
tccacagccctatataaacccaactctcctcctctctccccaatctccgcgacccctattctgctgtcgtatttaccgatggacgccatggaggacttggtgctccgtctccgcgcctcggtcaactccttcctctcccagtacgagccgatcaccctcctcctctcccccctcctcgccctcctcctcgcccgggctctccactccctccttggtgccctccaggagaaggggatcaaagccgcggtcctagggttcctaatgagctccgtcaagttgatccccggcgtcagcggctacatcgaatccgagaagagaaaggttgtggacaaattacaatctggcagtaagtccaaaagggataactggagagctgagttgccaaatattggacttggaagaagagttattgaggaactggaagatgtgaaaagtaaggatgtggcttggcaaggaaaatgctccggaacagtatatatcgggggaagccagtctgagggtcatttcgctttgacaaatgaggcatactcaatgttttcacacaccaacccattgcatcaggatgtatttcaaagtgtggcacgatttgagggagaagtcattgccatgacagctgcactccttggcagtaaagagaagacatctggaggacaaatctgtggcaatatgacatcaggagggactgaaagtatattactagctgttaaaacatcacgtgactatatgagagcaaaaaagggaataacaaaaccagaaatgataattcctgagtctgcacattctgcatatgacaaagctgcacagtattttaacattaaggtgcggcgtgttcctgtaaataaagaatttgttgcagatgttaaagggatcaggcgatgcatcaatcgaaacacgataatgattattggatctgcaccagggttcccacatggcattgttgatcctattgaagagcttggcaacttggcatctagttatggcatttgcttccatgttgatctttgccttggtggcttcgtattgccatttgctcggaagcttgggtaccaaattcctccttttgatttttctgtaaaaggagttacatcaatttcaattgatgtgcacaagtatggattaggtcccaagggcactagtgtagttctttacagaaaccatgaactcagaaagcaccaatttgttgcagtcactgagtggtctggagggctatatgtctcccctaccattgctggaagcagacctggtggactgattgccggggcttgggcagctatgatgtcattaggactgaatggatacttggagaatacaaggcagatcatggaagcatccaagaagatacagaaagggatagaggatattccagagttgtttgttgttggaaagccacacatgacagtggtggcttttggctccaatgcggttgacatctttgaagtcaatgatttaatgtcatcaaaggggtggcatttgaatgccttgcagagacctaacagccttcatatctgtgtaacacttcagcacgttccagtgtttgaagacttcctaagagatcttagggattctgttaaaactgtgaaggaaaacccaggtgcaattagtggtggacttgctccggtctatggtgctgcaggaaagatgcctgatagaggtatggtggaggagttgctggtagaattcatggacaactcctgctagccctggtttcttgtgcaactccatacaaaatctcatagtatttctaaaatttcttcctgttacctttgttgttgaaagaaaatgccattcagatatgaaggtttatgaactattcctctcacgctgtattgacattgcttatccatttgagagggtgtatgttgttacaataggacgcatcacagataatcctggtaggagacgatcaatatgaatgtattattttgaacgtttataaggcaatgacattatc

SEQ ID NO: 957 - DNA, 2225 bp, Ananas comosus
cctcgcgctcctcctcgcccgcgccctccactccgccctcgccgtgctccacgagaaggggatccagggcgccgtgctagggtttctcatgagctccgcgaagttgattcccggagtgagcggctacatcgaatcggagaagaggaaggttgttgacaagttgcagtcaggaagcaagtctcaaagagagaactggagaaccgagttaccgattgttgggcttagtgaaggagcaattcaggaacttaaagaagcaaaagctaaagatgtggtttggcaaggcaaatgctctggtacagtatatattgctggaaatgagtctgatggccattttgcgctgataaacgaggcatattcaatgttttcacacaccaatccgctacaccaggatgtgttccagagtgtggcacgttttgaggcggaggtggttgcgatgacagctgctcttcttggcagcaaggaaaagacatctggagggcaaatttgtggcaacatgacatcaggagggacagaaagcatactattggctgttaaaacatctcgtgactatatgaggtcgaagaagggaattactaaaccagaaatgataatacctgaatcagcacattctgcatatgacaaggctgcacaatattacaacatcaagctgtggcgtgtacccgtaaacaagaactttgttgcagacgttaaaggaataaagcaacgcatcaacagaaacaccatactgattgttggttctgcacccggatttccacatggcattatcgatcccatagaagagcttggagaactggcgtcatcttatggtatttgcctgcatgttgatctttgccttggtggcttcgttttgccatttgctcgtaagcttgggtacccacttcgacctttcgatttctctgtgaaaggagttacatccatttcaacagatgtccataagtatggattagctcctaagggcacgagtatagttctttacagaaatcatgaaattagaaagcatcaatttgttgccgtaactgagtggtcaggcgggctgtacgtttcccctacgatggcaggaagccggcctggtggattaatcgccggggcttgggccgctatgatgtcactaggcctgaacggatacttggaaaatacgagacagataatggaagtagcgaagaagatacagaaagggatagaggagattccacagttgtttatcgttggaaaaccgcacatgactgtgatagctttcggctcgaatgtcctcgacatctttgaggtgaacgatataatgtcgtcgaaagggtggcacctgagtgctttgcagagacctaacagccttcatatttgcgtgacccttcaacacgttactgttttcgaagacttcctcaacgatctaaaagattctgttaaaattgtaaaagagaaccccggcccgatagacggagggaaggccccgatctacggtgcggcgggaaagatgccggaccgaggaatggtgcgggatttgttggtggaattcatggatggcacttgctaggtgagctattgagctctacacaaacatcatacaacaccatcttttattcttcatctctatttctgttaaccacatttacaataaaaacatgtgctgaatatctccaagtgatttctatttattcactccctgtgttagcatataaccgaatgggtataaaattgtaacatgttgtacatgttaatctgtgtattttcatttctactcctgttgccacatttacaataaacatatgctgaatagcttttagtgatttctatttgtttactcccgtgttagcatatagtcaaatgggcatagattgtaacgtgtcgtacatgatgatctgtgtatctgcgctgcttgacttgtttgtacaatggtaaatgcaatttcatatccgtgctgatgaatcgtattgagtggttttatgtccttggatgtttctgtgttgaaatttaatgctaaacttaattctctgttcgtatggtaatgcaatttcatatctgtgctgttgtgtgtccttgaatgtttcagtgttgaaacttacgactaaacttaattctctattcgaatgttaccttacaatccccataagcttttggattgtacttttagaatcgggatccaataaccactactggatgtgagtagggatgcaaacggatctggattggtggagctcacacgccaatccgccccgaattgggcagtagacaag

SEQ ID NO: 958 - DNA, 1577 bp, Triticum aestivum
ttgagcagttgcagtcaggcagcgcgtccagcaagaagaacctgcgaaccgagctgcccgccgtcggggatcccgacggagtcatagacgagctccaggcgctcaaagacaaggatgtgagatggcagggcaaatgctccggcaccgtttatatcgctgggagcgagtctgaaggccatttttcacttataaacaaggcctactctatgttttcacacacaaatccactgcatcaggatgtattcaagagtgtggcacagttagaggctgaagtagtagcaatgacagctgctttgcttggcagcaaagaaaaggcgtctggtggacaaatttgtggcaatatgacgtcaggcgggactgaaagcatattgttggccgtcaaaacatcacgcgattatatgcaatcaaagaagggaatcacaaagcccgaaattataattgctgaatcagctcattctgcctatgacaaagctgctcaatatttcaatattaaagtgcggcgtgtacctgtgaataaagaatttcttgcagatgtaaaaggattcaaacggtgcataaatggaaacaccataatgatggttggatctgcaccaggatttccccacggtttaattgatcccatcgaggaacttggggagttggcttcacaatatggtatttgcttgcatgttgatctatgccttggtggcttcgtattgcctttcgcccgtaagcttgggtatcctattcctccttttgatttttctgtcaaaggtgttacgtcgatctcaacagatgttcataagtatgggctagccccaaaaggcaccagtactgtcctatacaggaatcatgaaattagaaagcaccaatttgttgctgtgacggaatggactggtgggctctatatttcccctactatggctggaagcaggccaggtggactagtcgcaggagcttgggctgcgatgatgtctcttggattgaatggttatttggaaagtactggtaaaatcatggaagtctcaaggaagatacaaaaaggaattgatgatatctcaggtttatttgtgattgggaagccagacatgaccgtcgtggcctttgggtcggacgcagtcgacatatttgaggtgaatgacataatgtcatcaaaaggatggcacctcaatgctcttcagagacccaacagtctgcacatctgcgtgacgcttcaacacacggctatctatgaggaattcctcaaggacctcgaggattctgtgaacacagtgaaagcgaatccagggcctatcagcggggggatggctccgatctacggcgcggctgggaagatgccggacagaggcacggtcaaggagttgcttgtggagttcatggacagctcttgctaaccattgactataccccattggttggtcatctctctgtaacatgcatatgtacaagccgcagtgacagtgttgtgtgatcttctatatttggtttggctcaaaactgaaggcacacaacacaatgcctccaatatagacatgtatctatgtatcagttacattggtcgcaataaagttacattttcagcctattgctcctatata

SEQ ID NO: 959 - DNA, 1642 bp, Papaver somniferum
atcatcatcatcagttttaaggaatagagtgaattcatatctatcagaatatgaaccgatactactagttgtaactccactcttagcactcttaattgcttctgttcttcactcattctttaattatgttcaagataaaggattcaaatctgctctaatagggtttttcatgaactccatcaagttgattccatttgttaagaattacatcgatgctgagaaacaaaaggtggttgataagatgcaatctggtggaaaatctaaaagagatggttggcaaacagagttaccgaaggttggattaggaggacatgtaatagacaagttgagagaagagaaagaaaaagatgtggcttggcaaggaaaatgctccggtacagtgtacattggtggaaatgactcagagaggcatttttctttgataaatgaggcgtattcaatgtttgcacataccaatccgttgcatcaagatgtatttcagagtgtagtacggtttgaggcagaggtggttgcaatgactgctgcattgcttggaagtaaggagaaggcttcaggaggacaaatctgtggaaatatgacatcaggagggactgaaagtatactactagctgtgaaaacgtcacgcgattacatgagaacaaagaagggaataacgaaaccagaaatgataattcctgaatctgcacactcagcatatgacaaggctgcacagtattttaatatcaagttgtggcgagtcccagtaaacaaagagtttcaagcagatgtcaaagcaatccgaagatttgttaacaagaatactattttaattgttggatctgccccgggtttccctcatggaataatcgatcccattgaagaacttggtgaattggcatccagggcgggaatttgtttgcatgtcgacctttgtcttggtggcttcgttttgccttttgctcgtaaactcgggtacccaattccccccttcgacttttccgtcgaaggagtaacatcaatatcagttgatgtgcacaagtatggattggctcctaagggaacaagtacagttctatacaggaatcatgaaatacgaaagcaccaatttgttgctgttaccgagtggtcaggtgggctttatatttctccaacaattgccggaagcaggcctgggggtttgagtgccggggcttgggcagcaatgatgagtctaggcctagaaggttacttgcaaaatactagagagatcatggaagtgtctaagcaaatacaaaaagggataaaggagattcctgagctatttatcattggaaggccagacatgacaattgttgcattcggttcaaatgatttagacatattcgaagtcaatgatataatgtcctccaatggttggcatttgaatgcactgcagagaccaaacagcttgcatatttgcgcgactcttcagcatgtttcggtggttgaggacttcctcagagtcttgaaggaagctgtgcaaacggttaaagcaaatcccggaccaatcaagggagggatggctcccatatatggtgcagcagggaaaatgcctgatagaggtatggttcacgatttgttggtagattttatggatagctcttgttaatgtgagagcctccactcaatgttgttctccttgcca

SEQ ID NO: 960 - DNA, 2021 bp, Phalaenopsis aphrodite
ataacttcaaaaagctcttctcatcttaactttcacggatccacctcgtgcaggctcgcatcggaatctaatcgccgatcatggagaatactttgcagcaactccggcaatcggcgaactcgttcctctcgcagtatgagccaatcgccctcctctctgttcctttacttgcgcttgtagttgccagagctcttcactccctcctgagcgcaattcaggataggggtatcaaagcggtggtgataggcttcataatgagctccgtgaatttgattccgagcgtcaggagccgcattgaatccgagaagaagaaggcagtggagaaactacaatctagcaacaaatctaacagggatgactggataactgctttgccaagtattggactagggaaggaagttctggagaagctagaagtggcaaaatgtaaagatgaagattggaaaggcaaatgctctgggacaatctatattggtggaagtcaaagcgagggccatttttctttgacaaatgaggcatactcaatgttttcgcacaccaatccattacatcaggatgtatttcgaagtgtggcgaagtttgaagctgaagttgttgctatgactgctgcactccttggaagtaaagaaaaagaatcaggagggcaaatatgtggaaacatgacatctggtggaactgaaagtatacttttagctgttaaatcatcaagagattttatgaaagctaaaaagggaattacaaaaccagaaatgataatagcagtatctgcacattcggcatatgataaggctgcacaatactttaatattaaggtgcgacgtgttcctgttaataaagaatttgttgcagatgttaaagctgtcaggcgaagcattaataggaacaccattttgattattgggtctgcaccaggattcccacatggtgtcattgatcctattgaagagcttggggagttggcatcttgccatggtgtttgcttgcacgttgatctttgccttggtggatttgtattgccatttgctagaaagcttgggtacccaattccaccttttgatttttccgtcaaaggagttacgtcaatctcagcagatgttcacaaatatggattaggtccaaagggcaccagtgtagttctgtacagaaatcatgaaattagaaagaatcaatttgttgctgtcactgaatggtcgggtgggctttatgtttctcctacaattgctggaagtagacctggtgggttgatagctggagcatgggctgcaatgatgtcattgggattgaatggatacttggaaaatacacgtcaggttatggaagtatctaagaaaatacagaaagggattgaagaaattcctgaactatttatcgtcggaaagcctgacatgactgtagtagcatttggttctgatgtcatagacatttttgaggtcaacgatattatctcttctaaaggttggcatttgaatgctttgcaaaggccgaacagccttcacatttgtgtcacacttcaacacgttcctgtttatgaagccttcctgaatgatttgagggagtctgttaaaattgtaaaacaaaatcctggtccagtcagcggagggctcgctcccatgtatggtgcggcaggaaagattcctcatagaggtttgctacaagaattactagtagagttcatggacggtagttgctagccctggttatatggctttgtttgctgctgctaccgaatttcccaacacgcctgcatttatatacacgtccggtcataggaactttggggcaattttccagttgttttatacgtgatcattatacacaatcctcacagaatacggactatattgatttgaatatttgataaaaggtttgatgaattataacaagaatttcttacaaagaaatcttgtgactgtgttcagaatccttgtattgtaattaaatttatgttggtgaaaaacctgtctacatttaaatttgtatttaaaggttttcatctactatttgttattattttcttcaaa

SEQ ID NO: 961 - DNA, 1864 bp, Papaver somniferum
ttttttttttttgattttcaatggagtatttctcatcatcatcagttttgataagctttaggaatagagtgaattcatatttatcagaatatgaaccgatactactagttgtaactccagtcgtagcactctttattgcttctgttcttcactcattctttaattatgttcaagataaaggattcaaatctgctcttatagggtttttcatgaactctatcaagttgattccatttgttaagaattacatcgatgctgagaaacaaaaggtggttgataagatgcaatctggtggtaaatctaaaagagatggttggcaaactgagttaccgaaggttggattagggggacatgtaatagacaagttgaaagaagagaaagaaaaagatgtggcttggcaagggaaatgctctggtacagtatacattggtggaaatgactcagagaggcatttttctttgataaatgaggcgtattcaatgtttgcacataccaatccattgcatcaagatgtatttcagagtgtagtacggtttgaggcagaggtggttgcaatgacagctgcattgcttggaagtaaggagaaggcttcgggaggacaaatctgtggaaatatgacatctggagggactgaaagtatactactagctgtgaaaacatcacgcgactacatgagaacaaagaagggaataacgaaaccagaaatgataattcctgaatctgcacactcagcatatgacaaggccgcacaatattttaatatcaagttgtggcgagtcccagtaaacaaagagtttcaagcagatgtcaaagcaatccgaagatttgttaacaggaatactattctaattgttggatctgccccaggtttccctcatggaataattgatcccattgaagaacttggtgaactggcatccagtatggggatttgtttgcatgtggacctttgtcttggtggcttcgttttgccttttgctcgtaaacttggatacccagttccccccttcgacttttctgttgaaggagtaacatcgatatcagttgatgtgcacaagtatgggttggctcctaagggaacaagtacagttctatacagaaatcatgaaatacgaaagcaccaatttgttgctgttaccgagtggtcaggtgggctttatatttctccaacaatagctgggagcaggcctgggggtttgagtgccggggcttgggcagcaatgatgagtctaggcctagaaggctacttgcaaaacactagagagatcatggaagtgtctaagcaaatacaaaaagggataaaggagattcctgagctatttatcattggaaggccagacatgacaattgttgcattcggttcaaatgatatagacatattcgaagtctatgatataatgtcctccaatggctggcatttgaatgcactgcagagaccgaacagcttgcatatttgtgtgactcttcagcatgtttcggtagttgaggacttcctcagagtcttgaaggaagctgtgcaaacggttaaagcaaatcctggaccaatcaagggagggatggctccgatatatggtgcagcagggaaaatgcctgatagaggtatggttcacgatttgttggtagattttatggatagctcttgttaatgtgagagcctccactcaacgttgttctccttgccgtttctgttgtattgaatttgtctgagagactggcgcacatatttattgtctgaaggatcacactgtcctgtaagtgcagctccataacagtgagataatcttagcaaactacttgtcacgaataataatagaaaactatttagcttgaagtacctacggtacccgaaaaggggtaccaaccg

SEQ ID NO: 962 - DNA, 1949 bp, Musa acuminata
gttgtcgccaaccaacccatcggtaggatccctctcccaggcatcggccgcccttcgcgtccctcaccttacctcgccggctcaatggaggaccgcatgctccgcctccgtgccgccgccaatgccgccctctcgcggtacgagcctctcgccctcgtcgtcgcgccgcttctcaccctcctcctcgcgcgctccctccacgcgctcttcctctccgtccgtgagaaagggatcaaggccgccgttctagggttccttatcgcctccgtcaagtcgattcccggcgtgagctggtatattgaatccgagaagaaaaaggttgtggagaaattacaatctggtagtaagtctaaaagggatagctggagaactgagttaccaaacattggacttggtaaagcaactatacaggaactagaagatgcaaggaataaagatatagcttggcaaggcaaatgctctggtacagtatatattggtggaagtgactcagagaaccattttgctttgataaacgaggcacatgcaatgttttcacataccaatccattgcatcaggatgtgttccaaagtgtggcaagatatgaagcagaagtggttgcaatgacagctgctctccttggcagtagagagccggcatctggaggacaaatatgtggcaacatgacatcaggaggaacagaaagtatattattagctgttaaaacatcacgagattacatgagaaccaagaagggtattacaaagccagaaatgataattccaggatcggcacattctgcatatgataaagctgcacaatactttaatattaagctgtggcgtgttcctgtaaataaagattatgttgcagatgttaaaagaattatgcgctgcatcaacggaaacaccatattgattgttggatctgcaccagggtttccacatggcgtcattgatcctattgaagagcttggggatttagcatcaagatatggtgtttgtttgcatgttgatctttgccttggtggctttgttttaccattcgctcgtaagctggggtatcccatcccaccttttgatttttctgttaaaggggttacatcaatttcaactgatgttcacaagtatggattaggtcccaagggcacaagtgtggttctttacagaaatcgtgagataagaaagcaccaatttgttgctgtcacagagtggtcaggtgggctatatgtatcccctactatggctggaagcagacctggtgggttgatcgccggggcttgggcagcaatgatgtctctggggctgaatggttatttggaaaatacaagacaaatgatggaagtctccaagaagatacagaaagggatagaggagattccagggctgtttatcattggacagccacacatgactgtcgtggcttttggctccaatgatattgacatctttgaggtcaacgatatgatgacctcgaaaggatggcacttaaatgctttacagaaacccaacagtattcatatctgtgtcacccttcagcatcttcatgtggtcggagactttctgagagatcttagggagtccgtgaagatggtaaaagaaaacccaggtccgatcagtggagggcttgcaccactctacggtgccgcgggaaagatgccagataggggaatcgtgcaggacctgttggttgagttcatggacagctcttgctagctgcagcatttagacataccaattcttaagctctttgcctcaccaggttgttgcagaaacgtaattggatgatataagtatttcagccatgttaacataatttagccactcaaggggatattactgtacaagaatgtagaacacttgttgttttacttcaaaaacaatcaatcaggcgttatttagtttatatgtaattgagttgtgaactccttactggttctccttctcaactcttttattgtcaatcccac

SEQ ID NO: 963 - DNA, 1850 bp, Papaver somniferum
tcaatggagtatttctcatcatcatcatcagttttgataagcttaaggaatagagtgaattcatatttatcagaatatgaaccaatactactagttgtaactccactcacagcactcttaattgcttctactcttcactcattcttgaatcatattcaaaatcaaggattcaaatctgcttttatagggttttttatgaactctatcaagttgattccatttgttaagaattacatagatgctgagaaacaaaaggtggttgataagatgcaatctggtggtaaatctaaaagagatggttggcaaactgagttaccaaaggttggattaggaggacatgtaatagacaagttgagagaagagaaagaaaaagatgtggcttggcaagggaaatgctccggtacagtatacattggtggaaatgactcggagaggcatttttctttgataaatgaggcgtattcaatgtttgcacatacgaatccgttgcatcaagatgtgtttcagagtgtagtacggtttgaggcagaggtggttgcaatgacagctgcattgcttggaagtaaggaaacggcttcgggaggacaaatctgtggaaatatgacatcaggagggactgaaagtatactactagctgtgaaaacatcacgcgattacatgagaacaaagaagggaataaggaaaccagaaatgataattcctgaatctgcacactcagcatatgacaaggctgcacagtattttaatatcaagttgtggcgagtcccagtaaacaaagagtttcaagcagatgtcaaagcaatccgaagatttgttaacaagaatactattttaattgttggatctgccccaggtttccctcatggaataatcgatcccattgaagaacttggtgaactggcatccagtatgggaatttgtttgcatgtcgacctttgccttggtggcttcgttttgccttttgctcgtaaacttgggtacccaattccccccttcgacttttcggttgaaggagtaacatcaatatcagttgatgtccacaaatatgggttggctcctaagggaacaagtacagttctatacaggaatcatgaaatacgaaagcaccaatttgttgctgttactgagtggtcaggtgggctttatatttctccaacaatagcagggagcaggcctgggggtttgagtgccggggcttgggcagcaatgatgagtctaggcctagaaggttacttgcaaaacactagagagatcatggaagtgtctaagcaaatacaaaaagggataaaggagattcctgagctatttatcattggaaggccagacatgacaattgtcgcattcggttcaaatgatttagacatattcgaagtcaatgatataatgtcctccaatggctggcatttgaatgcactgcagagaccgaacagcctgcatatttgcgtgactcttcagcatgtttcggtggttgaggacttcctcagagtcttgaaggaagctgtgcaaacggttaaagcaaatcccggaccagtcaagggagggatggctccgatatatggtgcagcagggaaaatgcctgatagaggtatggttcacgatttgttggtagattttatggatagctcttgttgatgtgagagcctccagtcaacgttgttctccttgccatttctgttgtattgaatttgtctgagacactggcacacgtattaattgtctggaggaccacacggttcctacatatttagttttacataacaatgggaggaacctgcaagtgcagatccatgacaatgagataatcttagcaaactacttgtgactattatattgaaaacgtttgatttttg

SEQ ID NO: 964 - DNA, 1541 bp, Secale cereale
agttgcagtcaggaagtgcatcctccaagaagaacctgcgaaccgagctgcccgccgtcggggatcccgacggagtcataggggagctccaggcgctcaaagacaaggatgtgagatggcagggcaaatgctccggcacagtttatatcgccgggagtgagtccgaaggccatttttcactaataaacaaggcctactctatgttttcacacacgaatccactgcatcaggatgtattcaagagtgtggcacagttagaggctgaagtagttgcaatgacagctgctttgcttggcagcaaagataaggcgtcaggtggacaaatttgtggcaatatgacgtcaggtggaactgaaagcatattattggccgtcaaaacaacacgcgattatatgcagtcaaagaagggaatcacaaagcctgaaataataattgctgaatcagctcattctgcctatgacaaagctgctcaatatttcaatattaaagtgcggcgtgtacctgtgaataaagaatttcttgcagatgtaaaaggattcagacggtgcataaatggaaacaccataatgatggttggatctgcaccaggatttccccatggtttaattgatcccattgaggaacttggggagttggcttcacaatatggtatttgcttgcatgttgatctatgccttggtggcttcgtattgcctttcgcccgtaagcttgggtaccctattcctccttttgatttttctgtcaaaggtgttacgtctatctcaacggatgttcataagtatgggctagctccaaaaggcaccagtactgtcctatacaggaatcatgaaattagaaagcaccaatttgttgctgtgacggaatggactggtgggttgtatgtttcccctactatggctggaagcaggccaggtggactaattgcaggagcttgggctgcgatgatgtctcttggattgaatggttatttggaaagtaccggtcaaatcatggaagtctcaaagaagatacaaaaaggaattgatggtatctcaggtttatttgtaattgggaagccagacatgaccgtcgtggcctttgggtcggatgcggtcgacatatttgaggtgaatgacataatgtcatcaaaaggatggcacctgaatgctcttcagagacccaacagtctgcacatctgcgtgacgcttcaacacacggctatctatgaggaattcctcaaggacctcgaggattccgtgaacacagtgaaagcgaacccagggcctatcagcggggggatggctcccatctacggcgcggccgggaagatgccggacagaggcacggtcaaggagttgcttgtggagttcatggacagctcttgctaactattggctataccccattggttatctctctgtagcatgtgtacatacaagccgcagtgacagtcttgtgtgatcttctatatttggtttggctgcaaaactgaaggcacacaatgcctccaatatatctatgtatcagttacattggttgcaataaagttacattttcagcca

SEQ ID NO: 965 - DNA, 1930 bp, Eucalyptus grandis
atcatttcttaatcgaacgaagaagccattaccgtgctctacttgacaagaagaagcaactgcgagctgctcttccttcttcaacgtctcgtcgtcttccatcttcttctccttctccttcatctgctgccgccatggcgtccgccgttctccgcctgagagcttccgcgaactccttcctgtcgcagtacgagcccctcgccctgctcctcgcgcccctcctcgccgtcctcgtcgcccgcgcggtccgatcgttcgtcggcattttgcacgagagagggctcaaggcgaccttcataggcttcttcatgagctgcgccaagttggtccctgccgtgaagagttatatagatgcagagaagcagaaggtggtggaccagttacagtctggtggtcaatctaaaagaaaaagctggagaactgagttgccaagatctggtatgggaaatggcgtaatagatatgatgaaggaagaaaaaaggaatgatgcggtttggcaaggcaaatgctcgggtacagtatacatcaggggaagcgaatgcgaggggcatttttcactgataaatgaggcctgttctatgtttgcacacaccaacccgttgcacttagatgtcttccacagtgtggttcgatttgaagcagaggttgttgccatgactgctgctttattgggaagtaaagaaaaagtttcgggaggacaaatatgtggaaacatgacatctgggggaacggagagtatattattagcagtgaagacttcacgtgattatatgagagcgaagaagggaattacatcgcctgaaatgataataccggaatctgcacactcagcatatgacaaggctgcccagtacttcaacatcaaactgtggcgtgttcctgtgaataaagaattccgagcggatgtaaaagcaattaagcggcacattaacagaaacaccatcttgattattggatctgcacccgggtttcctcatggcatcattgatcccattgaggagcttggtgaactcgcttctagcttcaacatatgtctccatgttgacctttgtcttggtggctttgtattacctttcgctcgtaaactcgggtatccagttcctccctttgatttttctgttgaaggggtaacatcaatatcagtagatgtacacaaatatggtttggcccctaagggaactagtgtagttctatacagaaatcatgacatcaggaagcatcaatttgttgctgtgacggagtggtccggaggtctctatgtatctccaaccatggccgggagcagaccagggggcttgattgctggtgcttgggcggcaatgatgtctctaggggaggaaggttatctagaaaacacaaaagagatcatggaagcgtcaaagaagattgaaagaggaataaaggaaattccagagattttcatcattggcaggccggacatgacacttgtagcctttggttctgatgttattgacatattcgaagtcaatgatatcatgtcatccaaaggctggcacttgaatgcactgcagagacccaacagcttacatatatgtgtgacccttcaacatgtaccaatggttgaagacttcctcaaggatttgaaggaatccgtgaacactgtcaaagaaaatccaggtcccataagcggagggaaggctcctatttatggtgctgcaggaaagatgccagatagaggaatggtccaggaattgttggtaagtttcatggacagtgcttgctaagtggctttggctgggtgtttctcaatcttcttgggacctgttcttcaaactttaacatcatgggtcattttgtatcttaatcttcagtccttgatattcttggattttcgcacgactgtgctcttgtttatcagaataatatatatgcccgattatcaactagtgatgtggattgtcaaaaacca

SEQ ID NO: 966 - DNA, 1714 bp, Musa acuminata
ctctgttgtcgccagccaacccatcggtaggatccctctcccaggcatcggccgcccttcgcgtccctcacctaacctcgccggctcaatggaggaccgcatgctccgcctccgtgcagccgccaatgccgccctctcgcggtacgagcctctcgccctcgtcgtcgcgccgcttctcaccctcctcctcgcgcgctccctccacgcgctcttcctctccgtccgtgagaaagggatcaaggccgccgttctagggttacttttcgcctgcgtcaagtcgattcccggcgtgagctggtatattgaatccgagaagaaaaaggttgtggagaaattacaatctggtagtaagtctaaaagggatagctggagaactgagttaccaaacattggacttggtaaagcaactatacaggaactagaagatgcaaggaataaagatatagcttggcaaggcaaatgctctgggacagtatatattggtggaagtgactcagagaaccattttgctttgataaacgaggcacatgcgatgttttcacataccaatccattgcatcaggatgtgttccaaagtgtggcaagatatgaggcagaagtggttgcaatgacagctgctctccttagcagtagagagccggcatctggaggacaaatatgtggcaacatgacatcaggaggaacagaaagtatattattagctgttaaaacatcacgagattacatgagaaccaagaagggtattacaaagccagaaatgataattccaggatcggcacattctgcatatgataaagctgcacaatactttaatattaagctgtggcgtgttcctgtaaataaagattatgttgcagatgttcaaagaattaggcgttgcatcaatggaaacaccatattgattgttggatctgcaccagggtttccacatggcgtcattgatcctattgaagagcttggggatttagcatcaagatatggtgtttgtttgcatgttgatctctgcctcggtggctttgttttaccattcgctcgtaagctggggtatcccatcccaccttttgatttttctgttaaaggggttacatcaatttcaaccgatgttcacaagtatggattaggtcccaagggcacaagtgtggttctttacagaaatcgtgagataagaaagcaccaatttgttgctgtcacagagtggtcaggtgggctatatgtatcccctactatggctggaagcagacctggtgggttgatcgccggggcttgggcggcaatgatgtctctggggctgaatggttatttggaaaatacaagacaaatgatggaagtctccaagaagatacagaaagggatagaggagattccagggctgtttatcattggacagccacacatgactgtcgtggcttttggctccaatgatattgacatctttgaggtcaacgatatgatgacctcaaaaggatggcacttaaatgctttacagaaacccaacagtattcatatctgtgtcacccttcagcatcttcatgtggtcggagactttctgagagatcttagggagtccgtgaagatggtaaaagaaaacccaggtccgatcagtggagggcttgcaccactctacggtgccgcgggaaagatgccagataggggaatcgtgcaggacctgttggttgagttcatggacagctcttgctagctgcagcatttagac

SEQ ID NO: 967 - DNA, 1986 bp, Amorphophallus konjac
tcttcttcttcgttaacggattcaaatcctgtgtatagccagagagccggagccagaggagccatggagggctatgccgctcgcctcagggccgccgccaacgccgcgctgtcgcagtacgagcccgtcgtcctcgtcacctcccccttgctcgccctgctcgtcgcctgggccgttcacgccttgctttcccacctccgggagaaaggcgccaaggccgccgccgtcggcgcgttcatggcggccgttaagttaattcccggcgtcaacagttacatccagtccgagaagaggaaggttgcggataaattacagtccagcatcaagtcaggaagggatagttggagaactgaattgccaggtctaggtcttggattgggtgtcttagaggagctacaagaagataaaaagaaagatgtgacatggcaaggcaaatgctcgggtaccgtttatattggtggaagtgaactcgaaggccactttactttgataaatgaagcatgttcaatgttttcacatacaaatcctttgcatcaggatatattccgaagtattgcacgttatgaggcagaagtggttgccatgacagctacactactaggcagcaaagagaagaattctggagggcaaatctgtggcaacatgacatctggagggactgaaagtatattattagctgttaaatcttcacgtgattatatgaaaatgaagaggggaatctcgaagccagaaatgataatcgcagaatctgcacattctgcatatgacaaggctggacaatatttaaagatcaaggtctggcgtgtccctgtaaataatgattttcaagcagatgtgaaggcaatcaaaagatatattaacaaaaacactattttgattgttggttctgcacctgggtttccacatggcattattgatcccattgaggagcttggtgaattagcttctaactttggcatttgctttcacgttgatctttgccttggtggctttgtattgccatttgcacgtaagcttgggtaccccattcccctgttcgatttttctgttagaggagttacatcaatatcggcagatgtacacaagtatgggctgggtccaaaggggaccagtgtagttttgtacaggaatcatgaaattagaaagcaccaatttgttgctgttacggagtggtctggcgggctttatgtttcaccaactgtagctggaagcagaccaggggggctgattgcaggtgcctgggcagctatgatgtcactggggctagaaggatacttggaaaagacaagggagattatggaagtatcaaagaagatacagaaagggatcaaggaaatacctggattatttattattggccggccagacatgacagtcgtagcattcggctccaatgatgttgacatatttgaagtcaatgatataatgtcatctagaggttggcatttgaatgcattgcagaggcccaacagcctgcatatctgcgtcacacttcagcatgttcctgttgccgatgattttctgaaggatctgaaggagtctgttgaaactgtgaagcaaaaccctggtccaattagcggtgggcttgctccaatctatggtgctgcagggaagatgcctgatagaggtttggttgaggacttactgattgaattcatggatggcacttgctagctctggaagggctctggcctctgagcatacagaatttccacgttgacaaaattttcgtattgctagtattctgcaaaatgtaatcgtcaaaaaataagcgttacccgccccatcggaaagtgcgatatatgcggttgcgccgtgtggtaccggtttgcgaggtcgttttgaccgtttcctctccaagtagctgccactcccaactattggacatctattttcttcaataaaattgtaagaaaatataatctctctgaacctcccccttctttctattttgaagttgcggccgtattcgtccagcttaacttg

SEQ ID NO: 968 - DNA, 2067 bp, Lupinus angustifolius
agagtagaatatctcgcaatagcggctgtgtataaattagtcttataatcttatcgacgcaaacattgattcttcttcatttctctgttactctgcaacaatggcgaattcatctattacttttcatttcaatcatttcagagtttccaccaattcctttctctcacaatacgaacctcttcttcttctcatcactcctcttttctctctattcatcgctcattcaattcgctcttttttcaatgtctttcgtgataagggattcaaagccacaataatcacttttatcttgaacttcatcaaattgatccctggcgttaaaagctacatccaagctgagaaacaaaaggttgtggatcagatgcagtcgggtggtaaatctaaaagagaaggttggctaacagagttaccaagcacaggactaggaaaatctgtccttgaaaaaatgaaagaagagaaaagaaatgatccggtttggcaaggcaaatgttctggtacagtctacattggaggcagtgaatctgatggacatttttttgtgataaatgaggcatgctcaatgtttgcacataccaatcccttgcatttggatgtattccggagtgtagcacactttgaggcagaagtggttgcaatgacagcagcacttcttggaagtaaggaacatatttctggaggacaaatatgtggcaatatgacatcgggagggactgaaagtatattattagctgtcaaaacatctcgtgattatatgaaatctaagaaagggattacaagacctgaaatgataattcccgagtctgcacactcagcgtatgacaaggccgcccagtattttaatatcaagttatggcgtgttccggttaacaaaaattttcaagcagaagcgaaagcaattagacgtcgtattaacaaaaataccattatgattgttggatctgctccagggtttcctcatggaataattgaccccattgaagaacttggtcatctcgcatcaagctatggtatttgtctccatgtggacctttgccttggtggctttgtattaccttttgctcgtgagcttgggtaccccattccaccttttgatttttctgttaaaggagttacttctatatcagtggatgtgcataaatacggattagcccccaaaggaacaagtatcgttctatataggaaccatgaaatcagaaagcatcaatttgttgccgttactgagtggagtggtgggttgtatgtgtctccaaccatagctggaagccggcctggaggtcttattgccggagcatgggcagcaatgatttctctaggaaaagaaggttacttgaaaaatacaaaagaaattatggaagcatcaaaaaaaatacagaaaggtgtagaggagattcccgagttgtttgtcgttggaaggcccgacatgacaattgtggcttttggatctgatgttctggacatatttgaggtcaatgacatcatgtcatccaaaggatggcatttgaatgcattgcagagacccaacagcctccatatctgtgtgacactgcagcatgtgccagttgttgaagacttcctcagcgagttgaaggaatcggtgaaaactgtgaaagaaaatcctggtccaataaaaggaggcctagcacctatatatggtgccgcagggaagatgccagatagaggcacagtccaggaattgctggtagaatatatggacggtacttgctagtagccgattgtcgacaatctatcgcctttcgctcctttttatcggtcgaaaaatattatctctcattattagttaacgtttatttaaatcaattgatcaatcataaagtaagacaccgatatgtgtcgtgtgtgagaacatatattatctccttttgtatggtcccattagtaaacgatatttgattttactgtgccttctttcatattgattaaacaactcaaatgaatagaaaagtaatgctcatttgtttgcgtcattatattagtcgattttccggtgagattacgatttgtttgttgttgataattgacgattactaaaatattgttttttgattc

SEQ ID NO: 969 - DNA, 1796 bp, Tropaeolum majus
cgcaagtagttcaatcattcattgggctgattaacgagaaaggactaaaagcaagtttaattgggggttttatgagctttatcaagctgttccctggtgtgcagagctacataaatgcggagaaacaaaaggttgtggatcaattacagtctggcagtaaatctacaagagaaagttggagaaatgatttgccggggacaggtttcggggtagaagttttagaaataatgaaagatgaaaagagaaaagatgtcaattggcaagggaaatgctctggtacagtatacattggtggaaccgagactgaagggcatttttctctgataaacgaggcatgctcgttgtttgcacataccaatccattgcatttggatgtattccagagtgtagctaaatttgaggcagaagtggtagcaatgaccgcagctcttcttggcagcaaagaaaaggcttctggaggagaagtgtgtggaaacatgacatcaggaggaactgaaagtatattattagctgtaaaatcatcccgtgactatatgaaatataagaagggaatcacaaggcctgaaatgatcatacctgaatctgctcactcagcatacgacaaggcagcacagtatttcaaaattaagttgtggagagtccctgtcaataaagaatttcaagctgatgttaaagcaataaaacggcatataaacagaaacaccatcctgatagtcggatctgcacctgggtttcctcatggcattattgaccctattgaggaacttggtgaattggcttctagagctggagtatgtctccatgttgatctttgtcttggtggctttgtattaccgtttgcgcgtaaacttgggtaccctattccacctttcgatttctctgtgcgaggagtaacttcaatatctgttgatgtgcataaatatgggttggctcctaaaggaactagtgtagttttgtacagaaatcatgatattagaaagcatcagtttgttgctgttaccgagtggtctggtgggctgtatgtatctccaactatagctggaagcaggcctggtggtttgattgctggggcatgggccgcaatgatgtctctgggacaagaaggctacttggagaacacgaaaaaaataatggaagtatcaaagagaatacaggacggaatcaaggagattcccgagttatttatcattggaaagcccgacatgacaatcgtggcgtttggatctagcgtagtcgacatctttgaagttaacgatattctatcttcgaaagggtggcatttgaatgcattacagagacctaacagccttcacatttgtgttacacttcaacatgtgcctattgttgagactttccttcaggatatgagagagtctgtgcagacggtaaaagaaaatccagggccgataaagggaggtttagctccgatatacggcgcagcaggtaaaatgccggacagaggcatggtaaaggatctgttggtaaattacatggatacgacatgctagttcaattcacgtttccgcgtctgatggtgtaatatatctttcgattcatttgaaaactaccgtgtcgtaaaaaaaaaaagcattaatttgattgatctatctttcttttttctctagaaaaaaaaacaatgtatggatgattgtgaaaatgatgcaggaaatgtagcattaagctctctcttgtttagtactttgtaataagtcacactatatgtaaacatatgaataagtgacataagtgtattctttcttattataaattacatacatttggtccaaaaaaaaaaa

SEQ ID NO: 970 - DNA, 1376 bp, Papaver somniferum
aggacatgtaatagacaagttgagagaagagaaagaaaaagatgtggcttggcaaggaaaatgctccggtacagtgtacattggtggaaatgactcagagaggcatttttctttgataaatgaggcgtattcaatgtttgcacataccaatccgttgcatcaagatgtatttcagagtgtagtacggtttgaggcagaggtggttgcaatgactgctgcattgcttggaagtaaggagaaagcttcaggaggacaaatctgtggaaatatgacatcaggagggactgaaagtatactactagctgtgaaaacgtcacgcgattacatgagaacaaagaagggaataacgaaaccagaaatgataattcctgaatctgcacactcagcatatgacaaggctgcacagtattttaatatcaagttgtggcgagtcccagtaaacaaagagtttcaagcagatgtcaaagcaatccgaagatttgttaacaagaatactatttaattgttggatctgccccgggtttccctcatggaataatcgatcccattgaagaacttggtgaattggcatccagggcgggaatttgtttgcatgtcgacctttgtcttggtggcttcgtttggccttttgctcgtaaactcgggtacccaattcccccctccgactttccgttcgaaggagtaacatcaatatcagttgatgtgcacaagtatggattggctcctaagggaacaagtacagttctatacaggaatcatgaaatacgaaagcaccaatttgttgctgttaccgagtggtcaggtgggctttatatttctccaacaattgccggagcaggctgggggtttgagtgccggggcttgggcagcaatgatgagtctaggcctagaaggttacttgcaaaatactagagagatcatggaagtgtctaagcaaatacaaaaagggataaaggagattcctgagctatttatcattggaaggccagacatgacaattgttgcattcggttcaaatgatttagacatattcgaagtcaatgatataatgtcctccaatggttggcatttgaatgcactgcagagaccaaacagcttgcatatttgcgtgactcttcagcatgtttcggtggttgagggcttcctcagagtcttgaaggaagctgtgcaaacggttaaagcaaatcccggaccaatcaagggagggatggctccgatatatggtgcagcagggaaaatgcctgatagaggtatggttcacgatttgttggtagattttatggatagctcttgttgatgtgagagcctccagtcaacgttgttctcctgccatttctgttgtattgaatttgtctgagacactggcacacgtattt

SEQ ID NO: 971 - DNA, 2012 bp, Sesamum indicum
cgtgaatttaaacatgggcgagatctatttctccaatcaaaacaagaacaacgtggttgtcggaaaattgaagttagcagcatgtcccgtcattaacaattgcgtgtactcccccgtctgctcaacaagttcacataaggaaggaagcattcgacttctcatttcataattctcatcaatccaacccaagagacgaaccccaaaagaaaagccaatgatggattttgatgagatattttcatctctgaatctgttcagagcttctgcaaattcagttttatctcagtacgagcctctcgcgctgcttcttgttcctatcctcacgcttcttgttgcgcgaattctccagtctgttcttcgtgtagttttcgagaaaggccttaaatctgccgtcctggagttcttcatggcctccgtcaagttggtgcctggtgtgcaaaagtacatcgatgctgaaaagcaaaaggttgtggataagttgcaaggttctggtaaatcgaaaagagatggttggaggtctgagttgccgaagacaggcttaggagttgaggtcattgataaaatgaaggatgagaaacaaaaagacgtggcatggcagggcaaatgttctggtacagtctatattgcaggaaatgaacaggaagggcacttctctttgattaacgaggcatgctcaatgtttgcacatactaatcctctacatctagatgtattccagagtgtagtaagatttgaagcagaagttgtggcaatgacagcttcacttcttggaagtaatgaaaaggcctctggaggacaaatatgtggaaatatgacatcaggagggacagaaagcatattgttggctgtgaaaacgtcacgggattacatgaaagttaagaagggaataactagcccagaaatgattataccagtttcagctcattcagcatatgacaaagctgcacactattttaaaatcaaattgtggcgtgttcctgtggaccaagattttcgagctgatgttaaagcagtcaaacgacatattaacaggaacaccatattgattgttggatcagcacctggcttccctcatggaattatcgacccgattgaggagcttggtgagttggcttctacttacaagatttgtttgcatgttgacctttgccttggtggtttcgtgttgccgtttgctcgtaagcttgggtatcctgtaccgccattcgatttttctgttcagggtgtaacctctatatctgtggacgtccacaaatacgggctcgctccgaaaggaacaagtgtggttttgtatagggaccatgagatacgcaagcatcaatttgttgccgtcactgaatggactggtgggctttatatatctccgacaattgctggaagcaggcctggcggtctcattgctggggcttgggcagctatgatgtctcttgggctagaaggttatctggagaacacgcggaagattatggaagcttcaaagagaatagagaagggggtccgccagattccggagttgttcatcattggaaggcctgatatgacgattgtggcttttggatccgacattgtcgacatatttgaagtgaatgatgtaatgtcgtcaaaaggctggcatttgaatgcattgcagaggcctaacagcatacacatctgcgtgacgcttcaacacgtagccgtcaccgaagatttcctcaaggatctgcaagactctgtgcaaacagttaaagcaaatccaggtccaatcaatggagggcttgctccaatttatggtgctgctggaaaaatgccagatagagctatggtccaagatttgttggttgatttcatggatagctcatgctagtgccaaatgccaatccttcatgcattttttattgtattttcacccttgtgatgctacatgttttcaatttatggaaaattgtcgattgttatacgtaatattcatgtaacatttgttgaaaagattatgtacctctcctctccagtttatatgcttgtgctctctggcc

SEQ ID NO: 972 - DNA, 1613 bp, Secale cereale
tgcagtcaggaagtgcatcctccaagaagaacctgcgaaccgagctgcccaccgtcggggatcccgacggagtcataggcgagctccaggcgctcaaagacaaggatgtgagatggcagggcaaatgctctggcacagtttatatcgctgggagcgagtccgaaggccatttttctctgataaacaaggcctactctatgttttcacacacaaatccactgcatcaggatgtattcaagagtgtggcacagttagaggctgaagtagttgcaatgacagctgctttgcttggcagcaaagataaggcgtcaggtggacaaatttgtggcaatatgacgtcaggtggaactgaaagcatattattggccgtcaaaacaacacgcgattatatgcagtcaaagaagggaatcacaaagcctgaaataataattgctgaatcagctcattctgcctatgacaaagctgctcaatatttcaatattaaagtgcggcgtgtacctgtgaataaagaatttcttgcagatgtaaaaggattcagacggtgcataaatggaaacaccataatgatggttggatctgcaccaggatttccccatggtttaattgatcccattgaggaacttggggagttggcttcaaaatatggtatttgcttgcatgttgatctatgccttggtggcttcgtattgcctttcgcccgtaagcttgggtatcctattcctccttttgatttttctgtcaaaggtgttatgtccatctcaacggatgttcataagtatgggctagctccaaaaggcaccagtactgtcctatacaggaatcatgaaattagaaagcaccaatttgttgctgtgactgaatggactggtgggctctatgtttcccctactatggctggaagcaggccaggtggactaatcgcaggagcttgggctgctatgatgtctcttggactaaatggttatttggaaagtaccggtcaaatcatggaagtctcgaagaagatagaaaaaggaattgatggtatctcaggtttatttgtgattgggaagccagacatgaccgtcgtggcctttgggtcggacgtggtcgacatatttgaggtgaatgacataatgtcatcaaaaggatggcacctcaatgctcttcagagacccaacagtctgcacatctgcgtgacgcttcaacacacgggtatctacgaggaattcctcaaggacctcgaggattccgtgaacacggtgaaagcgaatccagggcctatcagcggggggatggctcccatctacggcgcggctgggaagatgccggacagaggcacggtcaaggagttgcttgtggagttcatggacagctcttgctaaccattggctataccccattggttatctctctgtgacatgtatatatacaagccgcagtgacagtgttgtgtgatcttctatatttggtttggctgcaaaactgaaggcacacaatgcctccaatatatctatgtatcagttacattggttgcaataaagttacattttcagcctattgcccctatatacttccttgctctctctggcaatcactaattatgacctaagtttcgatgttaaataaaattt

SEQ ID NO: 973 - DNA, 3528 bp, Petroselinum crispum
atccggcaagattatataattctattatatctacggggataaagatataaaaattaatagtatcggataaaataaatttggtgttgtgggctgttttgtcgggtagtatcaatgtatgtaaaataaaatgaaatggcgtagaaggcagcatatataggcctcatcgacttctcacatgcaacaatacaacccgccaaaacccacaattctatatatacacacatgtaccaatacttaattatacatataataaataactattgtatctagatccatccatcctaggactagctttgttgagttgagttgtgctatggaatggttgtcgtggttgtgtagtaactatgttgatgagtttagaggttttgcaaatgaatatttatcaaaatacgagcctcttgttttggtcatctttcctgttttatctcttgttttagctttgtttcttcactctttgcttggtgttatcagtgataaaggactcaaacctactctcctagggttttttatgtcatttctcaaattggttcctggtgtgcaaaagtatatcgatggggagaaacaaaaggttgtggataagttacagtcttctgataaagcaaaaagggatggttgggcaagtgagttgcctaagtcaggtttaggatttggagtaatagacagattaaaagaacagaagaccaatgatgtggcttggcaaggcaaatgctccggcacagtctatatttcaggcacggagtctgaaggacatttttccttgataaacgaggcatgtgcaatgtttgctcataccaaccctttgcatctggatgtcttccaaagtgttgtgcgctgtgagtctgaagtggttgctatgacagcggcattactaggaagtaaggaaaaatgttctggaggacaaatatgtggtaacatgacctctggtggaactgaaagtatattaatggcagtaaagtcatcacgtgattatatgaaagccaagaagggaattacaagaccagaaatgattattccggtgtctgcccattctgcttatgacaaggctgctcaatatttcaatatcaaattgtggcgtgttcctgtaaataaagaattccaagcggattcccgagctatcaagcggtttatcaacaaaaacactatactgattgttggatcggcccctggttttccacatggcatcatcgatcctattgaggagctcggtgaattggcctctaaatatggaatttgtttgcatgttgacctatgccttggtggttttgtgttgccatttgctcgtaaacttgggtatccaattccaccttttgatttttctgttaaaggagttacttcaatatcggcggacgtgcacaaatatgggttggctccgaaggggacaagtgtagttctatatagaaaccatgaaatccgaaagtgccaatttgttgctgttactgagtggacgggtggactttatgtgtctccaaccatggctggtagcaggcctggcggtctaattgctggagcttgggctgccttaatgtctctagggatggaagggtatctagagcacacaagagagatcatggaagcttcaaagagactgcagaaaggattgaaagaaatctcagagttatatattattgggaggccagacatgacagtagtagcatttggatctcacaatctggacatatttgaagtcaatgatattatgtcatccaagggctggcacctcaatgccttgcaaagacctaacagcatacatatctgcatcacccttcaacatgtggcggtcattgacagcttcctaaaggatttgagagattctgtacaaactgtgaaagaaaatcctggtccagtcagtggggggcttgctccgatatatggtgctgcaggaaagatgccagatagaggcatggttggggacttgctagtggattttatggacagctcgtgctgatggaaaccccttgatttattgatcatctatcttatcttatttgtttgttaaaatcattctttgggaagggacacaaaaagtctgttttataaacacatgtgtattacccaaatatgggttgggatttactggagaactcatggctagcttattgtatttgtgttacagtccaagttcccatgtttcacttgactgttatgtgtgtaccttttctggatggaaattggtaatatactagatattgtggctcaataatatgttcagtctatgaaggtagttggtggtccgtggtcgagatgtatttaaggcttttgttcctaatttatgtgtattttgatattggcttaagtgatcatataagggttggacatcgccagctgttgaatcagcatcagagttacagctgtaactggttactaaccgatgcttgcatgtactgaggtttgtcagtcagttgcttcataaaaaacagaggctgtttgttgaatggaagagaaagtatgaaaggaagcagtggatctatcgattcgcttacaacaaatcttcagacttcaactgccaggcgacagtgttaaacaggcaagttaatcatctaatatttaaagtatcgtgaagtgtgtgtgtaaacattatagtgttttaacagtattacatctcaaattctgtgtttaaatcaatggaaatcatcgtggttatctgagtaggcacatataatggatatggcatgaatattgtgtcaggttgatttcaagaagttagaagtatgtttaaatttggtcatgtaagctgaaagtaaaggatggtcaaacactcatatattacaatcatcacaatctcaaataagtaacatttttaattttacatgaggaaacctcttttattcttatgattgttccaagctcaaataacactactgttatcccaaaagttgagatcaggagtgtcttacatgcagtaatacctttctaaatgtccaattccaacaaatttcgttctcatcttcagctccctcttttgccttttacagctccaacactaagtctggaataagatgaatacttaacaagttaatttgattgcaacgaacctaaaaacattaactgtatctaaattgtaagtcagctgtaagattgagaagtgaataaaactaaggtatgcttgttgtctaattgtattaatctaagaacacagctacaatctattcacatgttcatgctgaccactacagtgactatgaattgttatgttatgctcttctattgtattgcgtatgattgatggacttagctagaaactttgaatagtgaacatgatgtaagaacatctgagatataaaattaagttattgttacttgtcaggaaaatattataaagtgttagatgatatattaattttacttgtatagaatttgaatgttgtcattcaggtctcatacattattgtcggttttagcaaatataaggagataaagacactcccacaatggtggtatctacactagaggtatgtacactagagtgatgaatctttcatcctcttctgttcaaccttgacacaaggactcctgtcaattcacacacac

SEQ ID NO: 974 - DNA, 2074 bp, Vitis vinifera
gctcaacgaacgcagccccgccaaaacaaatagaagcatcgtctcacgccattgaacaaagctcagcatctctctctacgtcttcaatggaatcttctttcttctctcacatgagagctgctgcgaactcattcttatccgagtacgagcctctgaatctgcttctcgctcctcttctcgctctcctcatcgctcgcatacttcaatgcttcgttggcgtcgtcaatgagaaaggactcaaggccacgattctagggtttctcatcacctccgtcaagttggttcctggtgtgaagaggtacatcgatgccgagaagcaaaaggttgttgataagttgcaatctggtagtaaatctaaaagagatggttggagtacagagttgccaaggacaggattgggagaaggagtcatagagaaaatgaaagaagagaaaagaaatgatgtggtttggcaaggcaaatgctccggtacagtttacattggaggaagtgaatcagaaggacatttttctttgataaatgaggcgtgttccatgtttgcacatacgaacccattgcatatggatgtattccaaagtgtagttcgatttgaggtggaagttgtggccatgacggctgcattacttggcagtaaagaaaaggcttctgggggacagatttgtggaaacatgacttccggaggaactgaaagtatattattagctgtgaaaacatcacgtgactatatgaaagcaaagaggggaatcacaaggccagaaatgataatacctgaatctgcacactcagcatatgacaaggcggcacaatattttaacatcaaacttttgcgtgttcctgtaaataaagaatttcaagcagatgtcaaagggattagacggcgtattaacaaaaacaccattttgatagttggctctgcacctgggttcccacatggcatcatcgaccctattgaggagcttggtgaattggcttctagttttggaatttgttttcatgttgatctttgtcttggaggctttgtattgcctttcgctcgtaaacttgggtacccaattccaccttttgatttttctgtggaaggagtgacctctatatcagtcgatgtgcacaaatatgggctggctcccaaaggaacaagtgtagttttatatagaaatcatgacatcagaaagcatcaatttgttgctgttactgaatggtcgggtgggctttacgtttctccaaccatagctggaagcaggcctggtgctttgattgctggggcttgggcagcaatgatttctttaggacaagaaggatatttgaataacacaagagagaccatggaagtatcaaaaaaattacagagaggaataaaggatattcccgagttatttgtcattggaaggccagacatgacaattgtggcatttggatctaatgtcgtagacatattcgaagtcaatgacatattgtcatccaaaggctggcatttgaatgcattgcagagacccaacagcattcacatctgtctgacccttcaacatgttaccatccttgaggacttcctcaaggatctgaaggaatctgtccaaactgtaaaacaaaacccaggtccaatcaacggaggacttgctccgatatatggtgcagcagggaagatgcccgacaggggaatggttggggagttgctggtaaatttcatggacggtacatgctagtggcattagcattcactgtactccacaactggtggtaatttcaatcaatttgtgctgttgagagtcactgtactctctggatgtggttctgtttgtttcccgtgattctgttgtaaaagaactcttatcaactcataaaataaatgaaccacccctatttgattttcttcaactattgcatgatgcccagctccctaatgttaatttttgactgttgcttgatatttcctctgaatttctttaaggatttaaagcagcttcaacggaaatttattattattatttttttgggaggtctgaaagggcatttataatgctcctcttttgaactgcctgtagtgttactcaaaggatgaagatatccacaatattaa

SEQ ID NO: 975 - DNA, 1862 bp, Fagus grandifolia
cactcactcaaagcaaccccgccaaaaataaagtcaatacttgcacgccaaaaacaaataaacaatcaaagctcaataaatttctctctctctctctctctcttcttcatcgccggcaatggattcttctttgaagtcattcctgattgatttcagagcttccgcgaattcattcttatcggaatacgagcctctggctctactcctcgctcctctcctcgccttcctcctcgctcgcacgcttcaatcctttctcgctgttcttcaccaacgaggtctcaaagctaccgtcttagggttcttcatcaccctcatcaagttggttcctggtgtcaagaattacatcgatgccgagaaacagaaggttgtggataagttacagtcgggtggtaaatcgaagcgagtggattggaggacggagttgccgagggcagggttaagagatggagtgatagagaaaatgaaagatgagaaaagaaggatgtggattggcaaggaaaatgctctggtacagtctacattggagggagtgaaactgaagggcatttttctctgattaatgaggcatgttcaatgtttgcacataccaatccattgcatttggatgtattccagagtgtagtacggtttgaagcagaagtggttgcaatgacagctgcactactaggcagtaaagaaaagggttcaggaggacaaatatgtggaaacatgacatcaggtggaactgaaagcatattattagctgtaaaatcatcacgtgactacatgaaaaccaagaaggggattacaaaacctgaaatggtaatagctgaatctgcacactcagcatatgacaaggctgcgcaatattttaacatcaagctgtggcgtgtccctgtaaataaagaatttcaagcagatgtcaaagcaattaggcgacatattaacagaaacaccattttgatcgttggatctgcacctgggtttccccatggcatcatcgaccctattgaggagcttggtgaattggcttctaacttcggaatttgtctccatgttgacctttgtcttggtggctttgtactaccttttgctcgtaaacttgggtacccaattccaccttttgatttttctgttaaaggagtgacctcagtatcagtggatgtgcataaatatgggttggctcccaaaggaacgagtgtagttctgtatagaaatcatgatatcagaaagcaccaatttgttgctgttactgagtggtcaggagggttgtatgtatctcccacgattgctgggagcaggcctggcggtttgattgctggggcttgggcagcaatgatgtctttgggggaagaagggtacttggagaactcaaaaaagatcatggaagtatcaaagaggatgcagaaagggatagaggaaattcctgagttgtttattattggaaggccagatatgacgattgtggcatttggatctaatgttgtggatatatttgaagttaatgatgtcatgtcatccaaaggctggcatttgaatgcactgcaaagacccaacagcattcacatctgtctgactcttcaacatgtaccaattgttgaggaattcctcatggatttgacggaatctgtgaagactgtaaaagaaaacccgggtccaataagtggagggctagctcccatatatggtgctgcagggagaatgccagatagagtcatggtccaggacttgttggttaattatatggacggtacatgctagtggccttccctatacggctataccttggttcggttctgattgtttttctatgttttgatttctacaagaattctttggccatttgtgaaataaaagataatgataataatcgtattaacttt

SEQ ID NO: 976 - DNA, 1962 bp, Ricinus communis
gaacaacttttaatgtaactttatattattctgattcttatcgtaaaatttttatatctaaaagcgactttgaggcagcttttaattctttgaattcttcagtagcaatggaaatggattcggtgaaggaactgttgattcaatttagagttactgctaattcattcttatctgaatatgaacctctagctcttgttctcgctcctctcctaactcttctcctagctcgaattctccactctctgtttcgcgttttctacgaaaatggactcaaatccactctttttgggtttctcatggcctctatcaagttggtgcctggagttaagagctacatcgatgctgagaagcagaaggttgtagataagttgcagtctggtagtaaatctaaacgagagggctggagggtcgagttgccaatggaaggcttaggaacagaaataattgagaaaatgaaggaagagaagagaaatgatgcagtttggcaaggaaaatgttctggtacagtctacattggagggagtgaatctgaaggacatttttctattataaatgaggcatgttcaatgtttgcacacaccaacccattgcatctcgatgtattccagagcatagcgcgatttgaggcagaagtagttgcaatgacagcgtcactgcttggtagcaaagaaaaggcttctggaggagaaatatgcggaaacatgacatctggaggaactgaaagtatattgttggctgtgaaatcatcccgagattatatgaaggttaagaagggaattacgagacctgaaatgattataccggaatcagcacactcagcatatgataaggcagcgcaatactttaacattaagttgtggcgtgttccagtaaataaagaatttcaagcagatgccaaagcaatcagacggcacattaacaggaataccgttttgattgttggatctgcaccagggtttcctcatggcatcattgaccctattgaggagctgggtgaattggcttttcgatatggaatatgtttccatgttgacctgtgtcttggtggttttgtattaccttttgctcgtaagcttgggtatccaatgccgccttttgatttttctgttaaaggagtaacctcaatatcagtagatgtgcataaatatggactggctcctaaaggaacgagtgtagttctgtacagaaatcatgatattagaaagcatcaatttgttgctgtcacggaatggtcaggtgggctctatgtgtctcctaccattgctggaagtaggccaggtggtctaatagctggggcttgggcagcaatgatgtcacttggactagaagggtacttgaagaacacaaaagtgatcatggaagtgacgaaaaaaatacagaaaggaatagaggagatgcctgagttatttgtaattggaaggccagatatgacaattgtggcgttcggatcaaacgtgctagacatatttgaggtcaatgatattttgtcatcaaagggctggcatttaaacgcattgcagagacctaacagccttcatatatgcgttactctgcaacatgcatcggtttacgaggacttccttcaggatttgagagaatctgtgcaaactgtaaaacaaaatccaggtcccataaatggaggcctggctccaatttatggtgctgcagggaagataccagatagaagcatggttcaggagttgttagtaaattacatggacagtacatgctagtgtcatcttctgtccttcggaatctttcttttttcttttttttttgctccattaattgctttcaatttgatctgtatcagaacgtttgttgaatagttggatgactaaacatcttgtttctattcatttatcacatatttaagcactcgataaataaaaacattgaataaaagctaaaggctcattgtgccggaattccattgaaacggtggaagtaatttatctatat

SEQ ID NO: 977 - DNA, 1298 bp, Euphorbia peplus
tgctctgccacagtctatatagggggaagtgaatctgaaggacatttttctttgataaatgaggcatgttcaatgtttgcacataccaatccattgcatcttgatgtattccaaagtgtagcaagatttgaagcagaagtggttgcaatgacagcttccctacttggtagtaaagaaaaggcttctggaggagaagtatgtggaaacatgacatctggaggaactgaaagtatattgttggctgtaaaatcatctcgtgactatatgaaggctaaaaaaggaataaccactcctgaaatgatcatacctgaatctgcacattcagcttatgataaggcagctcaatactttaacatcaagttatggcgtgttccggtaaataaagactttcaagcagatgtgaaagcaatcagacggcacattaacaggaatacaattttgattgttggatctgcacctgggtttccccatggaattattgatcctattgaggagcttggtgagttggcttttcaatatggaatatgtctacatgttgacctctgtcttggtggttttgtattaccttttgctagtaagcttggctatccgataccaccctttgatttttctgttaaaggagtaacctcaatttcggtagatgtgcataaatatgggttggctcctaaaggaacaagtatagttctatacagaaatcatgatattagaaagcatcaatttgttgctgtcactgagtggtctggtgggctctatgtatctccgaccattgctggaagcaggcctggaggtttaatagccggggcttgggcggctatgatgtctctgggagaagaaggttacttggagaacacaaaagcaataatggaagtatccaagaaactacagaaaggaatgatggagctgcctgagttgttcattgttggaaagccggatatgacaattgtggcatttggatcaaatgttgtggacatatttgaggtcaacgatattatgtcctcaaaaggctggcatttgaatgcattgcaaagacccaacagccttcatatatgcattactctgcaacatgtatcggttattgacgacttcgtacaagatttacgagaagctgtgcaaactgtgaagaaaaatccaggtccaataaatggaggaatggctccaatttatggtgctgcagggaaaataccagacagaggtatggtttcagagttgttggtaaattacatggatagtacatgttagtgtgcatttattcacactatttcacatctttaatgtgtatccaaaaatatttggtaatc

SEQ ID NO: 978 - DNA, 1684 bp, Triphysaria pusilla
cgcttgttttcgcacgaattgttcagtcagtatttcgcgtggtttccgagaaaggactaaaatctgtgattctggatttcatcatgacctccgtcaagttagtccctggtgtgcagaaatatatcgacgccgaaaagcaaaaggttgtggataagttacaagggtctggtaaatcaaaaagagatggttggaggactgagttaccaagagaaggtttgggagatgatgtcatcaataaaatgaaagatgataaacaaaaggatggggcatggcaggggaagtgttctggtaccgtctacattgcaggaaacgaagaagaagggcacttttctttgattaatgaggcatgctcaatgtttgcacatacaaatcctctgcatttagatgtgttcccgagcgtcgtaagatttgaatccgaagttgtggcaatgactgccgccttacttggaagtaaggaaaaggcttctggaggacagatatgtgggaacatgacgtctggagggacagagagtatattgttagcagtgaaaacatcacgcgactatatgaaagttaagaaggggataactagtccagaaatgatcatacccatttcagctcattcggcttatgacaaggcttcacagtatttcaaaatcaaattgtggcgtgttcctgtgggccaggactttcgggctgatgtcaaagcgatcaaacggcatattaacaggaacacaatattgattgttggatcagcacctgggttccctcacggaataatcgacccgattgaggaacttggtgagttagcttcgagttacggggtttgtctgcatgttgacctttgccttggtggatttgtattgccttttgctcgtaagcttgggtaccctataccaccatttgatttcactgtgaagggagtaacatctatatctgtggatgtacacaagtatgggctggcacctaaaggaacaagtgtggttttatatagggatcatgacatacggaagcatcaatttgttgccgtcactgaatggactggtgggctttatgtgtctccttcgattgctggaagcaggcctggaggccttattgctggggcttgggcagcgatgatgtctcttgggctagaaggctatctagagaacacgaggaagattatggaaacttcaaagagaatcgagaaaggagtccgggagattccagaattgttcattgttggaaggcccgatatgacgattgtggcttttggatctgaaattttggacattttcgaagtgaatgaccttatgtcatcgaaaggatggcatttgaatgcactacagaggcccaatagcattcatatctgcgtgacactccaacatgtaactgttgctgaagaatttctgaaggatttgagtgattctgtgcaaactgttaaagcaaatccaggtccaatcaatggagggcttgctccaatatacggtgctgctggaaaaatgccggatagagctatggttcaagatttgttggtcgatttcatggatggctcatgctgatccttattgtaatatttatgaagcttgtgttctccttttatttttttcttgtttatcaattgtggattctttacaatttacatacaagtgaatattcattttgtcattttaaaattggcacttggtgataaataataattaagattgcttgttcaaaaaaaaaa

SEQ ID NO: 979 - DNA, 1773 bp, Manihot esculenta
gagcttcttcgaatccacagtaatggacatggatatggcttctctctactcattattcaatgagtttagagcttctgctaattccttcttatcggaatacgaacctcttgttctgcttattgttcctctctttactctcattcttgcacggattctccgctcgtttcttcgcgtcctttatgaaaatggtctcagagccaccattattgggtttctcatgacctgcatcaagatggtgccttgggtgaagagttacatcgatgcggagaagcagaaggttgttgataagatgcagtctggtggtaaatctaaacgagaaagctggaggtctgagttgccaagagaaggcttaggagctggggtcttagaaaaaatgaaggaagagaaaaggaatgacattgcttggcgaggaaaatgctctggtacagtctacattggaggaactgaatctgaaggacatttttctttgataaatgaggcatgttcaatgttttcacataccaatccattgcatttcgatatattccagagtgttgcacgatttgaagcagaagttgttgcgatgactgcttcactacttggcagtaaagaaaaagcttctggaggagaagtatgtggaaacatgacatcaggaggaactgaaagtatattattggctgtcaaatcatctcgtgactatatgaagggaaagaagggaattacaagacctgaaatgatcatacctgaatctgcacactcagcatatgacaaggcagcacaatacttcaacataaagttgtggcgtgttccagtgaatgaggaatttcaagcaaatgtcaaagcaataagacgacatattaacaaaaataccattttgattgttggatctgcaccggggtttcctcatggcatcattgatcctgttgaggagcttggagaattggctttacagtatggaatatgtctccatgttgacctctgtcttggtggttttgtgttacctttcgctcgtcaacttggatatccaatatcaccttttgatttttccgttaagggagtaacctcaatatcagtggatgtgcataaatatgggctggctcctaaaggaacaagtgtaattctatacagaaatcatgatattaggaagcatcaatttgttgctgtcaccgagtggtcaggtgggctatatgtgtctcctaccattgctggtagcaggcctgggggtttaatagctggtgcttgggctgcaatgatgtcactaggacaagaagggttcttggagaacactaaggcaataatgaaagcatccaaaaaaattcagaaaggcataaaggagatacctgagttatttatcattgggaagccagatatgacaatcgtggcatttggatcaaatgttctagacatatttgaagtcaatgatataatgtcatcaaaaggctggcacttaaatgcgttgcagagacccaacagcctgcacatatgtgttactcttcaacatgtatcggtttgtgaggactttcttcaggatttgagagaatctgtgcaaactgtgaaagaaaatccaggtcctataagtggaggcctagctccaatttatggtgcagcagggaggattccagatagagtaatggtcaaggagttgttggtaaattacatggacagtacatgctagaggaattccctctcctatggcttcaattgttacctatattgctttccgttcttttgatttgttgtatcaggcattcaaaacattttgactatgaatgaaataaacctagacttgtttat

SEQ ID NO: 980 - DNA, 1870 bp, Castanea mollissima
tcataatctccctcaactctcaatacactattatatcatatcaaagacagtatcatacatatcctttctttctttcttgttgttcatcattggctatggattcttcttctttgaaatcatttctgattagtttcagagcttccgcgaattcattcttatcccaatacgagcctctggcactgctcctcgctcctctcctcgccttcttcctcgctcgcacgcttcattcgtttctcactcttcttcaccaacgaggcctcaaggccaccttatttggcttcttcatgaccctcatcaaattggttcctggtgtcaagaattacatcgatgccgagaaacagaaggttgtggataagttacagtctggtggtaaatcgaagcgagaggcctggaggacggagttgccaggggcagggttaggagttggagtcatagagaaaatgaaagatttgaaaagaaacgacgtggcttggcaaggaaaatgttctggtacagtgtacattggaggaaatgaatctgaagggcatttttctgtgattaatgaggcatgttcaatgtttgcacataccaatccattgcatttggatgtattccagagtgtggttcgatttgaagcagaagtggttgcaatgacagctgcactacttggcagtcaagagaagggttcaggaggacaaatatgtggaaacatgacatcaggtggaacagaaagcatactattagctgtgaaatcatcacgggactacatgaaaactaagaagggaattacaaaacccgaaatgataatacctgaatctgcacactcagcatatgacaaggctgcacaatattttaacatcaagctgtggcgtgtccctgtgaataaagaatttcaagcagatgtcaaagctattaggcgatgtattaacagaaacaccattttgattgttggatctgcgcctgggtttcctcatggcatcattgaccctattgaggatcttggtgaattagctactagcttcagaatttgtctccatgtcgacctttgtcttggtggctttgtactaccttttgcttgtaaacttgggtacccaatcccaccttttgattttactgttaaaggagtgacctcaatatcagtggatgtgcataaatatgggttggctcccaaaggaacaagtgtagtgctgtataaaaatcgtgatatcagaaagcaccaatttgttgctgttactgagtggtcaggagggttgtatgtatctcccacgattgctgggagcaggcctggtggtttgattgctggggcctgggcagcaatgatgtctttgggggaagaagggtacttggagaacacgaaaaagatcatggaagtatcaaagaggctacaaaaggggatagaggaaattcctgagttgtttattattggaaggccagacatgacaattgtggcgtttggatctaatgttgtggatatatttgaagttaatgattcaatgtcatccaaaggttggcatttgaatgcactgcaaagacccaacagcattcacatctgtctgactcttcaacatgtaccaattgttgaggaattcctaagggatttgatggaatctgtgaagactgtaaaagaaaatccgggtccaataagcggagggttagctcctgtatatggcgctgcagggaaaatgccagatagaggcatgatccaggaattgttggttaattatatggacggtacatgctagtagccttccctgggattggttctgtttatttctttaagttttgatttgtacaagaattatttggctaaattgtaaaataaaagataatgataataatagtttaaactttctccaatttatccaaaaaataataataattgtacaaactt

SEQ ID NO: 981 - DNA, 1988 bp, Gossypium raimondii
ccaacattataaaccctttcacatttcctctcttcttcctaaatttttcaggagaaaacaaagatggattcttattcttcttggttgaattctttcttagttcgcttcagactttctgccaatctcttcctttcacaattcgaacctttggctctgcttctcgcccctctgctcactctctttatcgcccgtctacttcactcgctcctttccgttattcacgagaaaggcctcaaagctacggtcttagtcttgttcatgagttccatcaagttggttcctggtgttcagagttatattgatgcagagaagcaaaaggttgtggataagctacaatctggtagcaaatccaaaagagaacactggaggacagagttgccaaccacaggtttaggagtgggtgttatagaggaaatgaaagatgtaaagagcaatgatgctgattggaaaggaaaatgctccggtacagtctacattggtggaagtgaatctgaaggacatttttctttgatcaatgaggcaagctcgatgtttgcacataccaacccattacatttagatgtgtttcagagtgtggcgcgatttgaggctgaagtggttgctatgacagcagatctacttggcagtaaagagaaggcttctggaggacaagtttgtggaaacatgacatcaggaggaactgagagcatattattagcagtgaaaacatctcgggattacatgaaggcgaagaagggaattacaaggccagaaatgataatagctgaatctgcacattcagcatatgacaaggcagcacaatattttaacatcaaactccgtcgcgtccctgtcaataaagaatttaaagcagatgttaaagcaatcagaaaacaaattaacagaaagacaatcttgattgttggatctgcacctgggtatcctcatggcatcattgaccctattgaggagcttggtaaactggctgatagctatggaatttgtctccatgttgacctttgtcttggtggctttgtgttgccttttgctcgtaaactcgggtacccaattccgccatttgatttcactgttaggggagtaacatcaatttcagcggatgtgcataaatatgggctggctcctaaaggaacgagtgtagttctttacagaaatcatgacattagaaagcatcaatttgtagctgttactgagtggtcgggtgggctttatgtgtctccaaccatagctggaagcaggcctggaggagtaattgctggagcttgggcagcaatgatgtctctgggacaacaaggttacttggagaacacaagaaaaatcatggaagtatcgaagatgattcagaaagggataaaggagattcctgagttgttcatcattgggaacccagacatgacaatcgtggcatttggatctgctgttctggacatatttgaagtcaatgatatcatgtctggcaaaggttggcatttaaatgcattgcagaggcccaacagcattcatatctgtgtcactcttcaacatgtaccagtagttgatgccttcctccaggatttgagggaagctgtacaaactgtgaaagaaaacccagggccgataagcggaggtctagcacccatatacggtgctgcagggaagatgccagatcgaggcatggttcaagatttgttggtaaattacatggatggtacatgctagtgcccaaatagagccgatgaaggttgattttagatccgtaagagtggtgcatcccggaatcaagtacaaagaactagagtttgagtctcggccattcattaccttgccatcccacacctcagttctgatccatttgcttcttcacaatatattggtttgtaatttgtactataagaattatggttaatttaggatggaaataaatgtatttgtttgcttaacatcacttcactgaaaatcaataattactgatttttacttgattaaaaatacatcctggttttattttagta

SEQ ID NO: 982 - DNA, 1925 bp, Quercus alba
atcagacacgcccgggatctcaattatcaataatatacaaactcatcaccatctctctcaactctcaatacacaaataatatcatagacaagagtattcgtacattggctatggattcttcttctttgaaatcatttctgattagtttcagagcttccgcgaactcattcttatcccaatacgagcctctggctctgctcctcgctcctctcctcgccttcttcgtcgcttgcacgcttcattcgtttctcactcttcttcaccaacgaggcctcaaggccaccttagtaggcttcttcatgaccctcatcaagttggttcctggtgtcaagaattacatcgatgccgagaaacagaaggttgtggataagttacagtctggtggtaaatcgaagcgagcggcttggaggacggagttgccaagggcagggttaggagttggagtcatagagaaaatgaaagatgagaaaagaaatgacgtggcttggcaaggaaaatgttctggtacagtgtacattggaggaaatgaatctgaagggcatttttctgtaattaatgaggcatgttcaatgtttgcacataccaatccattgcatttggatgtattccagagtgtagtacgatttgaagcagaagtggttgcaatgacggctgcactacttggcagtcaagagaagggttcaggaggacaaatatgtggaaacatgacatcaggtggaacagaaagcatactattagctgtgaaatcatcacgggactacatgaaaactaagaagggaattacaaaacctgaaatgataattcctgaatctgcacactcagcatatgacaaggctgcacaatattttaacatcaagctgtggcgtgtccctgtgaataaagaatttcaagcagatgtcaaagctattaggcgacgtattaacagaaacaccatttttattgttggatctgcgcctgggtttcctcatggtatcattgaccctattgaggatcttggtgaattagctactagcttcggaatttgtctccatgttgacctttgtcttggtggctttgtactaccttttgctcgtaaacttgggtacccaatcccaccttttgattttactattaaaggagtgacctcaatatcagtggatgtgcataaatacgggttggctcccaaaggaacaagtgtagtgctgtataaaaatcatgatatcagaaagcaccaatttgttgctgttactgagtggtcaggagggttgtacgtatctcccacgattgctgggagcaggcctggtggtttgattgctggggcctgggcagcaatgatgtctttgggggaagaagggtacttggagaacacgaaaaagatcatggaagtatcaaagaggctacaaaaggggatagaggaaattcctgagttgtttattattggaaggccagacatgacgattgtggcatttggatctaatgttgtggatatatttgaagttaatgatacaatgtcatccaaaggctggcatttgaatgcactgcaaagacccaacagcattcacatgtgtctgactcttcaacatgtaccaattgttgaggaattcctaagggatttgacggaatctgtgaagactgtaaaagaaaatccgggtccaataagcggagggctagctcccgtatatggtgctgcagggaaaatgccagatagaggcatgatccaggaattgttggttaattatatggatggtacatgctagtagccttccctgggattggttctgtttgtttctctaagttttgatttgtacaagaattatttggctaaattgtaaaataaaagataatgataataatagtttaaactttctccaatttatccaaaaaataacaataattgtataaactttctccatttgatatctttcactttactatggtattctttc

SEQ ID NO: 983 - DNA, 1653 bp, Olea europaea
tttttctgagtttttctctgggttgcatcgatttcgagcttctgcaaattcgtatttagttcaattcgaacctctggcgctaatgtttcttcctattctgacacttctcgtcgcgcggagttttcaatccatttttcgtgttttttacgagaaaggattcaaagcttcgattctagggttcttctttaccttcgtcaagttggtgcctggtgtgaaaaattacatggaccgcgaaaagcaaaaggttgtgactaatttgcaagcttctggtaaatctaaaagagagggttggaggactgagttgcccaaagcaggattaggagggatggtcattgagaaaatgaaagatgagaaacaaaatgatgcggcatggcagggcaaatgttctggtacagtctacattggaggaaacgaatatgaaggacacttttctttgataaatgaggcatgctcaatgtttgcacataccaatcctttgcatctggatgtattcccgagtgttgtgagatttgaagcagaagttgttgcgatgacggctgcactacttggaagcaaggaaaaggcctccggaggacaaatttgtggaaatatgacatcaggaggaacagaaagtatagtattggctgtgaaagcctcacgtgactatatgaaagctaagaaggggatcactagaccagaaatgataataccagcttccgctcactcagcatatgacaaggctgcccattacttcaatattaaattgtggcgggttcccgtaaacaaagattttcgagctgatgttaaagctattaaacggcatatcaacaggaacaccatactggttgttggatcagcacctggcttcccacatggaatcattgacccaattgaggagcttggtgaattagcaacaacattaaggatatgctttcatgttgatctttgtcttggtggcttcgtattgcctttcgctcggaagcttgggtatcctgtaccaccattcgatttctctgtacaaggagtgacctcaatatctgtggatgtgcacaagtatgggctggcccccaaaggaacaagtgtagttttatacagagatcatgacattcggaagcatcaatttgttgctgtaacggaatggactggtgggctttatgtatcaccaaccattgccggcagcaggcctggaggtctgattgccggtgcttgggcagcaatgatgtctcttggagtagaaggatatctagacaacacaagggtaatcatggaagcctcaaagagaatagaaaagggtgtacgcgagatttctgatttattcgttgttggaaggcctgacatgacaatcgtggcttttggttctgacgttatagacatatttgaagtcaatgacattatgtcatcgaaaggctggcatttaaatgcattgcagagacctaacagtattcacatttgcgttacactgcaacatgtacccgtcattgaggacttcctgaaggatctgaaagattctgtgcaaactgtaaaggcaaatccaggtcccatcagtggagggcttgccccaatatacggtgctgcaggaaaaatacctgatagagttatggttgaagatttgttggtggatttcatggattcttcatattagtggcctctattgtttcttattatttcatgtgt

SEQ ID NO: 984 - DNA, 1897 bp, Aquilegia formosa
aaaactcccttctcttcttttctcatcaacttctctctctctctttttcccgattcagtagttttctttcttcttcatcaatggaagaaatttcttcatttcttattaaaattagaactacaacaaattcatttctatctcaatatgaacctcttcttcttcttattactcctttacttgttcttttctttacttttaatcttcaatctttcttcaactttgttcaagataaaggacttaaacctactcttattggttttttcatgacttcaatcaaatttattcctggtgttaataatcatattgaagctgagaaacaaaaggttgtagacaagttgcaatctgggagcaaatctaaaagagatggttggatgacagagttgccaaaagctggactaggaggaggagtcatagaaaagctgagagacgagaaagggaatgatgttgtttggcaagggaaatgctctggtacagtttatattggaggaagtgaatcagaggggcatttttctgtgatcaatgaggcatatacaatgttttcgcatacgaatccattacatcaagatgtatttcaaagtgtcgtacgatttgaaggtgaggtggttgcaatgacagcagcactgcttggcagtaaagaaaaagcctgtggaggagaaatctgtggcaacatgacatcagggggaactgagagtatattattagctgtgaaatcgtcacgagattatatgaaaacaaagaaggggatcacaaaacctgaaatgattataccagaatccgcacactcagcgtatgacaaggctgcacaatattttaacattaagttatggcgagtacctgtgaacaaagaataccaagcagatgttaaagctatcagaagatttattaacaagaacacaattcttattgttggatctgcaccgggttttccacatggcatcattgatccgattgaagagcttggtgaactggcattgagttttggtgtttgcttgcatgttgacctatgtcttggtggcttcgtgttgccttttgctcgtaagcttgggtatccaattccaccctttgacttttctgttgaaggagtaacatcaatatcagttgatgtgcataagtatggattggctccaaagggaacaagtgtagtgttatatagaaatcatacaattcgaaagaaccagtttgttgccgtcaccgaatggtcaggtggtctttatgtttctccaactatagcagggagcaggcctgggggattaattgccggggcttgggcagccatgatggctgtggggcaagaaggatacttggaaaacactagaaagatcatggaggtatccaagagtttacagagagggataaaggatattcctgagttatttatcattggaaggccagatatgacgattgttgctttcggctctaatgatctcgatatctttgaaatcaacgatcaaatgtcatctagagggtggcatttgaatgctttgcaaagacccaacagcattcatatctgtgtgacccttcagcatgtaccggttgtagaagacttcttgagagacttgagggagtccgtgcaaactgtaaagaagaatccaggtccgattagtggagggcttgctcctatatatggtgctgctgggagaatgcctgatagaggtatggtccaggacttgttggtgaattttatggatagctcctgctagctgatcccataattcgaaaatggtgatcttttcacgttgaaaatggcaaacattcggaaattaatgttgtttcattaatttgaaaactgtattgtatggaggttctctcatgatgagaaacaaacattcagaattctttgtcaattgttgtataggtaataaaactagatgatttgcaaccatttgtgaatttttac

SEQ ID NO: 985 - DNA, 1852 bp, Gossypium hirsutum
caattcgaacctttggctctgcttctcgcccctctgctcactctctttatcgcccgtctacttcactcgctcctttccgttattcacgagaaaggcctcaaagctacggtcttagccttattcatgagttccatcaagttggttcctggtgttcagagttatattgatgcagagaagcaaaaggttgtggataagctacaatctggtagcaaatccaaaagagaacactggaggacagagttgccaaccacaggtttaggagtgggtgttatagaggaaatgaaagatgtaaagagcaatgatgctgattggaaaggaaaatgctccggtacagtctacattggtggaagtgaatctgaaggacatttttctttgatcaatgaggcaagctcgatgtttgcacataccaacccattacatttagatgtgtttcagagtgtggcgcgatttgaggctgaagtggttgctatgacagcagatctacttggcagtaaagagaaggcttctggaggacaagtttgtggaaacatgacatcaggaggaactgagagcatattattagcagtgaaaacatctcgggattacatgaaggcgaagaagggaattacaaggccagaaatgataatagctgaatctgcacattcagcatatgacaaggcagcacaatattttaacatcaaactccgtcgcgtccctgtcaataaagaatttaaagcagatgttaaagcaatcagaaaacaaattaacagaaagacaatcttgattgttggatctgcacctgggtatcctcatggcatcattgaccctattgaggagcttggtaaactggctgatagctatggaatttgtctccatgttgacctttgtcttggtggctttgtgttgccttttgctcgtaaactcgggtacccaattccgccatttgatttcactgttaggggagtaacatcaatttcagcggatgtgcataaatatgggctggctcctaaaggaacgagtgtagttctttacagaaatcatgacattagaaagcatcaatttgtagctgttactgagtggtcgggtgggctttatgtgtctccaaccatagctggaagcaggcctggaggagtaattgctggagcttgggcagcaatgatgtctctgggacaacaaggttacttggagaacacaagaaaaatcatggaagtatcgaagatgattcagaaagggataaaggagattcctgagttgttcatcattgggaacccagacatgacaatcgtggcatttggatctgctgttctggacatatttgaagtcaatgatatcatgtctggcaaaggttggcatttaaatgcattgcagaggcccaacagcattcatatctgtgtcactcttcaacatgtaccagtagttgatgccttcctccaggatttgagggaagccgtacaaactgtgaaagaaaacccagggccgataagcggaggtctagcacccatatacggtgcagcagggaggatgccagatcgcggcatggttcaagatttgttggtaaattacatggatggtacatgctagtgcccaaatagagccgatgaaggttgattttagatccgtaagagtggtgcatcccggaatcaagtacaaagaactagagtttgagtctcggccattcattaccttgccatcccacacctcagttctgatccatttgcttcttcacaatatattggtttgtaatttgtactataagaattatggttaatttaggatggaaataaatgtatttgtttgcttaacatcagttcactgaaaatcaataattactgattcttacttgattaaaaatacatactggttttattttagt

SEQ ID NO: 986 - DNA, 1767 bp, Nicotiana benthamiana
agtaaaacattgctctcaaccaacgaaccaaaaaaaaggcagggattgcaaaaaataaaaaaataaaaaataaaaacctgtttcacagtctcgttcacatcgttcggcgatggagtttccagatccgccatggctgaatcagttccgagcttccacgaattcctttttatctcaatacgagccgttaactctactcctttctcctctctttggtcttctattggctcaaattcttcaatcctttttccttgttattcacgaacgaggcctcaaagccaccattattagttttgtcatgagctctgtcaagttggtgcctggtgttagtaaatacattgatgctgagaagcagaagatagtggataaattgcaagcttccggtaatagagatggatggaagactgagttaccaagatcaggtttaggaaacaaagccctagagcaaatgaaagatgagaaacaaaaagatgtgacctggcagggcaaatgttcgggtaccgtctatattggcggaaatgagcacgagggacatttttcattaataaacgaggcatgttccatgtttgcccatacaaatccactgcatctgagtgtgtttccaagcgttgttagatttgaagcagaagtggttgcaatgacagctgcacttcttggcagtaaggaaaagacatctggaggacagatttgtggaaatatgacatcaggaggcactgagagtatactattagcagtgaaatcatcacgtgactatatgaaagccaagaatggaatcactaaaccagaaatgataataccagtttctgcgcactcagcatacgacaaagctgcacaatatttcaagatcaagttgtggcgtgttcctgttgataaagagtttcgagcagatgttaaagctgttaatcggcacattaacaaaaacactatcatgattgttggatcagcacctggctttccccatggcataattgatccaattgaggcaacttggtgatttggcttctagctatggagtttgtctccatgttgacctttgtcttggaggctttgtcttaccatttgctcgtaaactgggataccccgtacctccatttgatttcactgttcaaggagtaacttcaatctcagtggatgtacacaagtatgggctggctccaaaaggaaccagtgtagttctgtacagaaatcatgagatacggaagcatcaatttgttgctgtcactgagtggactggtgggctttatgtttctccaacaattgctggaagcaggcctggaggtttgatagccggggcatgggcagcaatgatatctttaggctttgaaggatacttggaaaacaccaaggagatcatggaggcatcaaaaagtattcagaaagggatacaggacattccagaacttttcatgattggaaggcctgatatgagcattattgcttttggatctgacattgtagatatatttgaagtcaatgatgtaatgtcatcaaaaggctggcatttaaatgcattgcagagacctaacagtgttcatatttgcgtgacacttcaacatgtaccagtagtccagatttttctgaaggatctgagagattccgtgcagactgtgaaagaaaatccaggtccagttaatggaggatttgctccaatctacggtgccgcggggaagatgccagataggggtatggttcaagatctgttgatcgagtttatggacagttcatgctagtcatttgactcatttctcatctttggtgcatattctttgc

SEQ ID NO: 987 - DNA, 1949 bp, Cajanus cajan
tccttcttctccattactctatctttgttccaatggattcttcttcgatctctcagttccgcgccaccgcgaattcctttctctcccaatacgagcctctcgctctgcttctcgctcctctcctctctctcctcctcgcccactctctccgctccttcttcctcctcctccgtgacaacgctctcaaacccacgctcctagggtttctcattagctccgcaaaattagtccctggcgtgaagggatatatagaggccgaaaaacggaaggttgtggataagatgcaatctgatggtaaatctaaaagagaaggttggaaaaccgagttaccaagcacaggattagggacatctgtccttgagaaaatgacagaggagaaaataaatgatgcggcttggcaaggcaaatgctctggtacagtctacattggaggaagtgaatctgatggacatttttctctgataaacgaggcatgttcaatgtttgcccataccaatcctctacatttggatgtattcaagagtgttgcacgctttgaggcagaagtggttgcaatgacagcggcacttcttggaagtaaggaaaagagttctggaggacaaatatgtggcaacatgacatcaggcgggactgaaagtatattattagctgtcaaatcatctcgtgactatatgaaatctaagaaaggaattacaagacctgaaatgataattccggaatctggacactcagcatatgacaaggctgcacagtattttaacatcaaactatggcgagtaccagttaacaagagttttcaagcggatgtgaaagctatacgacgtcatattaacaaaaatacaatcttgattgttggatctgctcctgggtttcctcatggaataattgaccccattgaagaacttggtcatctcgcatcaagctttggtatttgcttccatgtggacctttgccttggtggctttgtattaccttttgctcgtgagctcgggtacaacatcccacctttcgatttttcggttaaaggggtttcttcaatatcagtggatgtgcataaatatggtttagcccccaaaggaacaagtgtagttctttatagaaaccatgaaatcagaaagcatcaatttgttgctgttactgagtggtctggtgggttgtatgtgtctccaaccatagccggcagcaggcctggaagtcttattgctggtgcgtgggcagcaatgatatctctgggaaaagaaggttacttgaaaaatacaaaagcaatcatggaagggtcaggaagaatacagaaaggcatagaggagattactgagttgtatattgttggaagacctgacatgacaatcgtggcttttggatcagatgttctggatatatttgaagtcaatgatattatgtcatccaaggggtggcatttgaatgcattacagagacccaacagtctccatatctgcgtgacactgcaacacgtgccaattgttgaagactttttgaaggatttgaaggaatctgtgaaaattgtgaaagaaaatccaggtccaataagtggagggctagcacctatatatggcgccgcagggaagatgccagatagaggcatggtccaggaattgctggtagattatatggatggcacctgctaatggcgttcgacatttgtaccagattcttctggcaaaatgtactctagtggaccttcacttaataatatcctattttattgtgcattctttcatatttaaagactgaattgaaaaaaataaatgtatcattgtacatgaattgaaagaagagcacacgtcattttgagcattatcaacggcgaagttcgttactatttcggctgattgaccatagtggagctcttttaatttttttttaccaaaatgggactattttgtaacaaattatacctttagggtaatttttaacggtatcgttatggt

SEQ ID NO: 988 - DNA, 1721 bp, Malus domestica
gttttcttgggctgctgcaacttgtcggagtattcagccatggattctgcttctgtgaaaacgttcctgctcgatgttagagcttctgcgaattcgttgttgtcgcagtacgagcctctggttctggtttctgctcctctctttgctctcctggtcgcttccacgcttcaatcggctatccatggcctgcaggagaagggactcaaagccacactcctagggttcttcatgagcttcatcaagttggttcctggcgtcaagagttacatcgacgctgagaagcaaaaggttgtggataagttacagtctggtggtaaatctggaagagaaagttggagaactgaattgcctagctcggggttgggagtgggagtcatagagaaaatgaaagatgagaaaagtaaagatgtggcttggcaaggaaaatgctcgggtgcagtttacattgggggaagcgaggttgaaggacatttttctgtaattaatgaggcatgctcagtgtttgcacataccaatccattgcatatggatgtcttcaaaagtgtggtacggtttgaatcggaagttgttgcaatgactgctgcactgcttggaagtaaaaagaagtcttctggaggacaaatatgtggaaacatgacatccggaggaactgaaagtatattattagctgtgaaatcatcacgagattatatgaaaaccaggaaggggattaagaaacctgaaatgataatacctgaatctgctcactctgcatatgacaaggctgcacaatattttaacatcaagctctggcgtgtccctgtaaataaagaatttcaagcagatgtcaaagcaattagaagacacattaataagaacaccgttttgattgtgggatctgcacctggttttcctcatggcattgttgatcctattgaggagcttggtcaattggcttctagctttgacatctgtctgcatgttgacctttgtcttggcggcttcgtattaccttttgctaataagctcgggtatccaattccaccctttgatttttcagtgaaaggagtgacttcaatatcagcagatgtacataaatatgggctggctcctaaaggaactagcacagttctgtacagaaaccatgacatcagaaagcatcaatttgttgctgttaccgagtggtccggagggctatacgtgtctccaaccatagccggaagcaggcctggtggcttgattgctggggcatgggcagctatgatgtctttaggggaggaagggtacttggaaaacacaaaaaacatcatggaagcatcaaaaagacttcagaaaggaatagaggaaattccggagctgtttatcattggaaagccagacatgacagttgtagcatggggatctaatgttgttgacatatttgaagtcaatgatatcatgtcatctaaaggctggcatttgaatgcattgcaaagacccaacagtattcatatctgcgtgacgcttcaacatgtacccgtcattgatgactttctcagggatctaaggggatccgtgaaaactgtcaaagaaaatccaggaccgataagcggagggctagctcccatttatggtgctgcagggaggatgccggacagaggtatggttcaggagttgctggtaaattacatggacggtacatgctagtgatgctctctgtccacattgtttctcatgcttcatgttttgtgccagaattcttt

SEQ ID NO: 989 - DNA, 1891 bp, Cicer arietinum
aggttgtggataagatgcagtctgatggtaaatctaaaagagaaggttggaatacagagttgccaaacgcagggttggggacatctgcccttgagaaaatgagagaggagaaaagaaatgacgcagtttggcaaggcaaatgctcgggtacagtctacattggaggaagtgaatctggtgaacatttttctttgattaatgaggcatgctcaatgtttgcacataccaatcccttgcatttggatgtattccggagtgttgtacgctttgagggagaagtggttgcaatgacagcggcacttcttggaagtaaagaaaagacatctggaggacaaatatgtggcaacatgacatcaggagggactgaaagtatattattagctgttaaatcatctcgcgactatatgaaatccaagaaaggaattacaagacccgaaatgataattcctgaatctggtcattcagcatatgacaaagctgcacagtattttaacatcaaactatggcgtgttccagttaacaagaattttcaagcagatgtgaaagcaattagacgtcatattaacaaaaataccgttttgattgttggatcttctcctgggtttcctcatgggataatagaccccatcgaagaacttggtaatctagcatcaagctttggcatttgttttcatgtggacctttgccttggtggctttgttttaccttttgctcgtgagcttgggtacgacattccaccttatgatttttctgttaaaggggtaacatcaatatcagtggatgtgcataaatatgggttagctcccaaaggaacaagtatagttctatataggaaccatgaaatcagaaagcatcaatttgttgccgttaccgagtggtctggtggattgtatgtatctccaaccatagctggaagcagacctggatcccttattgctggtgcatgggcagcaatgatgtctctagggaaagaaggttacttggaaaatacaaaagcaattatggaaggatcaaaaagactacaaaaaggcattgaggagattgctgagttgtttatcattggaaaacccgatatgacaatagtggcttttggatccgatgttctggatatatttgaagtgaacgatatcatgtcatccaaagggtggcatttgaatgcattgcagagacccaacagcatccatatctgtgtgacactgcagcatgtaccagttgttgaagacttcctaagggatttgaaggaatctgtgaaaactgtgaaagaaaatccaggtccaataagtggaggactagcacctatatatggggccgccggtaagatgccagatagaggcatggtccaggaattgctggtcgattttatggatggcagttactagtggcgttcataaaacgaacaagttctatagggtcacaagataagtgtacagggtttagacacacataaaagacatttttttctttctaataatattaaaaataattaattttaatttaaagttatttcttttgcatgtgtgtttaaacactctgtgactgtgactgtacaacaatagttgtcacaaaattgtgacatttgtaatttatttttctggggaacatgtactatagcagacccctactaaataatgatatttgattttacagtacattgtttcatactgagaactgaaagaaccatgattgctttaaattaattagatgaaaaataaattccctctcttttgtgtagtggttctctgaatctctgttagtgctctacatcaaacaaagaaagaggaggccctatcatatgttgtctaatatgtacccttttttaagataaagtaaactaatgtgtgtgaagtcattattaaaaatatgaatggtagagattttgtcaaatttttaa

SEQ ID NO: 990 - DNA, 2307 bp, Prunus mume
ataaaacagaaaaaaggtgttctgatcgagaaggcagccggaccaattgtaagaatttcaacgctttgtctcttctttcacacttcttccacaccagcatcaacaaaacatttgcatcgaacaataatcagaaatttcgccaacaaagcatatcaaaatccaaaatccaaaaactccattcggtaagaagctctctaaagctacgcaacccaaccaaacccaaagcgtttacttgtacgccacaacaatttttcaaccaagcctcactatctatccgtaattttctctactggttttgaattttcatcgacgtagtcttgaactgtaatcagattgttcagttcagccatggattcttctgtgaaatcgttcctgcttgatgttagagctttcgcgaattcattcttgtccgaatacgagcctctggttctggtttctgctcctcttatcgcactcttcgttgcttccatgcttcaatcggctctccaagtcctgcacgagaacggactcaaagccactctgctagggttcttcatgagcttcgtcaagttggttcctggcgtgaagagttacatcgacgctgagaaacaaaaggttgtggataagttacagtctggtggtaaatctgtaagagaaagttggagaactgaattgcctagcacagggttgggagtgggagtcatagagcaaatgaaagatgagaaaagaaaagatgtggcttggcaagggaaatgctctggcgcagtctacattggaggaagtgagtgtgaaggacatttttctttaattaacgaggcatgctcaatgtttgcacataccaatccattgcatatggatgtattccagagtgtggtacggtttgaagcagaagtggttgcaatgactgctgcaatgcttggaagtaaaaagaagtcttctggaggacaaatatgtggaaacatgacatcaggaggaactgaaagtatattattagctgtgaaatcatcacgagattatatgaaaaccatgaaggggattaaaaagcctgaaatgataatacctgaatctgctcactcagcatacgacaaggctgcacaatattttaacatcaagctctggcgcgtccctgtaaataaagaatttcaagcagacgtcaaagcaattagaagatacattaatagaaacaccattttgattgttggatctgcacctggtttccctcatggcattgttgatccgattgaggagcttggtcaattggcttcaagcttcgacatttgtctccatgttgacctttgtcttggcggcttcgtattaccttttgctaataagcttgggtatccaattccaccctttgatttttcagtgaaaggagtgacgtcaatatcagcggatgtgcataaatatgggttggctcctaaaggaacaagtgtagttctgtacagaaaccatgacctcagaaagcatcaatttgttgctgttactgagtggtcaggagggctatatgtgtctccaaccattgccggaagcagacctggtggtttaattgctggggcttgggcatctatgatatctttgggggaggaagggtacttggaaaacacaaaaaagatcatggaagtatcaaaaagacttcagaaagggatagaggaaattcccgagttgtttgtcattggaaggccagacatgacagttgtggcattgggatctaatgttgttgacatatttgaagtaaatgatatcatgtcatctaaaggctggcatttgaatgcattgcaaagacccaacagcattcatatctgcgtgacacttcaacacgtaccaattattgatgactttctcagggatctaacggaatctgtgaaaactgttaaagaaaatccgggtcctataagcggagggctcgctcccatttatggtgctgcagggaggatgccagatagaggtacggttcaggagctgttggtaaattacatggacggtgcattctagtggtgctctccaaattttttctcatagaattctttggtcaagttgtaagaaaaatgttgtttttgaaaagaccacaagttaaaagaaaaatgaaaatccattcgttgattttctccaatattacttgatgttcttgcctcgggtttgatttaaggattcattgtctaaatccacgatatatacgtgtattttgtgatcatgatgtgctgctcattcacaactttttattttataattcaatcaactgccccttgcggagcccccccaattgttaactgcttttataggtcatgtttcttttaaacctacttcaatcccgtccattgcaattattag

SEQ ID NO: 991 - DNA, 1898 bp, Solanum phureja
tatggagtatcaatctaagtaatacattactatcaaacaaaaaaaaagataaaagaaaaaaaaatatacccatttcacgtcgatcggcgatggcgtttccgattccaccatggttgaatcagtacagagcttcagcaaattccttcttatctcaatacgagccattaattctacttattactcctctcttctctctactaatcgctcgaattcttcaatccatcttcctcgttattcacgagcgaggactcaaagccaccattattagcttcgttatgagcgccatcaagttggtgcctggtgttaaaaagtacattgactctgagaagcagaagatagtggataagttgcaaggttctagtaatagagatggatggagaactgagttgccgaagacaggtttaggagataacgtcctagtgcaaatgagagatgaaaaacaaaaagatgtgacatggcagggcaaatgttcgggtaccgtctatattggcggaaatgagaatgagggacatttttcattgataaacgaggcatgttccatgtttgcacataccaatccactacatctgagtgtgttcccaagcgttgttagatttgaagcagaagtggttgcgatgacagcagcaattcttggtagtaaagaaaaggcttctggaggacaaatttgtggaaatatgacatcaggggggactgaaagtatattattagcagttaaatcatcacgtgactatatgaaagccaagaagggaatcactaaaccagaaatgataataccagtttccgcacactcagcatatgacaaggctgcacaatatttcaagatcaagttgtggcgtgtccccgttgataaagaatttcgagcagatgttaaagctattaagcgatatattaacaaaaatactatcatgattgttggatcggcacctggattcccccatggcataatcgatccaattgaggcaacttggtgatttggcttctagctaccaaatttgtttccatgttgacctttgtcttgggggctttgtcttacctttcgctcgtaaattgggataccctgtacctccatttgatttcactgttcaaggagtaacctcaatctcagtggatgtacacaagtatgggctggcaccaaaaggaaccagtgtagttctgtaccgaaatcgtgaaatacggaagcatcaatttgttgctgtcactgagtggactggtgggctttatgtttctccaacaattgctggaagcagagctggaggtctgatagctggggcttgggcagcaatgatatctttaggctccgaaggatacttggaaaacaccaaggagatcatggaggcatcaaaaagaattcagaaagggatacaggacattccagaactgtttgtgattggaaggcctgatatgagtataattgcttttggatctgatgttgtagacatatttgaagtcaatgatatactgtcatccaaaggttggcatttaaatgcattgcagagacctaacagtgttcatatttgtgtgacgcttcaacatgtatcagtagtccagatttttctgaaggatcttagagattccgtgcagactgtgaaagaaaatccaggtccagttaacggagggtttgctccaatctacggtgccgcagggaagatgccagatagagttatggttcaagatttactggtggaatttatggacagttcatactagtcatttctcagcataatctatgcataattactgctgaatagaaaatattgcaattgttaattaatattgggttttctgcattatggtaaatacgaacagaatgttaacaattgaacagtattgattcttttgtacttgctgaatgcatgctaaaatataattggtgaaacccctcaaactattattaccaa

SEQ ID NO: 992 - DNA, 2072 bp, Glycine max
tgtttcttcgttatcgctttctttctttcaccaaatattttatatactgcactgtccttattccttcttctccaatctccattgttgatattctcttcttccttcgttccttccaatggattcttcgatctctcacttcagagcctccgcgaattccttcctctcccaatacgaacctctcgctttgcttctcgctcctctcctctctctcctcttcgccctcgctctccgctccttcttccacctcctctccgagaacggactcaaagccacgctcctagggtttctcattaactccttcaaattggtcccaggtgtgaagagatacatagatgccgaaaaacaaaaggttgtggataagttgcaatctgatagtaaatctaaaagagaaggttggaaaactgagttgccaagcacaggattagggacaactgtccttgagaaaatgagagaggagaaaattaatgacgcagtttggcaaggcaaatgctctggtacagtctacattggaggaagtgaatctgatggacatttttctctgataaatgaggcatgttcaatgtttgcacataccaatcccctgcatttggatgtattcaagagtgttgcacgctttgaggcagaagtggttgcaatgacagcagcacttcttggaagtaaggaaaaaagttctggaggacaaatatgtggcaacatgacatccggcgggactgaaagtatattattagctgtcaaatcatctcgtgactatatgaaatctaagaaaggaattacaagacctgaaatgattattcccgagtctggacactcagcatatgacaaggctgcacagtattttaatatcaaattatggcgtgcaccagttaacaagaattttcaagcagatgcgaaagctattcgacgtcacattaacaaaaataccatcttgattgttggatctgctcctgggtttcctcatggagtaattgaccccatcgaagaacttggtcatctggcatcaagctttggtatttgtttccatgtggacctttgccttggtggctttgtactaccatttgctcgtgagcttgggtaccacattccaccttttgatttttctgttaaaggggtttcttcaatatcagttgatgtacataaatacggtttagctcccaaaggaacaagtgtagttctttatagaaaccatgaaatcagaaagcatcaatttgttgctgttaccgaatggtctggtgggttgtatgtgtctccaaccatagctggaagcaggcctggaagtcttattgctggtgcatgggcagcgatgatgtctctagggaaagaaggttacttgaaaaatacaaaagcaattatggaagggtcaagaagaatacagaaaggcatagaggagattgctgagttgtttattgttggaaaacctgacatgacgatagtggcttttggatctgctgttctggatatattcgaagtcaatgatgttatgtcatccaaagggtggcatttgaatgcattacagagacccaacagcatccatatctgtgtgaccctgcaacatgtgccaattgttgaagactttctcaatgatttgaaggaatctgtgaaaactgtgaaagcaaatccaggtccaataagtggaggcctagcacctatatatggtgccgcagggaagatgccagatagaggcatggtccaggaattgctggtagattatatggatggtacctgctaatggcgttcaacatttgtaccagacttttcaggaaacatgtactgtagtggacctttactttgataatattccattttatagtgcattctttcatattggggagaaaactaaagactactaataaggccttgtttgtttgtgtgtgtatgctcttgtacgttgaagaggccacttcgttttatattcatatctaagcattatcatgggtggtggggggacattggggacagtaatacttctgaaactcccagaacaaaaataatgcacatgagattgattgtacaaaaacaaaatgtacgcatgtttgataatcatcataaaaatgagggtaaaaatcagggttaca

SEQ ID NO: 993 - DNA, 2181 bp, Glycine max
ttccttcttctcccatctccattccttccaatggcttcaatctctcacttcagaacctccgcgaattccttcctctcccaatacgaacctctctctctgcttctcgctcctctcctctctctcctcttcgctcacgctctccgctccttcttccacctcctctcccagaacggactcaaagccacgctcctagggtttctcattaactccctcaaattagtccctggcgtgaagggatacatagatgccgaaaaacaaaaggttgtggataagttgcaatctgatggtaaatctaaaagagaaggttggaaaactgagttgccaagcacaggattagggacatctgtccttgagaaaatgagagaggagaaaataaatgatgcggtttggcaaggcaaatgctctggtacagtctacattggaggaagtgaatctgatggacatttttctctgataaatgaggcatgttcaatgtttgctcataccaatcccctgcatttggatgttttcaagagtgttgcacgctttgaggcagaagtggttgcaatgacagcagcacttcttggaagtaaggaaaagagttctggacgacaaatatgtggcaacatgacgtcaggcgggactgaaagtatattattagctgtcaagtcatctcgtgactatatgaaatctaagaaaggaattacaagacctgaaatgattattcccgagtctgggcactcggcatatgacaaggctgcacagtattttaatatcaaactatggcgtgtaccagttaacaagaatttccaagctgatgtgaaagcgatccgacgtcatattaacaaaaataccatcttgattgttggatctgctccagggtttcctcatggagtaattgaccccattgaagaacttggtcatctggcatcaagctttggtatttgtttccatgtggacctttgccttggtggctttgtattaccatttgctcgtgagcttgggtaccacattccaccttttgatttttctgttaaaggggtttcttcaatatcagtggatgtacataaatacggtttagctcccaaaggaactagcgtagttctttacagaaaccatgaaatcagaaagcatcaatttgttgctgttaccgagtggtctggtgggctgtatgtatctccaaccatagctggaagcaggcctggaagtcttattgccggtgcatgggcagcgatgatatctctagggaaagaaggttacttgaaaaatacaaaagaaattatggaagggtcaagaagaatacagcaaggcatagaggagattgctgagttgtttattgttggaaaacccgacatgacgatagtggcttttggatccgacgttctagatatattcgaagtcaatgatgttatgtcatccaaagggtggcatttgaatgcattacagcgacccaacagcatccatatctgtgtgacactgcaacatgtgccaattgttgaagactttctcaatgatctgaaggaatctgtgaaaactgtgaaagcaaatccaggtccaataagtggaggcctagcacctatatatggcgccgcagggaagatgccagatagaggcatggtccaggaattgctggtagattatatggacggtacctgctaatggcgttcgacatttctaccagacttttctggcgacatgtactgtagtggacctttacttgataatattccattttatagtgcattctttcatattggggagaaaactgaagactaataataaggccttgtttgtttgtgtgtgtgccattgtacgtttaagaggccacgttgttttagattcacatctgagcattattatcatggatgggtggggggggagttcgttgctatttcacaatcttgctcttgacattgaggacagtaatatttctgaaacccccataaccaaaaataatgcacatgtgattgattgtacaaaaacaaaatgtacgtgtgattgataatcatcataaatataagggtgaaaatcagggttacagaccagtgtaatgcttatccatcagtccacaataagagctgggcatggataggaacagtatttttgtcgtgatgataaaaaaatttggagggaatcttactttgttctccttgatgagtaattacattacattgtcatcctttctaattttaaaatgttttt

SEQ ID NO: 994 - DNA, 1973 bp, Valeriana officinalis
gtgaggcaactagaaagatctgattggtgagaagtgagaacaaaactttgtgtaaccccgtggctaggcgcgggcactgttacaagcaagcaaaaatattatccatctctaatggagtcatcctggagttgcctaaatcattctagagtcacattgaattcatttttgaatcaatatgagcctctcgttctgctcctcgctcctcttctatcactactacttgcccggattctccactcattcttccatgtaatttatcacaagggtgtcaaagccacacttcttgggttcttcatgacatccatcaagttggtacccggtgtcaagaagtacatcgacgccgaaaagcaaaaggttgtggataagatgcaatcttcaggtaaatcagaaaggaatgaatggaggagcgagttaccgagatcagggctaggcgttggagtcatagagaaaatgaaagatgagaaaagaaaagatgtggtctggcaaggcaaatgctctggtacagtatacattggaggaagcgaatccgaaggacatttttctttgataaatgaagcatgttcaatgtttgcacacacaaatccactgcatctagatgtattcaaaagtgtggtgaggtttgaggctgaagtggttggaatgacggctgcgttacttggaagtaaggacgaaaagtgttttggaggagaaaaaatatgcggaaatatgacttctggagggactgaaagtattctattagctgtcaaatcttcgcgtgactatatgatggctaagaaagggatcgtcgtacctgaaatgattatccccgaatcagcacactcagcttatgacaaggcttgtcaatatttcaacatcaagctgtggcgcgtacctgtcaataaagatttccaggcagatgtcagatctatcaagcgctttatcaacaagaataccattttgattgttggatcagcacctgggtttccacacggcattattgatcctattgaggaacttggcgagctagcatatcgtactggagtttgtttccatgttgacctatgtcttggtggttttgtgttgccttttgctcgtaaacttgggtatcctttgcctccattcgacttttgtgtccaaggagtgacatcaatatcagttgatgtacacaagtacggattggctcctaaaggaacaagtgtagttttatatagaaaccatgacattcgcaagcatcaatttgttgctgtgactgaatggtctggtgggctttatgtgtctccgacaattgctggtagcaggcctggtggtctcattgccggggcttgggcagcaatgatgtccttaggaatggaaggatacttggagcacacaaggaatataatggaagcatcaaagagactacagaaaggaacggaagagatacgtgagttgtttataatcggaaagccagacatgacaatagttgctttcggatccgacagcatagatatatttgaagttaatgacctaatgtcgtccaaaggctggcatttgaatgccttgcagagacccaacagcattcatatttgcgtcacccttcagcatgtacccattgtggacgagtttctcaaggatttgagggactcggtagaaactgtgaaagcaaatccaggtccagtaagcggggggatggctcctatatacggcgctgcaggtaggatgccagataggtctatggttaaggaactacttgtcgatttcatggacacgtcatgctagtgctagtgatagtgctactacgacttctcattctttgtcctgcacaatagatttagatatgcatttatattactagctctcagactactgtccaaatgctttcatgttcaaactatctctatgtcagatattattactcatgtacgctcagctcatatttaaatgttgcttgttagacacttgggaatcacccaccagacaaacttatacgacttgcgttacatgggcattatcac

SEQ ID NO: 995 - DNA, 2066 bp, Trifolium pratense
gggaatcaacctgtgtgtattcatctatccattcatttcttcctttttccttattcttctccattgctctctccgcgccatggattcttctgtgttgacttcttacttcaacaacttccgaaccaccgcgaactcttttctctctcaatacgaacctctcaccctggttctagttcctctattctctctctttctcgcaaacgtgattcgttcgtttttcagtgttattcatgataaaggactcaaagccactgtactagggttcttcatgaacttcatcaaattgatccctggtgtgaagagttatatagatgctgaaaaacagaaggtcgtggataagttacagtctgatggtaaatctaaaagagaaggttggaagacagagttgccaagtacagggttggggacatctgttcttgagaaaatgagtgaggagaaaagaaatgatgcagtttggcaaggcaaatgctctggtacagtctacattggaggaagtgagtctagtgcacatttttctgtcataaatgaggcctgctcaatgtttgcacataccaatcccttgcatttggatgtattccagagtgttgtacgctttgaggcagaagtggttgcaatgacagcggcccttcttggaagtaaagaaaagacatctggtggacaaatatgtggcaatatgacatcaggtgggactgaaagtatattattagccgttaaatcatctcgcgactacatgaaatccaagaaaggaattacaagacctgaaatgataatccctgagtctggtcactcagcatatgacaaagctgcacattattttaacataaaactatggcgtgttccagttaacaaaaaatttcaagccgatgtgaaagcaattcgaagtcatattaacaaaaataccattttgattgttggatcttctcctgggtttcctcatgggataatagaccccattgaagaacttggtcaactagcatcaagctttggcatttgttttcacgtggacctttgccttggtggctttgtattaccttttgctcgtgagcttgggtaccacattccaccttatgatttttctgttaaaggggttacttcaatatcagcggatgtgcataaatatgggttagctcccaaaggaacaagtgtagttctatataggaaccatgaaatcagaaagcatcaatttgttgcagttactgagtggtccggtgggttgtatgtatctccaaccatagctggaagcagacctggaagccttattgctggtgcatgggcagcaatgatgtctctagggaaagcaggttacttggaaaatactaaagcaattatggaaggatcaaaaagactacaaaaaggcatagaggagattcctgagttatttatcattggaaaacccgatatgacaattgtggcttttggatcaaatgttctcgatatatttgaagtcaatgatatcatgtcatccaaaggttggcatttgaatgcattgcagagacccaacagcatccatatctgtgtgacactacaacatgtaccagtaatcgaggactttataaaggatttaaaggaatctgtgaatactgtgaaagaaaatccaggtccaataagtggaggactagcacctatatatggagccgccgggaagatgccagatagaggaatggtccaggaattgctggtcgatttcatggatggcacctgctagtgactgagtgagtggctttcataaaactgtgacatgtgttatttcattcttctgcctgtgggaacatgtactgtactaggcccctaccaaataataatgtacgatttcacatgcattctttattttgatagaacggtttcacgtgcattctttcatattcagaagagaaagaataatccaagaactataattgatattgaatatatggaaaataaagtcagtttgtttatgtggtctatgctgtgtagtgtgtatcaaagaggccctatcatatatggtcttatatgtactttttctaatattaaaaacttatttgtactttttctattattaaaaaatatatgaatggtagagattaatt

SEQ ID NO: 996 - DNA, 1879 bp, Panax ginseng
acgcgacagacttgaaatatccccaaaaaagtattaatactactgtatctatccctcagctgtttgctgttgatcatcatcttcatctaatctaagtaagactgttgttttgatatatacatttgtttcccaatggagtcgtcatcgttgttctggacttctctgaatcggttcagagcttctgcaaatggacttctatctgaatatgaacctcttactctacttctcgctcctattttctccctcctatttgctcggattcttcaatcttttctccacctagtaaacgacaaaggactcaaggctacactcctagggttcctcgtgacatccatcaagttggtacccggcgtaaagaagtacatcgatgccgagaaacaaaaggttgtagataagttgcaatcttctggtaaatctaaaagggatggttgggaaaatgagttgccaaaggcgggattaggatttggagtcatagagagaatgaaaaatgataaaagaaatgatgtggtttggcaagggaaatgctctggtacagtctacattggaggtaccgagtctgaaggacatttttctctgataaacgaggcatgttcaatgtttgctcataccaaccctctgcatcaggatgtcttccaaagtatagtacgttttgaggctgaagtggttgctatgacagccgcattactaggaagtaaagagaggtcttctggaggacaaatatgtggaaacatgacatcgggaggaaccgaaagtatattactagctgtaaaatcatcacgtgattatatgaaagctaggaagggcattacaagaccagaaatgatcatcccagaatctgcacactcagcttatgataaggctgctcaatatttcaacatcaagctgtggcgcattcctgtaaataaagaattccaagcagatgttcaagctattaagcggtttattaccaaaaacaccatattgattgttggatctgcacctggttttccacatggaatcattgaccctattgaggagcttggtgaattagcttttagtttcggagtttgtttccatgttgacctttgccttggcggttttgtgttgccatttgctcgtaaacttgggtatcctgttccacctttcgatttttctgttcaaggagttacctcaatatccgtggatgtacataaatacgggttggctccgaaaggaacaagtgtagttctgtacagaaaccatgatatccgaaagtgtcaatttgtagccgttactgaatggtctggtggactttatgtgtccccaaccatagctggtagtaggcctggaggtttaattgctggagcttgggcagccatgatgtctttagggctggaaggttatatggagaacacgagagagattatggaagcatcaaagaaattacagaaaggattgaaagagattcctgaagtgtttataattggaaggccagacatgacaatagtggcctttggatctcacactgtggacatatttgaagtcaatgatataatgtcatccaaaggctggcatctgaacgcattgcagagacccaacagcatccatatatgcttgaccctccaacatgtaccagttattggggacttcctaaaggatttgagggattccgtgcaaactgtaaaagaaaatccaggtccaataaatggagggcttgctccgatatatggtgctgccggaaagatgccagatagaggcatggttcaggaattactggtggacttcatggacagctcatgctaataatggaattccttgtactatcaaccagatcttttttttgcactattctttgggaaaggaaaggaacaaaatccccactatctgatactaaacatttagcatgatatacttgctttaa

SEQ ID NO: 997 - DNA, 1943 bp, Mimulus guttatus
atttcacacttctcatcaatccaacagaaaccaagaaagagacaaaacccagaaaagaggagagagagagagacgcaagagagagaaagagagaagggaaaacatggatttggaagcgatacttgcatctatgaatcaattaagagcttctgctaattcatttttatctcaatatgagcccctcgctctgatttccataccgattttcacgcttcttttcgcgcgaattgttcactcgatttctcgtctagtttccgacaaaggactcaaatctacaatcctcgacttcttcatggcttccctcaagttggtgcctggagtgaaaaagtacatagatgctgaaaaacaaaggttgtgaacaaattgcaaggttctggtaaatcgaagagagaaggttggaggacagagttgtcaatgacaggcttaggtgctgacgtcatcaataaaatgaaagacgagaagcaaaaagacgtcccgtggcagggcaaatgttctggtacagtctacattgcaggaaatgaacacgaagggcacttttctctaatcaacgaggcgtgctcaatgtttgcacatactaatcctctgcatcaagatgtattccaaagtgtcgtaaaattcgaagcagaagtcgtggcaatgacagctgcattacttggcagtaaagaaaagtcgtccggtggacaaatttgtggaaatatgacttcgggcgggactgaaagtatattaatggccgtgaaaacatcgagggactatatgaaaattaacaagggcataacttgtccagaaatgattataccagtttcagctcattcggcgtacgacaaggctgcacagtattttaaaatcaagctgtggcgtgtgcccgtgggcccggattttcgagctgatgttaaagcaatcaaacggcatattaaccggaacacaatattgattgttggatcagcgcccggttttccacatggaattattgacccgattgaggagatgggcgagttagcttccactaacgggatttgtttgcatgttgacctatgcctaggtggctttgtattaccttttgctcgtaagcttgggtaccctgtaccgccatttgatttctctgttgacggagtaacgtctatctctgtggatgtacacaagtacggacttgctccgaaaggaacaagcgtcgtcttatataggaatcacgaattacgcaaggtatttcgctcattcgtaaccgaatggagtggtgggctttacgtatctccgacaatagctggaagcaggcccggaggtctagttgccggggcttgggcagcaatgatgtctcttggcttagaagggtatctggagaacacaaggaagataatggaagcgtcaaagagaatcgagaagggggtccgccaaatcccggaactgtttgtagttggaaggccagatatgacgatcgtggcttttggatcgaacgttttggatatatttgaagtaaacgatattatgtcttcgaaaggatggcatctcaatgcattgcagaggcctaacagtattcatatttgcgtgacacttcagcacgtgacggtgactgaagatttcctcaaggatctgacggactctgtccaaactgtaaaagcaaatccaggtccgataaacggagggcttgctccaatatacggtgcagctgggaaaatgccggatagaggcatggttcaagatttacttgttgatttcatggatacctcatgctaatattttgacaatttttagataagccaatattcatgtgacatttcaaaattgttattttgtggatatatgatttactggatgtaatattcttgtttatataaacttcaatgaatgctattgttaatgttcttgggtaattgacactctgcacccttaaattgaaaaaaaaacactttgcacccttaaattaaaaaaaatagcactttgcacccttt

SEQ ID NO: 998 - DNA, 2098 bp, Fragaria vesca
acaacagtttgagtttcaacgcttcctctctcagtccattgacacctcaccattaagcttcagtcagtttctcgcttaagctacgcaaccgattccttcaacgcaatcacaattttcacatgctcataatctcatcctctttcatctaagcagccaccatcagattctcgcccgatggatttctctccagtcaaatcgttcctgctcggagctcgggcttcggcgaattccttcttggaaggctacgagccgctggttctgttttcgacgccgctgatcggactcttggtcgcgtcaaggcttcagtcggtgatcagtgtcctgcaggagaacggagtcaaggccactctcataggcttgttcatgagcttcatcaagctggttcctggagtgaagaagtacatagacgccgagaagcaaaaggtggtggatcagttacagtctggtggtaactctaaaagagagaattggagaactgagttgcctggcgcggggttgggagcgggagttcttgaccagatgaaagaggagaagagaaaagatgtggcttggcaaggcaaatgctctggtacagtatatattggaggaagtgaattcgaaggacatttttctctaattaatgaggcatgctcaatgtttgcacataccaatccactacatatggatgtattccagagtgttgtacggtttgaagcagaagtggttgcgatgacagctgcaatggttggaagtaaaacaaagtcttccggaggacaaatatgtggaaacatgacatcaggaggaactgaaagtatattactagctgtgaaaacatcacgtgattatatgaaagccaggaaggggattaaaaaacctgaaatgataatacctgaatctgcacactcagcatacgacaaggctgcacaatattttaacatcaagctctggcgtgtccctgtagataaagagttccaagcagatgtcaaagcgatcagaaaattcattaatagaaacaccgttttgattgttggatctgcacctggttttcctcatggcattattgatcctattgaggaacttggtcaattagcttctagctttgatatctgtctccatgtcgacctttgtcttgggggatttgtactacctttcgctcaaaagctggggtatccgattccaccctttgatttttcagttaaaggagtgacatcaatatcagctgatgtgcataaatatgggttggctcctaaaggaacaagcatagttctgtacagaaaccatgacattagaaagcatcaatttgtggctgttacggagtggtcaggagggctgtatgtatctccaaccatggctggaagcagacctggtgggttaattgctggggcttgggcagctatgatggctttgggggaggaagggtatctggaaaacacaagggctatcatggaagtatccaaaaaacttcaaaaagggttagaggatattcccgagttgttcatcattggacggccagacatgacagttgttgcatttggttctaatgttgttgatatatttgaagtcaatgatatcatgtcatctaaaggctggcatttgaatgcattgcaaagacctaacagcattcacatatgtatgacacttcaacatgtaccaattcttgatgactttctgagggatctaagggaatctgtgaaaaccgtaaaagaaaatccaggtcccataagtggagggctcgctcctatttatggtgctgcagggaggatgccagatagaggtatggtccaggatctgctggtaaattacatggacggtacatgctagtggtgctgtcaaaattgaatttgtacatcatacttgtgtgtcgtgcctgattcattggttaatttataagaaacatttacaagaaaaccagttataagtaaaatgaatagtcattcattgaatatcatcaaatacttgtctgtatctgctccttgtatacaatgtaaggattcaattgcctaatccgcaaagtgtaaaatgaagtccttcattgaatatcatcaaatacttctctgtatgtgctccttgtatacaatgtaaggattcgtttgcctaatatacaaagtgtttgcccatc

SEQ ID NO: 999 - DNA, 2185 bp, Cichorium intybus
aggataaaaatctatattcaaatattcaaattaaattttaaatggagatctatgatgtgaaaatggtgttagcgatttaggtgcgcaagatccgggtagaaagctgcagataacattgttgtcatcgacacacaaaagaagcacatacgcaaactagaaatccttgtgtcagccgtcgccaagtcacagtcgcttgcttgcttgcacatctatctctcttcgccacaaacaaaaccccccattaaaaaccaacgccgttaagcataagcaacacccattactcctccttaaatcctaatctatcccgtaattaatctgaatactacttagtgtgaggaggagttgtttcgaaggaacacaaaattaaatcatggagtcttccattcttcctgcagtaatccgattaagagcttctgcaaattcatttttgtcacagttcgaacctctggttctcgttgttgctcctctcgtatcttttctggtcgcccagattgttcaatcgttaattcaagtagttcatgagaagggattaaaagcgacgcttattgtttctttcatgacatgtgtcaagttggtgcctggtgtgaagaggtatattgatgctgagaaacagaaggtggttgacaaattacaatcttctggaaaatctaaaagggatggttggagaaccgagctgccaagtacaggattaggaagcggggttttagagcaaatgaaaaatgagaaacaaaaggatgcagcttggcaaggaaaatgttctggtacagtttatattggaggaaacgaatctgaaggtcacttttcgttgataaacgaggcgtgttcaatgtttgcacatacgaacccgttgcatctggatgtgttcaagagtgttgtgagatttgaggcagaagtggttggcatgacggctgctcttcttggaagcaaagagaaggcatgtggagggcaaatatgtggcaacatgacttcaggaggaaccgagagtatattgttggctgtgaaatcatcacgtgattacatgaaggccaagaagaatatcacatgtccggagatgatcatccctgaatctgcacactcggcttatgacaaagctgctcaatatttcaaaattaagttgtggcgtgttcccgtgaataaggaatttcaagcagatgccaaagctatcaagaaatacatcaacaagaacaccgtattgattgttggatcggcgcctggttttccacatggagtcattgatccaatcgaggagctgggcgaattggcgtccagttacgggatctgtctgcatgtagacctttgtcttggtggttttgtgttgccttttgcacgtaaacttgggtaccctattccaccatttgatttttctgtccaaggagtcacctctatatcagcggatgtgcataagtatgggttggcccccaaaggaacaagcatagtgttatacagaaaccatgaaattcgcaagcatcaatttgttgctgttacggaatggtctggtggtctgtatgtgtctccaacgattgcgggtagccgacctggaagtttaattgcgggggcttgggcagctatgctttctttagggcaagaaggttacctcgagcacacaagagagataatggaagcatcaaagaggctacaaaaaggagtaaaagagattcctgagttatttatcattggaaggccagatatgacgattgtggcttttggttctattgtgatagacatatttgaagtgaatgacatattatcctcaaaaggctggcatctaaatcccttgcaaagacccaacagcattcatatatgcgtgacccttcaacatgtacctattgttgacgacttcctgaaagatttgaaggattcagtgcaaactgtaaaagaaaatccagggccggtaagtggagggctggcaccgatatatggtgcagccgggaagatcccagatagaggcatggttaatgagttactggtagattacatggacaatgcatgctgatatgctgatttttgggtacttgaattcaatgtgttttggttgtttgccatcattctttgtaaaagcttccaaaggaaaggaaatcgtgtgtttgatgatatgtaaactgttatatacaaacaagtacaaaatttgaacaactggaaactcatttgatcttgaatgtgcatgtttttgcgaaaaagttattat

SEQ ID NO: 1000 - DNA, 2078 bp, Cichorium intybus
acacaaaagaagcacatacgcaacaaagaaatccttgcgtcagccgtcgccaagtcacagtcgcttgcttgcttgcacatctatctctcttcgccacaaacaaaattacaaaactccccattaaaaaccaacgccgttaagcataagcaacacccattactcctccttaaatcctaatctatcccgtaattaatctgaaaactacttagtgtgaggaggagttgtttcgaaggaacacaaaattaaatcatggagtcttccattcttcctgcagtaatccgattaagagcttctgcaaattcatatttgtcacagttcgaacctctggttctcgttgttgctcctctcgtatcttttctggtcgcccagattgttcaatcgttaattcaagtagttcatgagaagggattaaaagcgacgcttattgtttgtttcatgacatgtgtcaagttggtgcctggtgtgaagaggtatattgatgctgagaaacagaaggtggttaacaaattacaatcttctggaaaatctaaaagggatggttggagaaccgagctgccaagtacaggattaggaagtggggttttagagcaaatgaaaaatgagaaacaaaaggatgcagcttggcaaggcaaatgttctggtacagtttatattggaggaaacgaatctgaaggtcacttttcgttgataaacgaggcgtgttcaatgtttgcacatacgaacccgttgcatctggatgtgttcaagagtgttgtgagatttgaggcagaagtggttggcatgacggctgctcttcttggaagcaaagagaaggcatgtggagggcaaatatgtggcaacatgacttcaggaggaaccgagagtatattgttggctgtgaaatcatcacgtgattacatgaaggccaagaagaatatcacatgtccggagatgatcatccctgaatctgcacactcggcttatgacaaagctgctcaatatttcaaaattaagttgtggcgtgttcccgtgaataaggaatttcaagcagatgccaaagctatcaagaaatacatcaacaagaacaccgtattgattgttggatcggcgcctggttttccacatggagtcattgatccaatcgaggagctgggcgaattggcgtccagttacgggatctgtctgcatgtagacctttgtcttggtggttttgtgttgccttttgcacgtaaacttgggtaccctattccaccatttgatttttctgtccaaggagtcacctctatatcagcggatgtgcataagtatgggttggcccccaaaggaacaagcatagtgttatacagaaaccatgaaattcgcaagcatcaatttgttgctgttacggaatggtctggtggtctgtatgtgtctccaacgattgcgggtagccgacctggaagtttaattgcgggggcttgggcagctatgctttctttagggcaagaaggttacctcgagcacacaagagagataatggaagcatcaaagaggctacaaaaaggagtaaaagagattcctgagttatttatcattggaaggccagatatgacgattgtggcttttggttctattgtgatagacatatttgaagtgaatgacatattatcctcaaaaggctggcatctaaatcccttgcaaagacccaacagcattcatatatgcgtgacccttcaacatgtacctattgttgacgacttcctgaaagatttgaaggattcagttcaaactgtaaaagaaaatccagggccggtaagtggagggctggcaccgatatatggtgcagccgggaagatcccagatagaggcatggttaatgagttactggtagattacatggacaatgcatgctgatatgctgatttttgggtacttgaattcaatgtgttttggttgtttgccatcattctttgtaaaagcttccaaaggaaaggaaatcgtgtgtttgatgatatgtaaactgttgctataaacaaacaagtacaacatttgaacaactggaaaatcatctctatttgatcttggatgtgcatgtttttgcaaaaaagttattattccaa

SEQ ID NO: 1001 - DNA, 1961 bp, Panax ginseng
gaagctcaataaacgcaaacccgccaaaaaccataaattgatacatattctccacgcgacagacttgaaatatccccaaaaaagtattaatactactgtatctatccctcagctgtttgctgttgatcatcatcttcatctaatctaagtaagactgttgttttgatatatacatttgtttcccaatggagtcgttatcgtcgttctggacttctctgaatcggttcagagcttctgcaaatggacttctatctgaatatgaacctcttactctgcttctcgctcctattttctcccttctatttgctcggattcttcaatcttttctccacctagtaaacgacaaaggactcaaggctacactcctagggttcctcgtgacatccatcaagttggtacccggcgtaaagaagtacatcgatgccgagaaacaaaaggttgtagataagttgcaatcttctggtaaatctaaaagggatggttgggaaaatgagttgccaaaggcgggattaggatttggagtcatagagagaatgaaaaatgataaaagaaatgatgtggtttggcaagggaaatgctctggtacagtctacattggaggtaccgagtctgaaggacatttttctctgataaacgaggcatgttcaatgtttgctcataccaaccctctgcatcaggatgtcttccaaagtatagtacgttttgaggctgaagtggttgctatgacagccgcattactaggaagtaaagagaggtcttctggaggacaaatatgtggaaacatgacatcgggaggaaccgaaagtatattactagctgtaaaatcatcacgtgattatatgaaagctaggaagggcattacaagaccggaaatgatcatcccagaatctgcacactcagcttatgataaggctgctcaatatttcaacatcaagctgtggcgcattcctgtaaataaagaattccaagcagatgttcaagctattaagcggtttattaccaaaaacaccatattgattgttggatctgcacctggttttccacatggaatcattgaccctattgaggagcttggtgaattagcttttagtttcggagtttgtttccatgttgacctttgccttggcggttttgtgttgccatttgctcagaaacttgggtatcctgttccacctttcgatttttctgttcaaggagttacctcaatatccgtggatgtacataaatacgggttggctccgaaaggaacaagtgtagttctgtacagaaaccatgatatccgaaagtgtcaatttgtagctgttactgaatggtctggggggctttatgtgtccccaaccatagctggtagtaggcctggaggtttaattgctggagcttgggcagccatgatgtctttagggctggaaggttatatggagaacacgagagagattatggaagcatcaaagaaattacagaaaggattgaaagagattcctgaagtgtttataattggaaggccagacatgacaatagtggcctttggatctcacactgtggacatatttgaagtcaatgatataatgtcatccaaaggctggcatctgaacgcattgcagagacccaacagcatccatatatgcttgaccctccaacatgtaccagttattggggacttcctaaaggatttgagggattccgtgcaaactgtaaaagaaaatccaggtccaataaatggagggcttgctcctatatatggtgctgccggaaagatgccagatcgaggcatggttcaggaattactggtggacttcatggacagctcatgctaatggaattccttgtactatcaaccagttctttttttttgcactattctttgggaaaggaaaggaacaaaatcccccacaatatctgatactaaacatttaacatgatatacttgctttaaatttgttcaaggcataaatgcaattcat

SEQ ID NO: 1002 - DNA, 2295 bp, Lactuca sativa
cggagtttgggtgcgaaagatccggttagaaagctgcagataacatagcatagttgttatcgacacacaacacaaggatattagatatactctaaaaagaaatcgttgtgttgtcagccgtcgccaagtaacagttgcttgcttgcttgaacatctatctctctttgccacaaaaaaaaaacccctccattatagccaacgccgttaagcttaagcaatgtccattttccaaatccacccttcccttaaatcctaatctatccactcttattaatccaaaaaccacatagcgtgtgaaggaattaacgttgtttcgaaagaacacaaaatcaaatcatggagtcttcgattcttcctgcaattatccgattacgagcttctgcaaattcgtttttgtcacagttcgaacctctgctcctcgttgttgctcctctcataactttcctcgtcgcccagattgttcaatcgtttattcaagtagttcatgagaagggattcaaagcgacgcttattggttttatcatgacatgggtcaagttggtgcctggtgtgaagagctatattgatgccgagaaacaaaaggttgttgataaattacaatcttctggcaaatcttcaagggatggttggaggacagagcttccaagttcaggattaggaaatagggttttagagcaaatgaaaaatgagaaagaaaaggatgcagcttggcaaggaaaatgttctggtacagtgtatattggaggaaatgaatctgaaggccacttttcgttgataaacgaggcatgttcaatgtttgcacatacgaacccgttacatctagatgtattcaagagtgttgtgagatttgaggcagaagtggtggccatgacggctgctcttcttggaagtaaagagaaagcatcaggaggccaaatatgtggcaacatgacttcaggaggaacagagagtatactgttagctgtcaaatcatcacgtgactacatgaaggccagcaagagtatcacatgtccagagatgataatccctgaatcggcacactcggcttatgacaaagctgctcagtatttcaaaattaagttgtggcgtgttcctgtgaataaggaatttcaagcagatgtaaaagctatcaagaaatacataaacaaaaacaccatattgattgttgggtcagcacctggttttcctcatggaatcatcgacccaatcgaggagcttggtgaattggcattgagttacaggatctgtctgcatgtagacctttgtcttggtggttttgtgctgccttttgcacgtaaacttgggtatccaattccaccatttgatttttctgtccaaggagtaacttctatatcagcagatgtgcataaatatggattggcacccaaaggaacaagtatagttttatacagaaaccatgaaatccgcaagcaccaatttgttgctgttacggaatggtctggtggtctgtatgtatctccgacaattgctggtagcagacctggaagtttaattgctggggcttgggcagctatgctttctttagggcaagaaggttacctggagcacacaagagagataatggaagcatcaaagaggctacaaaatggagtaaaacagatccctgagttatttgtgattggaaggccagatatgacaattgtggcttttgggtctaatgtgatagacatatttgaagtgaacgacttactttcctcaaaaggctggcatctaaatcccttgcagagacccaacagcattcatatctgtgtgacccttcaacatgttcctattgttgacgacttcctgaaagatttaaaggattcagtgcagattgtaaaacaaaatccggggcctattagtggagggcttgcaccaatatatggagcagccgggaagatcccagatagaggtatggttaatgagttattggttgactacatggacaatgcatgttgatatgaagacttttgggtatttggactcccatgcatgtattttggtttggttgtttgccaattgccatcattctttgtaaaagctttccaaggaaaggaaattatatgtgtgtttgatgatatataaactgttatatacaaacaagtagaacattagcacatgaagaatcatctttattttatccaatcctgcatgtttatgcaagaggattattattccagcaaccaatgatcacaatgtgtgctgcaagtccagtggaatcgtgtaagatgtaaatctggtatatagcagtcccatattggggttgtgtgtcggtaggagttgttaataaaagca

SEQ ID NO: 1003 - DNA, 1823 bp, Plantago ovata
ccattcttcagtttctctgcaattcttatctcggagaagaaaacaatggattccgatgaaattttcctccatctgaatcgataccgagcttctgtgaactcgtttctgtcgcaatacgagcctctcgcacttatcgccgttcctctaatcactctgttcctcgcacgtatcgttaactcgattttcggtgtcatttccgagaaaggactgaaatcttccataatcggcttcttcatgacctccgtcaaattggtgcctggcgtgaagaagtacattgatgctgaaaagcagaaggttgtgaatcagctgcaaggttctggtaaatcaaagaaggatggttggagaactgagttgccaaagggtggtttaggagttgaggtcattaatttgatgaaagatgagaaacaaaaagatgtcacatggcagggcaagtgttctggcacggtctacattgcaggaagcgaacaagaaggtcacttctctttaataaatgaggcctgctcgatgtttgcacataccaaccctctgcatctagatgtattcaagagtgtagtaaaatttgaatcggaagttgttgcaatgaccgcggcgttactcgggagcaggggaaacaattccggaggacaaatctgtggaaatatgacatcaggagggacggaaagtattattctggctataaaaacctcgcgtgactatatgaaagctaagaaggggattagtaaaccagaaatgattataccagtgtctgctcattcagcgtatgacaaggctgcacaatatttcaacatcaaattgtggcgtgttcctgtaagccaagatttccgagctgatgttaaagcaatcaaacgacatattaacaagaacaccatagtgattgttggatcagcacctggttttcctcacggaatcattgacccaattgaggagcttggggaattagcttctacttatgggatttgcttccatgttgacctgtgtcttggtggttttgtattgcctttcgctcgtaaacttgggtatccaataccaccatttgatttctctgttcaaggtgtaacttcgatatctgtggatgttcacaagtatggattggctccgaaaggaacaagtgtggtcttatatagggatcatgaaatacggaagcatcaatttgttgctgttactgaatggactggtgggctttatatttctccaacaattgctggaagcaggcctggtggtttgattgcaggggcttgggcagcaatgatgtctctagggttggaaggttatttggaaaatacgcgacaggttatggaagcttcaaagagattagagaagggtgttcgtgagattcctgggttatttgtgattggaaggccagagatgacaatcgtggcctttggatctgactcattcgacgtatttgaggtcaatgatattatgtcctcaaaaggatggcatctgaatgcattacaaaggcccaacagcgttcatatttgtttgacacttcaacatgtacctgtggtcggggagtttctggaggatctgagagcttccgttgaaactgttaaagtgaatcctggcccagttaaaggaggtctggcaccaatatatggcgcagctggaagaatgccagatagagctacggttaaagatttgttggtggatttcatggatagctcctgctagtgtgacaaatgcttcctacctctaattatgttatcttattctttgcccacagtaaaaagttgtcaccaattcttgtattagccagaactgtaatatgtttgatacttcaattttacacactgattatttttatgcgactaaggtaacatttt

SEQ ID NO: 1004 - DNA, 1679 bp, Prunus persica
atattcatcgacgtagtcttggactgtaatcagattcttcagttcagccatggattcttctgtgaaatcgttcctgcttgatgttagagcttccgcgaattcattcttgtccgaatacgagcctctggttctggtttctgctcctcttatcgcactcttcgttgcttccatgcttcaatcggctctccaagtcctgcacgagaacggactcaaagccactctgctagggttcttcatgagcttcgtcaagttggttcctggcgtgaagagttacatcgacgctgagaaacaaaaggttgtggataagttacagtctggtggtaaatctgtaagagaaagttggagaactgaattgcctagcacagggttgggagtgggagtcatagagcaaatgaaagatgagaaaagaaaagatgtggcttggcaagggaaatgctctggtgcagtctacattggaggaagtgagtgtgaaggacatttttctttaattaatgaggcatgctcaatgtttgcgcataccaatccattgcatatggatgtattccagagtgtggtacggtttgaagcagaagtggttgcaatgactgctgcaatgcttggaagtaaaaagaagtcttctggaggacaaatatgtggaaacatgacatcaggaggaactgaaagtatattattagctgtgaaatcatcacgagattatatgaaaaccacgaaggggattaaaaagcctgaaatgataatacctgaatctgctcactcagcatacgacaaggctgcacaatattttaacatcaagctctggcgtgtccctgtaaataaagaatttcaagcagacgtcaaagcaattagaagatacattaatagaaacaccgttttgattgttggatctgcacctggtttccctcatggcattgttgatccgattaaggagcttggtcaattggcttcaagcttcgacatttgtctccatgttgacctttgtcttggcggcttcgtattaccttttgctaataagcttgggtatccaattccaccctttgatttttcagtgaaaggagtgacatcaatatcagcggatgtgcataaatatgggttggctcctaaaggaacaagtgtagttctgtacagaaaccatgacctcagaaagcatcaatttgttgccgttactgagtggtcaggagggctatatgtgtctccaaccattgccggaagcagacctggtagtttaattgctggggcttgggcatctatgatatctttgggggaggaagggtacttggaaaacacaaaaaagatcatggaagtatcaaaaagacttcagaaagggatagaggaaattcccgagttgtttgtcattggaaggccagacatgacagttgtggcattgggatctaatgttgttgacatatttgaagtaaatgatatcatgtcatctaaaggctggcatttgaatgcattgcaaagacccaacagcattcatatctgcgtgacgcttcaacatgtaccaattattgatgactttctcagggatctaacggaatctgtgaaaactgttaaagaaaatccgggtcctataagcggagggctcgctcccatttatggtgctgcggggaggatgccagatagaggtacggttcaggagctgttggtaaattacatggacggtacatgctagtggtgct

SEQ ID NO: 1005 - DNA, 1713 bp, Avena sativa
cagtgaagcttcaaactgaaaatctaccacctcaaacaaccgagaaattctgaacgcaccactgccggcgatgagcaccaccgaggggaagccgccgtcgccggacgccgccacggtggaggagatggcgcgggtggctacggcgtggtgcgggatccacgggctcgtcgtcggggatcgcgcggacccgagatcagggacagttcctggagttgggttggtccatgctccaatctctctcctcccgtcgcgcctgtcggaatctttctgggagcaggcgtgcgacctggctccggttttcaacgagcttgtggatcgtgtcagcttggatggggagttcctgcaggattcactgtctaaaacaagacaggttgatgatttcacttcgaggctcttagatattcataggaagatgatggataccaacaaggatgagaacattagattggggttgcaccgatcagattatatgctggattcagaaaccaattctcttcttcaaatagagctcaacaccatttcagtatcttttcctggactttgttccttagtgactgagcttcacaggacattgattaatcagtatggaaatttattatgtctagacgccaaaaaggttcctggaaatgaggcaagccgtcaatttgctcaggcattggccagagcatgcgatgagtttaatgttgacagggctgtagttatgatgattgttcagcctaaagaaagaaatatgtatgaccaatactggcttgtcaagtatttgaaggaatcacatggcgtaacaactatcaggaaaaccttgtcagaggtggaggctgaaggccaggttctccctgatggaacgcttgttgtagatggcaagaaggtcgctgtggtgtattttagagcaggctatacaccaaatgattacccttcagaagcggaatggagtgcaaggcttttgatggaacaatcatctgccgtaaagtgtccttcaatatcatatcatttagtgggaagcaagaagattcaacaagaactagcaaaacctaacgtgcttgaaaggtttcttgaaaataaggaggaaatttccaagcttcgtcaatgctttgcagggttatggagcttggatgaggaagaaattgtcaaatctgcaatcgaaaaccctgacttgtttgtcttgaagcctcagcgtgaaggcggaggaaacaacatatatggcctcgatgtgcgagacgctctgatcagactcaagaaggaaggaggagatgctctctcagcctatatactgatgcaaagaatctttcctaaagcatcttttgctaatctggtccgtggtggtgtttgccatgaggccctcacagtatctgagcttgggatatatggagcctacttgcggaacaaagataaggtgatcatcaatgacaaatgtggttacttgatgcgaacaaaagtttcttcatcagatgaaggcggcgttgctgcaggatttgctgttctagatagcttatacctgaccgacaagtgaagaaacctcgggaataccagctacaagtttcatccggcattgacataccatggttttagcactatgttgcgttggttgcagcacctgttatgtacaaagtagttgcataatttgcagacagcgaccatcatcatacaccacagacgtgaagaataatcatgttatgtattgacgaattgtgtctatactaaacaataatctttctg

SEQ ID NO: 1006 - DNA, 1632 bp, Festuca arundinacea
agaattctgaacgcacccccaccactaccggcgatgagcaccaccgagggaaagccgtcgccgtcgccgtcgccagacgccgctgtggtggaggagatggcgcgggtggcggcgacgtggtgcgcgatgcacgggctcgtcgtcggggaccgcgcagacccgagatcagggacagttcctggagttgggctggtccatgctccaatatccctgctcccatcgcgtctgccggagtctttctgggagcaggcgtgcgagctggctccgattttcaacgagcttgtggatcgtgtcagcttggatggggatttcctgcaggattccttgtctaaaacaaggcaggttgatgatttcacttcgaggctcttagatattcaccggaagatgatggatacaaacaaggaggagagcattcggttgggattgcaccgatcagattatatgctggattcagaaaccaattctcttcttcaaatagagctcaacactatttcagtatcttttcccgggctttgttccttagtgactgagcttcacaggactttgatcaatcagtatgggaatttattgagtctagacgccaaaagggttcctggaaatgaggcaagccgtcaatttgctggagcattggccagagcatgcgatgagtttaatgttgacagtgccgtagttatgatgattgttcagtccgaagaaagaaatatgtatgaccaatactggctcgtcaaatatttgaaggaatcacatggcataacaactattaggaaaaccttgtcagaggtggaggctgaaggccaggttcttcctgatggaactcttgtggtagatggcaggaaggtcgctgtggtgtattttagagctggttatacaccaaatgattatccttcagaaagagaatggagtgcaaggcttttgatggagcaatcatctgctgtaaagtgtccttcaatatcttaccatttagtagggaccaagaagattcaacaagaactagcaaaacctaatgtgcttgaaaggtttctcaaaaataaggaggaaattgccaatcttcgtcaatgctttgcagggctatggagcttggatgatgaagatgtagtcaaatctgcaatggaaaaccctaacttatttgtcttgaagcctcaacgtgaaggcggagggaacaacatatatggccttgatgtgcgagaggctctaatcagactcaagaaggaaggaggagatgctctgtcagcctacatactgatgcaaagaatctttcccaaagaatctcttgctaatctggtccgaggtggtgttttccatgaagccctcacagtatctgaccttgggatatatggagcctacttgcggaacaaagataaggtgatcatcaatgacaagtgtggttacttgatgcgaacaaaagtttcttcatcagatgaaggaggtgttgctgcaggtttcgctgttctggatagcttatacctgaccgaaaaggtgatacacacatcagtttgacatatttcataacaatgaaccggtcatgtttgaagcgtattagctgtaggtaaatggttctgtgtgatacttcttgggaaattaaaaaataagataaggaaaaacctttgtcgtcaaaaaaaaaaaaaaaaaaaa

SEQ ID NO: 1007 - DNA, 2265 bp, Brachypodium distachyon
gcgcagccccctcccttttcataggaattccaatccccaccacagctataaagttccagcttccaaacattatactcctaactgaaagtgaagctgccaaatatatcccctcaaattacccagaaattctgcgcgcgccccaccactgccggcgatgagcaccgccaagggaaacccgccgtcgccggaccccgcggccgtggaggagatggcgcgggacgcgacagcgtggtgcgcgatgcacggactcgtcgtaggggaccgagctgagcagagatcaggaacagttcctggagttggcttggtccatgctccaatctccctgctcccggcgcgtctcccggaatctttctggagtcaggcgtgcgagttggctcccattttcaacgagcttgtggatcgtgttagcttggatggagatttcctacaggattccttgtccaaaacaaggcaggtcgatgatttcacttccaggctcttagagattcacaggaagatgatggatataaacaaggaggagaatattcgactagggttgcatcgatcagattatatgctggattcagaaaccaattctcttcttcaaatagagatgaatactatctcagtatcctttccagggctttgttccttagtgactaagcttcacagagtcttgattaatcagtatggaaatttattatgtctagactccaaaaggattcctgaaaatgtggcaagccagcaatttgcagaagcattgtccagagcatgggatgagtttagcgttgacagtgctgtagttatgatgattgttcagcccgaagaaagaaatatgtatgaccaatactggattgtcaaatacttgaaggaatcacatggcgtaaccactattaggaaaactttgtcagaggtggaggctgaaggccaggtcctcccagatggaactcttgtggtagatggcaggacggttgctgtggtgtattttagagctggctatacaccaaacgattatccttcagaagcagaatggagtgcaaggctcttgatggaacaatcatctgctgtaaagtgtccttcaatatcataccatttagtggggaccaagaagattcaacaagaactagcaaaacctaatgtgcttgaaaggtttcttgaaaataaggaggaaatagcgaagcttcgtcaatgctttgcagggctatggagcttggatgatgaagagattgtgaaatctgcaattgaaacacctgacttgtttgttttgaagcctcaacgcgaaggcggagggaacaacatatacggtcttgatgtgcgagagactctgatcagactccagaaggaaggaggagatgctctctcagcctacatattgatgcaaagaatctttccaaaagcttctcttgctaatctggtccgtggtggtgtttcccatgaggccctcacaatatctgaacttggcatatatggagcctacttacgcaacaaagataaggtggtcatgaatgaccagtgtggttacttgatgcggacaaaagtttcttcatcagacgaaggtggtgttgctgcaggatttgctgttttggatagtttatacctgaccgacaagtgagataacaaaaggaacaccagctataaattcagcaggcattgacctattatggatttaacattctgttgcatcaccgagatcaacaaagtagctgcgcagtttgctgacagctaccagtgtcaattattacatacaccacaatacaaggggcaaacaataattatggtatgtgtagattacctgtgtatgtacaaagtaataattcttgagaagaaactgatcacggaatgttgactagtattatttcttctggtttatgaatcactatgccctgaattcaaactcaaagccgttgtgctgccaactgtatattagggaggaagtggttctttctgaatttttgtattgtgttcctcttctatttgttgtctcgtcattattgtttcctcgcagcattcttatggtgccatgtgtgcaaaaccatgattgggatggcatgtgtgcaaaaccaagtcactccgctggccactcctttttgagtggggttgagtaccagttatattgaaagttagggtgatcaaacttactcgtttgaagttttggtactccctcggtccaacaaaagatatctcaattgtcaaaatttggatgtatctaaacatgactcggtgtatagatgcattcaaatttagtcaaagttgagacattctttgttggatggagaaaacaaagaa

SEQ ID NO: 1008 - DNA, 2677 bp, Brachypodium distachyon
ggtccaaatatccgcataatgaactaatattgtaagtgtaagatttgaattgataaagagaaagtgaaatttctctgcattttaatcaaccaaaatttctctgaatttcaatgttggaatggaggctgcccaagcagagaaagcgacaggcgcacagactctttacagagaccaatgctgaccctgctacttctgcgcagccccctcccttttcataggaattccaatccccaccacagctataaagttccagcttccaaacattatactcctaactgaaagtgaagctgccaaatatatcccctcaaattacccagaaattctgcgcgcgccccaccactgccggcgatgagcaccgccaagggaaacccgccgtcgccggaccccgcggccgtggaggagatggcgcgggacgcgacagcgtggtgcgcgatgcacggactcgtcgtaggggaccgagctgagcagagatcaggaacagttcctggagttggcttggtccatgctccaatctccctgctcccggcgcgtctcccggaatctttctggagtcaggcgtgcgagttggctcccattttcaacgagcttgtggatcgtgttagcttggatggagatttcctacaggattccttgtccaaaacaaggcaggtcgatgatttcacttccaggctcttagagattcacaggaagatgatggatataaacaaggaggagaatattcgactagggttgcatcgatcagattatatgctggattcagaaaccaattctcttcttcaaatagagatgaatactatctcagtatcctttccagggctttgttccttagtgactaagcttcacagagtcttgattaatcagtatggaaatttattatgtctagactccaaaaggattcctgaaaatgtggcaagccagcaatttgcagaagcattgtccagagcatgggatgagtttagcgttgacagtgctgtagttatgatgattgttcagcccgaagaaagaaatatgtatgaccaatactggattgtcaaatacttgaaggaatcacatggcgtaaccactattaggaaaactttgtcagaggtggaggctgaaggccaggtcctcccagatggaactcttgtggtagatggcaggacggttgctgtggtgtattttagagctggctatacaccaaacgattatccttcagaagcagaatggagtgcaaggctcttgatggaacaatcatctgctgtaaagtgtccttcaatatcataccatttagtggggaccaagaagattcaacaagaactagcaaaacctaatgtgcttgaaaggtttcttgaaaataaggaggaaatagcgaagcttcgtcaatgctttgcagggctatggagcttggatgatgaagagattgtgaaatctgcaattgaaacacctgacttgtttgttttgaagcctcaacgcgaaggcggagggaacaacatatacggtcttgatgtgcgagagactctgatcagactccagaaggaaggaggagatgctctctcagcctacatattgatgcaaagaatctttccaaaagcttctcttgctaatctggtccgtggtggtgtttcccatgaggccctcacaatatctgaacttggcatatatggagcctacttacgcaacaaagataaggtggtcatgaatgaccagtgtggttacttgatgcggacaaaagtttcttcatcagacgaaggtggtgttgctgcaggatttgctgttttggatagtttatacctgaccgacaagtgagataacaaaaggaacaccagctataaattcagcaggcattgacctattatggatttaacattctgttgcatcaccgagatcaacaaagtagctgcgcagtttgctgacagctaccagtgtcaattattacatacaccacaatacaaggggcaaacaataattatgatgagagaatcaaccgggaggaggaagaaacgaatctcataactcactcggccttgaagctgtctcggaagaattgatttgatgcacggctcctccttgtctattcgcatcgccaggaggagctgatggcgcaagcctcaccggtcctctcttcgtttcctctgcgccatggagggggtgtattcatggcgagcgcaaagctagcttatgcatccgtatatgtaggttttggctcagctaattaaataaggcagctgaacccatcatgcatatatatcaaaacttcattggcgccgcatctattcttccctccactttaaaccaattagctgaaagattagcgagctcacgtgtaccacattttcgagatattccttgcgtgaagcgtacgtgatgctctcgagaaacttcagcctcattttccagcgttcgatcctttcccgccccaagcccctttttgcagatatacgagacgctgtgtgatttcaggcgatgcccgagaggcctgaggaggtccggtgcgcgccgttggcccgccctagattttggcacccagaagggcaaacgaaggcctggcccggcccggcccggctaaacagagggtccaacagggcccagccaaacgctcgaccctgcagcaccgcaccgctccgcatcgtggctgcagcgtgaatggactcgtgtagccatgggcggatccaccttaagcccgatgggggctactgta

SEQ ID NO: 1009 - DNA, 2768 bp, Oryza sativa
gttcatcaccggacatattcatgggcgcgtgttctttgccgtacagaacctacagtatggttccccaattgatctctactcacatcaccagacctatgctcaaagtttttgaattttgttcaggagttattgtttcaagggaaaaaaaggaacccaacaattctggatatatctatgtcagactctggtattctaaacttgagttcatgattgggtgcaataccgttttcgagaaaaaaattgattgggtgcaatattgaagccatgaccttattgggcaataaaattccatttcgtaggattactagcagcatgttgagataacttccatgtcaggaaatatggtactatatcagcaagaaaaaaccaactcattgtccacaaacatgagacttggcatgataaatctgtatgattactggtgattgagcccaaacaggtcccaattttctgggcctccttctctaggttgttagatagagatgtttcatctttatttattttgtcagtccttgacagaggaatgtcatgttgaaggtccattgaaccgagacattttcttttgctaatgtcatgcatgatgccattgagatagatgatgtaatattcggattgcattgaaaggaataacatgaccggccaaaaaaacaaggaacatagggcaacattttcctcaaaaagacagaaaatttaggtgcaattttgcatttttgtctctaacgtcaacagataaaaatattcccttactcagtgctaattccagaaatgggtgatggagaaaaaaaaatcgaggcaatgtaaatattatgtgccaaatgttccaaataggtcatgaattcatttatattttatttcaacttctatacaagtacacaacacttaaaatatatttaggctgagtttagttccaaactttttcttcaaacttccaacttttcaatcacatcaaaattttactacacacacaaacttctaatttttccatcatatcgttccaatttcaatcaaacttataattttgacatgaactaaacacacccttaaacaaaatttgattccaaactgacttttttttgctgtgctaaatttattcgagttggaggcgcactcacagaaaagctgaacctgacccttcaactttcgcgcagccccctccactttcctcgaaattgcaactcccacctcaactataaacttcggttcgacagttcggcactcgacaatctcgcagagagagtgaagctgagattgcaatttgcaaatatcccctcgagaaatcataatttgtttttcactccctaatccctctccagtccaccgcccgcgatgagcgccgccgcggaggggaggccggcggcggcggcggcggcgggtgagatggtgcgggaggccaccgcgtggtgcgcgctgcacgggctcgtcgtcggcgaccgcgccgaccctcgatctggaacagtccccggcgttggtttggttcatgctcctttctctctgctcccaacgcatcttccagaatctcattggaggcaggcgtgcgagttggctcctacttttaacgagcttgtggatcgtgttagcttggacggggacttcttgcaagattctttgtctaaaacaaagcaagttgacgatttcacttctaggctgttagagattcataggaagatgatggaaataaataaggaggagaatatccggttggggttgcatcggtcagactatatgcttgattcagagaccaattctcttcttcaaatagagctcaacactatttcagcatctttccctgggcttggttccttagtaagtgagcttcacaggaccttaattgatcagtatggacacttattttgtctagactccaagagggttcctggaaatgaggcaagcagtcaatttgctaaagcattggccagagcatgggatgagtttaatgttgacagtgctgtaattatgatgattgttcagcccgaagaaagaaatatgtatgaccagtactggctcgccaaacatttgaaggaatcacatggcataacgactatcaggaaaactttgtcagaggtagaggctgaaggccacgttctcccagatggaacacttgtcatagatggcaagacagtttctgtggtgtacttcagagctggctatacaccaaatgattatccttcagaagcagaatgggctgcaaggctattgctggaacaatcatctgctgtaaagtgcccttcgatatcataccatttagtggggaccaagaagattcaacaagaattagcaagacctaatgttcttgaaaggtttcttgaaaacaaggaggaaatcacaaagatccgtaaatgctttgcaggactatggagcttggatgatgaagagattgtgaaatccgcaatccaaaaacccgagttgtttgtcttgaagccccaacgtgaaggcggagggaacaacatatacggtattgatgtacgagagactttgatcagactccagaaggaaggaggggatgcgcttgcagcctacatactgatgcaaagaatcttcccaaaagcctctctctctaatctggttcgtggtggtgtttgccatgaggccctcacaatatctgagcttggaatttatggtgcttacttgcggaacaatgataaggtggttatgaatgaacagagtggttacttgatgcggacaaaagtttcatcgtcagatgaaggtggcgttgctgcaggatttgctgttttggatagtttgtacttaaccgacaaggcgatgtagac

SEQ ID NO: 1010 - DNA, 1919 bp, Setaria italica
taaatttgaattcatttcgtttcatccgctgatctgcaaaccaaaccagagcgaggccttaggttgcaattgcagttaccccttccacgaactgccaaactctgcgctcctcctgattggctgattccactgccactacccgcgaggctgcgatgagcgccgccgtgccgccgccggcggatcccgccgcggcgggggagatggcgcgggaggccgccgcgtggtgcgcgctgcacggcctcgtcgttggggaccgcgccgatccgagatcaggaacagtccctggtgtaggattggttcacgctccattctccctgctcccggcgcatcttccagaacccttttggaagcaggcgtgtgagctggctccaatttttaacgagcttgtggatcgtgttagtctggatgggaatttcttgcaagattctttgtccaaaacaaggcaggttgatgatttcacatctaggctcttagagattcacaggaaaatgatggaaataaataaggaggagaatattcgcttagggttgcaccgatcagattatatgctagattcagaaacaagttctcttcttcaaatagagctcaataccatctcaacatcatttcctgggcttggtcccttagtaagtgagcttcacaggaccttaattaatcagtatggacgtgtattgagcctggaaccaaagagggttcctggaaatgcagctagcagtaaatttgcagaagctttggccagagcatggactgagtttgatgttgacagtgctatagttatgatgattgttcagcctgaagaaagaaatatgtatgaccaatactggattaccaaatatttgaaggaatcacatggcataacaactattagaaaaacattgacacaggtggaggctgaagggcatgttctaccagatggaactcttctagtagacggcaagaaagttgctgtggtgtattatagagcaggatatacaccgaatgattatccttcagaagcagaatggagtgcgagacttttgattgaacaatcatcttctgtgaagtgtccttcaatatcatatcaattagtgggaactaaaaggattcaacaagaactggcaaaccctaatgttcttgaaaggttccttgaaaataaggaggacattgctaagcttcgtaaatgctttgctgggttatggagtttggatgatgaagagattattaaaactgcaattgaaaaacctgagttgtttgtattgaagcctcaacgtgaaggcggagggaacaacatctatggtcttgatttgcgagaaacacttaccagactccagaaggaaggaggggatgcgcttgcagcctatatacttatgcaaagaatcttccccaaagcttctcttgcttacttagttcgtggtggtatttgccacgagggtcttgtgatttctgagcttggaatatatggctcttacttgcggagcaaagataaggtgataactaatgaccaatgtggttacttgatgcggacaaaagtttcttcatcggacgaaggcggcgttgctgcggggtttgctgttttggatagtttatacctgactgataagtgaagtagcaaaaggagtgtcagctacagctttcagcaggcttacatcgacaatggattcgacatcatgttctgttctccattgaagatatataggcagcaaatttgctgcggactacagccatgtctgatctgtcatattgtttgatgatttcctactgcctgttcctagggagtggaatatatgtaatatgtgtagattacttctacgtgaaatccatgaaaaataatgacgaataaatacatatgcacaggccattccaataacctgttttctggtctcgtttcttcgatatattgatgtataccatgctgtgtatacatcataatggttgcagtg

SEQ ID NO: 1011 - DNA, 1851 bp, Panicum virgatum
ctccactgactcgtggcgtttatccacagagatcaggttgtcttacagttgcagataccccctcaaggaacgttagaaattctgagcgggacctcgtccaacaacctgcgatgagcgccgccgtgcccgtgcccgcgccgccgcaggtggatcccgccgcggcgagggagatggcgcgggaggccgccgcgtggtgcgcgctgcacggcctcgtcgtcggggaccgcgccgacccgagatcagcaacagtccctggcgttggtttggttcatgctccattctccctgctcccagcacatctcccagaatccgtttggaggcaggcgtgtgagttggctcccatttttaacaagcttgtggatcgtgttagcctcgatgggaagttcttgcaagattctttgtccaaaacaaggcaggttgatgatttcacatctaggctcttagagattcacaggaaaatggtggaaataaataaggaggagaatattcgcttggggttgcaccgatcagattatatgctggatttagaaacaaattctcttcttcaaatagagctcaacaccatttcaacatcatttcctgggcttggatccttagtaagtaatcttcacaggaccttaattaatcagtatggacatctattaagtctggaaccaaagagggttcctggaaatgcggctagcagtaaatttgctgaagcattggccagagcatgggctgagttcaatgttgacagtgctgtagttatgatgattgttcagcctgaagaaagaaatatgtatgatcaatactggcttactaaccatttgaaggaatcacatggcataacaactattaggaaaacattgtcacaggtggaggctgaagggcaggttctcccagaaggaactcttctggtagatggcaagaaagttgctgtggtgtactatagagctggatatacaccaaatgattacccttcagaagctgaatggagtgcaagacttttgattgaacaatcatgcgctgtgaagtgtccttcaatatcgtatcatttagtgggaaccaaaaagattcaacaagaactagcaaagcccaatgtgcttgaaaggtttcttgaaaataaggaggaaattgctaagcttcgtaaatgctttgctggtctatggagtttggatgatgaagagattgttaaaactgcaattgaaaagcctgagttgtttgtgttgaagcctcaacgtgaaggcggagggaacaacatttatggccttgatttgagagaaacacttaccagactccagaaggaaggaggggatgcacttgcagcctatatacttatgcaaagaatcttcccaaaagcttctcctgcttatctagttcgtggtggtatttgccacgagggtcttgtgatttctgagcttggaatatatggcgcttacttgaggaataaagataaggtggtaatcaatgaccaaagtggctacttgatgcggacgaaagtttcttcatcggatgaaggcggcgttgctgcagggtttgctgttttggatagcttatacctgactgacaagtgaggtaacaaaaggagtgtcagctacagctttcagcgagctcacatcgataacccatccaacatcatgctctccattaagcataggcacagaagttgctgcaggctacagccatatcatctgtcatattgtttgatgatttcctactccccgttcctagggagggaataaaacgtgttacgtgtagattacatgtacgtgaaatctatgaaaataatgatgaataatcatatcatgtgtctatcatgccaatgatatctgtgggtgtgcttctgttgaagacacttgtgctgtgcctgtg

SEQ ID NO: 1012 - DNA, 1919 bp, Setaria italica
taaatttgaattcatttcgtttcatccgctgatctgcaaaccaaaccagagcgaggccttaggttgcaattgcagttaccccttccacgaactgccaaactctgcgctcctcctgattggctgattccactgccactacccgcgaggctgcgatgagcgccgccgtgccgccgccggcggatcccgccgcggcgggggagatggcgcgggaggccgccgcgtggtgcgcgctgcacggcctcgtcgttggggaccgcgccgatccgagatcaggaacagtccctggtgtaggattggttcacgctccattctccctgctcccggcgcatcttccagaacccttttggaagcaggcgtgtgagctggctccaatttttaacgagcttgtggatcgtgttagtctggatgggaatttcttgcaagattctttgtccaaaacaaggcaggttgatgatttcacatctaggctcttagagattcacaggaaaatgatggaaataaataaggaggagaatattcgcttagggttgcaccgatcagattatatgctagattcagaaacaagttctcttcttcaaatagagctcaataccatctcaacatcatttcctgggcttggtcccttagtaagtgagcttcacaggaccttaattaatcagtatggacgtgtattgagcctggaaccaaagagggttcctggaaatgcggctagcagtaaatttgcagaagctttggccagagcatggactgagtttgatgttgacagtgctatagttatgatgattgttcagcctgaagaaagaaatatgtatgaccaatactggattaccaaatatttgaaggaatcacatggcataacaactattagaaaaacattgacacaggtggaggctgaagggcatgttctaccagatggaactcttctagtagacggcaagaaagttgctgtggtgtattatagagcaggatatacaccgaatgattatccttcagaagcagaatggagtgcgagacttttgattgaacaatcatcttctgtgaagtgtccttcaatatcatatcaattagtgggaaccaaaaggattcaacaagaactggcaaaccctaatgttcttgaaaggttccttgaaaataaggaggacattgctaagcttcgtaaatgctttgctgggttatggagtttggatgatgaagagattattaaaactgcaattgaaaaacctgagttgtttgtattgaagcctcaacgtgaaggcggagggaacaacatctatggtcttgatttgcgagaaacacttaccagactccagaaggaaggaggggatgcgcttgcagcctatatacttatgcaaagaatcttccccaaagcttctcttgcttacttagttcgtggtggtatttgccacgagggtcttgtgatttctgagcttggaatatatggctcttacttgcggagcagagataaggtgataactaatgaccaatgtggttacttgatgcggacaaaagtttcttcatcggacgaaggcggcgttgctgcggggtttgctgttttggatagtttatacctgactgataagtgaagtagcaaaaggagtgtcagctacagctttcagcaggcttacatcgacaatggattcgacatcatgttctgttctccattgaagatatataggcagcaaatttgctgcggactacagccatgtctgatctgtcatattgtttgatgatttcctactgcctgttcctagggagtggaatatatgtaatatgtgtagattacttctacgtgaaatccatgaaaaataatgacgaataaatacatatgcacaggccattccaataacctgttttctggtctcgtttcttcgatatattgatgtataccatgctgtgtatacatcataatggttgcagtg

SEQ ID NO: 1013 - DNA, 1949 bp, Panicum virgatum
agatcaggttgtcttacagttacagttgcagataccccctcaaggaacgttcgaaattctgaacgggtcctcgtccgacaacctgcgatgagcgctgccgtgcccgtgcccgcgccgccgccggtggatcccgccacggcgggggagatggcgcgggaggccgccgcgtggtgcgcgctgcacggcctcgtcgtcggggaccgcgccgacccgagatcagcaacagtccctggcgttggtttggttcatgctccattctccctgctcccagcacatcttcccgaatccatttggaggcaggcgtgtgagttggctaccatatttaacgagcttgtggatcgtgttagcctcgatgggaagttcttgcaagattctttgtccaaaacaaggcaggttgatgatttcacatctagactcttagagattcacaggaaaatgatggaaataaataaggaggagaatattcgcttagggttgcaccgatcagattatatgctggatttagaaacaaattctcttcttcaaatagagctcaacaccatttcaacatcctttccagggcttggatccttagtaagtgatcttcacaggagcttaattaatcagtatgtacatctattaagtctggaaccaaagagggttcctggaaatgcggctagcagtaaatttgctgaagcattggccagagcatgggctgagttcaatgttgacagtgctgtagttatgatgatcgttcagcctgaagaaagaaatatgtatgaccaatactggcttactaaccatttgaaggaatcatatgggataacaactattaggaaaacattgtcacaggtggaggccgaagggcaggttctccctgatggaactcttgtggtagatggcaagaaagttgctgtggtgtactatagagctggatatacaccaaatgattacccttcagaagctgaatggagtgcaagacttttgattgaacaatcatgcgctgtgaagtgcccttcaatatcgtatcatttagtgggaaccaaaaagattcaacaagaactagcaaagcccaatgtgcttgaaaggtttcttgaaaataaggaggaaattgctaagcttcgtaaatgctttgctggtctatggagtttggatgatgaagagattgttaaaactgcaattgaaaagcctgagttgtttgtgttgaagcctcaacgtgaaggcggagggaacaatatttatggccttgatttgagagagacacttaccagactccagaaggaaggaggggatgcacttgcagcgtacatacttatgcaaagaatcttcccaaaagcttctcttgcttatctagttcgtggtggtatttgccatgagggtcttgtgatttcggagcttggaatatatggtgcttacttgcggaacaaagataaggtagtaatcaatgagcaaagtggctacttgatgcggacgaaagtttcttcatcagatgaaggcggcgtcgctgcagggtttgctgttttggatagcttatacctgactgacaagtgaggtaacgaaaggagcctcagctacagctttcagcaagcttacatcgacaactgattcaacatcatgttctccattaaacaatgccggagaagctgctgcaggctacagccatatctcatctcgtttgatgatttcctactgcccgttcctagggagagaataagtgtattatgtgtggcttgcatgtacatgaaatccatgaaaacaatgatgaacaatcatgttatatgtagatcatgccaatgacctgcgcaggataatctcagccgcttgctcggcccattgccaaacacagactaactccttcgtgtataccatgcaaacttcaatctggaccaccggatcaacaggaagaaaaggaactggatcttcctctcaatcagctccgcctcttctggtgagcaatcaccacgggcacc

SEQ ID NO: 1014 - DNA, 1709 bp, Cenchrus ciliaris
ctccgcgatcctcctgattggctgattgcgctgccccccaaccggcgaggctgcgatgagcgccgccgccgtgccgccagcggtggatcccgccgcggcgggggagatggcgcgggaggccgccgcctggtgcgcgctgcacggcctcgtcgtcggggaccgcgccgacccgagatcaggaacagtccctggtgtaggattggttcacgctccattttccctgctcccggcgcatcttccagaacccttttggaagcaggcctgcgagctggctccaatttttaacgagcttgtggatcgtgtcagtctggatgggaaattcttgcaagattctttgtccaaaacaaggcaggttgatgatttcacatctaggctcttagagattcacaggaaaatgatggaaacaaataaagaggagaatattcgcctggggttgcaccgatcagattatatgctggattcagaaacaaattctctccttcaaatagagctcaatactatctcaacatcatttcctgggcttggtcccttagtaagtgagcttcacaggaccttaattaatcagtatggacatgtattgagtctggaaccaaagagggttcctggaaatgcggctagcagtaaatttgcagaagcattggcgagagcatggactgaatttgatgttggcagtgctgtagttatgatgattgttcagcctgaagaaagaaatatgtatgaccaatactggattaccaaatatttgaaggaatcacatggcataacaactattaggaaaacattatcacaggtggaggatgaagggcaggttctaccagatggaactcttctggtagatggcaagaaaatcgctgtggtgtattatagagcgggatatacaccgaatgattatctttcagaagcagaatggagtgcaagacttttgattgaacaatcatctgctgtgaagtgtccttcgatttcatatcatttagtgggaaccaaaaagattcaacaagaactagcaaagcctaatgtgcttgaaaggttccttgaaaataaggaggacattgctaagcttcgtaaatgctttgctgggttatggagtctagatgatgaagagattattactactgcaattgaaaaacctgatatgtttgtactgaagcctcaacgtgaaggcggagggaacaacatctatggccttgatttgcaagaaacacttactagactccagaaggaaggaggggatgggcgtgcagaatatatacttatgcaaagaatcttcccaaaagcttctcttgcttatctagttcgtggtggtatttgccacgagggtcttgtgatttctgagcttggaatatatggtgcttacttgcggagcaaagataaggtggtaactaatgaccaatgtggttacttgatgcggacaaaagtttcttcatcggacgaaggtggtgttgctgcggggtttgctgttttggatagcttatacctgactgataagtgaagcagccaaaggagtgtcagctacggctttcagcaggctttacatcgacattggattcgacaccatgagctgttgttctccattgaagataggcagcaaatgtattatgtattgtacatgcaatccatgaaaataaatgactgatgaatatgcacgtcattccatgctgtgtatacatcaaaaattcataatggttgcagtgatcctttgtttcaaaaaa

SEQ ID NO: 1015 - DNA, 2836 bp, Sorghum bicolor
tctctctctcctcttctgttgttgaaaagatgtagaaatttttttctcttctgttgttgaaaagatgtagaatttttttgttgttccgatccgatgatgcgagtgcgacggcgaggcggcataaagcaggagaaggcgattggcagtggcaacactctttttttttttttccttttgtaaaggtaaagaaagggtagccaatttgacttgagtctgctgccacttccgcgcagccccctccctccactgcgatcggaatctgaaatccataaccacaccagagagagattgattgccatcgctcctccctccacctctgcgctccacctgattgattatcaattggttccactgctgcggcaacctgcgatgagcgccgcggtgccgccggcgatggaccccgcggcggcgggggagatggcgcgggaggccgccgcgtggtgcgcgctgcacggcctcgtcgtcggggaccgcgccgaccagagatcagcaacagtccctggtgttggtttggttcatgctccattctccttgctcccagcacatcttccagagcccttttggaggcaggcgtgcgagctcgctcccatttttaacgagcttgtggaccgtgttagcatggatgggaatttcttgcaggatgctttgtccaaaacaaggcaggttgatgatttcacatctaggctcttagaaattcacaggaaaatggtggaaataaataaggaagagaatattcgcttagggttgcatcgatcagattatatgctggattcagaaacaagttctcttcttcaaatagagctcaacaccatttcagcatcatttcctgggcttggttccttagttagtgatcttcacaggaccttaattaaacagcatgggactttattaggtctggaacacaagagggttcctgcaaatgcggctaacactcagtttgctgaagcattggcccaaacatgggctgagtttaacattgacagtgctgtaattatgatgattgttcagccagaagagagaaatatgtatgatcaatactggctttcaaagcatttgcaagactcacatggcataacaactataaggaaaaccttatcgcaggtggaagctgaaggccagattctcccagatggaactcttcttgtaggtggccacaaagttgctgttgtgtactatagagctggctatacaccaaatgattatccctcagaagcagaatggagtgcaagacttatgatggaacaatcatctgctgtaaagtgtccttcaatatcgtatcatttagtgggaaccaaaaagattcaacaagaactagcaaagcctaatgtgcttgaaaggttccttgaaagtaaggaggaaattgacaaggttcgcaaatgttttgctgggctatggagtttggatgatgaagagattataaaaactgcagtggaaaaacctgagttgtttgtattgaagcctcaacgtgaaggcggaggaaataacatctacggtcttgatttgagggaaacacttgtcagacttcagaaggaaggaggggatgcacttgcagcctacatactgatgcaaagaatctttccaaaagcttctcttgcttatctggttcgtggtggtgtttgccacgagggtcttgcaatttctgagcttggaatatatggagcttatctgcggaacaaagataaagtggtcatcaatgaacaatctggttacttgatgcggacgaaagtttcttcatcagatgaaggtggcgtagctgcagggtttgctgttttggatagcttatacctgactggcaagtgagattagataacaaaaggagcgtcagctacagctctcagtggagggcatacaccgacaatggatcatcatgttctgcatttagatcggcagagaataagttgctgcaaactagtgccatttctgtgacaccacgtcacaatattgtttgatgaattccttctctgtccctgcgaaagggagagaatagacatattattacgagtagatcaaatgtgcatgaaatacatggaaataatgaaggataaaccacgtgcccgtagctgtgatgtaggccggcggtgccgtttcttttcctgatcaccttgacagcgatggaaattctgtgtttccgttgaagacacatggtgtgcatgtgcaccatcactgtgaattttaaccattggcaacggcagcaaaagagtattgagttgtaagacagcatagcgcgataaatctgcagctcattccttgatgtactctgggcagagcaggcagagagatgtgttatggtgtgtttggttgccttggttatcctagattggctagttctatgcaacatgttgcctggattgtctctaagcctgcattagaaggtgtgtgtttggttgttgtctgacttaattagcttgcatagaatcatcttatctcggggaaggtaagtttactcctctcaccacaatgtatcggacacttggtgggcgtgtgctgctggtggtggtggacatgcgcctcgaggctggcgcggtgaggttggacaaggtggcgcctgcggttgccggggcaggacaaggtggcggcggcagactgcccagctaggcggccttgcggctgccgagtatgggaagcgttgacgtcttccaaaagggtgcgtgcaagggtgaggtggctggcttggccggtggagacgtggagcttgatcggaggcggggacgacggtgctcgcgtgtcgtgtggtggctagcgacaaggaagacgcggaggtcatgtggagacgaggaagtgaaaggttctaatatagctagagcggtgaataacctatttaaaaattttacaaaac

SEQ ID NO: 1016 - DNA, 2296 bp, Zea mays
ggcctgccagttccgcgcagccccctccaaatccatcgataaaacacacaataaatcaataataaccagagagtcagtttgcgtggattgccatcgccccttcctccacctctgcgctccaccacctaataattgattccactgccaatacctgcgatgagtgccgccatgccgccggcgatggaccccgcggcggcgggggagatggcgcgggaggccgccgcgtggtgctcgctgcacggcctcgtcgtcggggaccgcgccgaccagagatcagcaacggtccctggtgttggtttggtccatgctccattctccttgctcccagcacattttccagagtccttttggaggcaggcgtgcgagctcgctcccgtttttaacgagcttgtggaccgtgttagcatggacgggaatttcttgcagaatgctttgtccaaaacaaggcaggttgatgatttcacatctaggctcttggaaattcacaggaaaatgatggaaataaataaggaagagaatattcgcttggggttgcaccgatcagattatatgctggattcagaaacaagttctcttcttcaaatagagctcaacaccatttcagcatcatttcctgggcttggttccttagttagtgatcttcacaggtccttaattaaacaatatgggacttctttaagtctagaacacaagagggttcctgcaaatgcggctagcactcaattttctgaagcattggcccaagcatggtctgagtttaatattgacagtgctgtaattatgatgattgttcagccagaagagagaaatatgtatgatcaatactggctttccaaacatttgcaagactcacatggcataacaactataaggaaaaccttatcgcaggtggaagcggaaggccaggttctcccagatggaactcttcttgtaggtggccagaaagttgctgtagtgtattttagagctggctatgcaccaaatgattacccttcagaagcagaatggagtgcaagacttatgatggaacaatcatctgctgtgaagtgcccttcaatatcatatcatttagtgggaaccaaaaagatacaacaagaactagcaaagcctaatgtgcttgaaaggttccttaaaagtgaggaaattgacaaggttcgcaaatgttttgctggcttatggagtttggatgacgaatatattataaaaactgcagtggaaaaacctgagttgtttgtattgaagcctcaacgtgaaggcggagggaacaacatctacggtcttgatttgagggaaacgcttgtcagactacagaaggaaggaggggatgcgcttgcagcctacatactgatgcaaagaatcttcccaaaagcttctcctgcttatctcgttcgtggtggtgtttgccacgagggtcttgcaatttctgagcttggaatatatggagcttatctgcgtaacaaagataaagtggtgatcaatgagcaatgtggttacttgatgcgaacgaaggtttcttcatcagacgaaggtggcgtagctgcagggtttgctgttttggatagcttatacctgactggcaagtgagataacaaaaggagcggcggctacagctttcggttgggggcatacaccgtcaatggatcatcatgtcctccatttagatcgacacagaataagctgctgcaaactagagccattatgtgacaccatgtcacgttgtttgatgaattccttctatctgcccctgccaagggagagaagagaatagacatattattgtgtgtagattaaatgtgcatgaaatccatggaaatggtgaaggatgaaccacgtgcccataaccgtgatgtaggctggcggtgccgtttcttgttcttgatcaccttgacagcaacggggaattctgtgtttcttttgaggacacgtgatgtgcaccatcagtatgaatgtaaccaaagaataagggcctatttagtttatgactaactatgtcatattttgtctaaagttagttgttcgaattgaaaaactaattttagtcacaaaagtatgataaatgtggcaaattagacagcgaatcaaacatgctctaaatctaccgctcattccttccagtactaactgttcatacaaaatttggtgcacagatgcttgtcaaggaagaggggcttggagaggaaataaaatatgagatgcctaaggcttgggtgcagttcactggtttacctaaggaacttagagagtactcagtaatctgggcggttggttctatgctaggcatctcaaaagaggtgga

SEQ ID NO: 1017 - DNA, 1575 bp, Solanum phureja
gttttggttggaatcaataataaatatcaagaagatcgttgttggccacaaattagttagaaacagagtgccaaaagagcaaaggctaagggctgtagaatcatacacttctcttatcctcacatccaatctcctccacccaattcataatccactacccaatctctactaaaaacatcccaattcccatttctccttatttttccttcttcaccaatcccccctcttaattctctgtattcataattcataaacatggctactgcagtaagtgctgcagtttctcttccttcatccaagtccacctctttttcctctagaacctccatcatctccactgacaaaatcaacttcaacaaggtgcctttgtactacagaaatgtgtctggtggtagtagattagtttctatcagagcccaagtgaccactgaggctcctgctaaagttgagaagatttcaaagaaacaggatgaaggtgtgattgtgaataaattcaggccaaaggaaccttatgttggtagatgtctactaaacactaagatcactggtgatgatgcacctggtgaaacttggcacatggtttttagcactgagggagaggtcccatatagagaaggacaatccattggtgtgattgctgatggtgttgatgccaatgggaagcctcacaagcttagattgtactcaattgctagcagtgcccttggtgacttcggtgactccaaaaccgtttccctgtgtgtcaagaggcttgtgtacaccaatgacaaaggggaagaagttaaaggagtttgctcaaacttcttatgtgacttgaagcctggagcagaggtcaagattactggacctgtaggcaaagaaatgctcatgcctaaagatccaaatgccaccgttataatgcttgccactggaactggaattgctcctttccgttcattcctgtggaaaatgttctttgagaaacacgaggactacaagttcaacggtaccgcatggcttttcttgggtgttcccaccagcagctcactactttacaaggaggaattcgagaaaatgaaggagaaggccccagaaaacttcagattggactttgctgtgagcagagagcaaacgaacgaaaagggtgaaaagatgtacattcaaaccagaatggctcaatatgctgaagaactatggactttgctccaaaaagacaacaccttcatctacatgtgtggactcaagggcatggagcagggaattgatgaaattatgtctgctcttgctgaaagagatggtattgtctgggcggactacaagaagcaattgaagaaggcagagcaatggaatgttgaagtctactaaatatttttacttttctttgtacaaatatgagccaccaactttatgcttctctccccctgcatccatgtagataggtaaatttttcctttgaaattttaatttcattttttgggacttccctttttaaatctttcatctgtatcttttaatgaatcagtatattcgcatttgtccctctaaaaagttcaattttgagggtctgggtctcaataacatatagctgaatcaacc

SEQ ID NO: 1018 - DNA, 1500 bp, Solanum tuberosum
aaagagcaaaggctaagggctgtagaatcatacacttctcttatcctcacatccaatctcctccacccaattcataatccactacccaatctctactaaaaacatcccaattcccatttctccttatttttccttcttcaccaatctcccctcttaattctctgtattcataattcataaacatggctactgcagtaagtgctgcagtttctcttccttcatccaagtccacctctttttcctctagaacctccatcatctccactgacaaaatcaacttcaacaaggtgcctttgtactacagaaatgtgtctggtggtagtagattagtttctatcagagcccaagtgaccactgaggctcctgctaaagttgagaagatttcaaagaaacaggatgaaggtgtgattgtgaataaattcaggccaaaggaaccttatgttggtagatgtctactaaacactaagatcactggtgatgatgcacctggtgaaacttggcacatggtttttagcactgagggagaggtcccatatagagaaggacaatccattggtgtgattgctgatggtgttgatgccaatgggaagcctcacaagcttagattgtactcaattgctagcagtgcccttggtgacttcggtgactccaaaaccgtttccctgtgtgtcaagaggcttgtgtacaccaatgacaaaggggaagaagttaaaggagtttgctcaaacttcttatgtgacttgaagcctggagcagaggtcaacattactggacctgtaggcaaagaaatgctcatgcctaaagatccaaatgccaccgttataatgcttgccactggaactggaattgctcctttccgttcattcctgtggaaaatgttctttgagaaacacgaggactacaagttcaacggtaccgcatggcttttcttgggtgttcccaccagcagctcactactttacaaggaggaattcgagaaaatgaaggagaaggccccagaaaacttcagattggactttgctgtgagcagagagcaaacgaacgaaaagggtgaaaagatgtacattcaaaccagaatggctcaatatgctgaagaactatggactttgctccaaaaagacaacaccttcatctacatgtgtggactcaagggcatggagcagggaattgatgaaattatgtctgctcttgctgaaagagatggtattgtctgggcggactacaagaagcaattgaagaaggcagagcaatggaatgttgaagtctactaaatatttttacttttctttgtacaaatatgagccaactttatgcttctctccccctgcatccatgtagataggtaaatttttcctttgaaattttaatttcattttttgggacttccctttttaaatctttcatctgtatcttttaatgaatcagtatattcgcatttgtccctctaaaaagttgaattttgagggtctgggtctcaataacatatagctgaatcaaccc

SEQ ID NO: 1019 - DNA, 1437 bp, Solanum melongena
acccaattcttaatccactacccaatctctactaaaaacatcccatttcccctcactcctcatttttcctccttcacccttccctcattatcatcaattccatttctctgtaaacatgtctgctgcagtaactgctgcagtttctcttccttcatccaactccacctcttttcccactagagcctccatcatctcctcagataaaatcaacttcaataaggtgcctttgtactacagaaatgtgtcaggtggtaacagattagtttctatcagggctcaagtcaccacagaggctcctgctaaagttgagaagatttcaaagaaacaggaagaaggtgtggttgtcaacaaatttaggccaaaggaaccttacgtcggtagatgtctactcaacactaagatcaccggtgatgatgcacctggtgaaacttggcacatggtctttagtactgagggagaggtcccatatagagaaggccaatccattggtgtgattgctgatggtgttgatgccaatgggaagcctcacaagcttagattgtactccattgctagcagtgccattggtgacttcggtgactccaaaaccgtttccctatgtgtcaaaaggctcgtgtacaccaacgacaaaggggaggaagttaaaggagtttgctcaaacttcttatgtgacttgaagcctggagcagaggtcaagattactggacctgttggcaaggaaatgctcatgccaaaagatccaaatgccactgttataatgcttgccactggaactggaattgctcctttccgttcattcttgtggaaaatgttctttgagaaacatgaggattacaagttcaacggtttggcatggcttttcttgggtgttcccaccagcagctcactactttacaaggaggaattcgagaaaatgcaggagaaggctccggataacttcagattggactttgcggtgagcagagagcaaacaaatgaaaagggggaaaagatgtacattcaaaccagaatggctcaatatgctgaagaactgtggagtttgctcaagaaagacaacaccttcatctacatgtgtggtctcaagggcatggagcagggaattgatgacattatgacttcacttgctgaaagagatggtattgtctgggcggactacaagaagcagttgaagaagtcagagcaatggaatgttgaagtctactaaatatttttacttttctttgtacaaatatgacccaactttatgcttctctcccttgcatccatgtagataggtaaaattttcctttgaaattataatttcattttttgggatttgcctttttgatctttcatctgtatctcttaatgaatcagtgtattggcatttgtccctctaaaaagttgaattttgagggcctagatcaataacatatagctgaatcaaacttctgtcag

SEQ ID NO: 1020 - DNA, 1573 bp, Nicotiana tabacum
cggggacacacaataaaaacacaatcgcgaaaagacatgaggctagaggctcaagaatcatacacttctcttatcttcacatctcccacccttcaaatctcctccacccaatcctttaatccactagataccctctctaaaaagatcccaactccccttctccttatttttccttcttcaccattaccttattatcaattccctcctcttaattttttattccattttttattatctcaaacatggctgctgcagtaagtgctgcagtttctcttccatcatccaagtctacctcttttgccaccagaacctccatcatctccccagaaaagatcaacttcaacaaggtgccgttgtactacagaaatgtgtcagctggtagcagagtggtttcaatcagagcccaggtgacaacagaggctcctgctaaagttgagaagatttcaaagaaacaggatgagggtgtagttgtgaacaagttcaggccaaaggaaccttacattggtagatgtctactcaacactaagatcactggtgatgatgctcctggtgaaacttggcacatggtcttcagcactgagggagaggtcccatacagagaaggacaatccattggtgtgattgctgatggtgttgatgccaatgggaagcctcacaaactcagattgtactccattgctagcagtgcccttggtgacttcggcgactccaaaaccgtttctctgtgtgtcaaaaggcttatctacaccaatgacaaaggggaagaagttaaaggagtttgctcaaacttcttatgtgacttgaagcctggagcagaagtcaagattactggacctgttgggaaagaaatgctcatgcctaaggatccaaatgccaccgttgttatgcttgcaactggaactggaattgctcctttccgttcattcttgtggaaaatgttctttgagaaacatgaggattacaagttcaacggtttggcatggcttttcttgggcgttcccaccagcagctcactactttacaaggaggaattcgagaaaatgaaggagaaggccccggaaaactttagactggactttgcagtgagcagagagcaaacaaacgaaaaaggcgaaaagatgtacatccaaaccagaatggcacaatatgcagaagaactatggggtctgctacagaaagacaacacctttgtctacatgtgtggactcaagggcatggagtccggaattgatgacattatgacttcacttgctgctagagatggtattgtatgggcggactacaagaagcaattgaagaaggcagagcaatggaatgtggaagtctattaaatattttttactttcctttgtacaaatatgagccaactttatgcttctctcccctgcattgtagataggtaaatttttcctttgaaatttatttttatattttttttggattttcccttttctgaaatttcaactttaaatgaatcagtgtattggcattggccctctaaaagttgtattttgaggggcatggatcaataacatatagctgaatcaatctcaatcgcagtctctttatctct

SEQ ID NO: 1021 - DNA, 1615 bp, Nicotiana benthamiana
cacacactaaaaacacaatcgcgaaaagacacgaggctagaggctctagaatcatacacttctcttatcttcacatctccaatccttcaaatctcctccacccaatcctttaatccactagctaccctctctaaaaagatcccaactccccttctccttattttccttattcaccattaccttattatcaattccctcctcttaatattttgttccatttcttgatatctcaaacatggctgctgcagtaagtgctgcagtttctcttccatcatccaagtccacctcttttcccaccagaacctccatcatctccccagaaaagatcaacttcaacaaggtgcctttgtactacagaaatgtgtcagctggtagtagagtggcatcaatcagagcccaggtgaccacagaggctcctgctaaagttgagaagatttccaagaaacaagatgagggtgtagttgtgaacaagttcaggccaaaggaaccttacattggtagatgtctactcaacactaagatcacgggtgatgatgctcctggtgaaacttggcacatggtcttcagcactgagggagaggtcccatacagagaaggacaatccattggtgtgattgctgatggtgttgatgccaatgggaagcctcataagctcagattatactccattgctagcagtgcccttggtgacttcggcgactccaaaaccgtttctctgtgtgtcaaaaggcttatctacaccaatgacaaaggggaagaagttaaaggagtttgctcaaacttcttatgtgacttgaagcctggagcagaggtcaagattactggacctgttgggaaagaaatgctcatgcctaaggatccaaatgccaccattgttatgcttgcaactggaactggaattgctcctttccgttcattcttgtggaaaatgttctttgagaaacatgaggattacaagttcaacggtttggcatggcttttcttgggtgttcccaccagcagctcgctactttacaaagaggagttcgagaaaatgaaggagaaggccccagaaaactttagactggactttgcagtgagcagagagcaaacaaacgaaaaaggcgaaaagatgtacatccaaaccagaatggcacaatatgcagaagaactatggggtctgctacagaaagacaacaccttcgtctacatgtgtggactcaagggcatggagtctggaattgatgacattatgacttcacttgctgctagagatggtattgtatgggcggactacaagaagcaattgaagaaggcagagcaatggaatgttgaagtctactaaatatttttggttttctttgtataaatatgagccaactttatgcttctctacccttcatccatgtagataggtaaatttttccttttaaattaattttcatttttttttggattttccttttcttgaaatttcatcattaaatgaatcagtgtattgacattggccctgtaaaaggaattgacggcatgtatcaataacatatagctgaatcaacctcaattgctgtctgtttatctctatttgtcactgctttctgattatacgggataagcatatgttgtatattcaatt

SEQ ID NO: 1022 - DNA, 1418 bp, Nicotiana benthamiana
ctccccttcttattatttttccttcttcaccattaccttattatcatttccctcctcttaatttttgttccattttttattatctaaaacatggctgctgcagtaagtgctgcagtttctcttccatcgtccaagtccacctcttttcccaccagaacctccatcatctcccctgaaaagatcagctttaacaaggtgcatttgcactacagaaatgtgtcagctggtagtagagtggtttcaatcagagcccaggtgaccacagaggctcctgctaaagttgagaagatttccaagaaacaagatgagggtgtggttgtgaacaagttcaggccaaaggaaccttacattggtagatgtctactcaacactaagatcactggtgatgatgctcctggtgaaacttggcacatggtatttagcaccgagggagaggtcccatacagagaaggacaatccattggtgtgattgctgatggtgttgatgccaatgagaagcctcacaaactcagattgtactccattgctagcagtgcccttggtgacttcggcgactccaaaaccgtttctctgtgtgtcaaaaggcttatctacaccaatgacaaaggggaagaagttaaaggagtttgctcaaacttcttatgtgacttgaagcctggagcagaagtcaagataactggacctgttgggaaagaaatgctcatgcctaaagatccaaatgccaccattgttatgcttgcaactggaactggaattgctcctttccgttcattcttgtggaagatgttctttgagaaacatgaggattacaagttcaacggtttggcatggcttttcttgggtgttcccaccagcagctcactactttacaaagaggaattcgagaaaatgaaggagaaggcccccgaaaacttcagactggactttgcggtgagcagagagcaaacaaacgaaaaaggcgaaaagatgtacatccaaaccagaatggcacaatatgcagaagaactatggggtctgctacagaaagacaacaccttcgtctacatgtgtggactcaagggcatggagtctggaattgatgacattatgacttcacttgctgctagagatggtattgtatgggcggactacaagaagcaattgaagaaggcagagcaatggaatgtggaagtctactaaatatttttggttttctttgtataaatatgagccaagtttatgcttctctacccttcatccatgtagataggtaaatttttccttttaaattaatttttatttttttttggattttccttttcttgaaatttcataattaaatgaatcagtgtattgacattggccctctaaaagttgaactgagggcatggatcaataacatatagctgaatcaaccactattactgtccgtttatctc

SEQ ID NO: 1023 - DNA, 1513 bp, Ipomoea nil
gattatttggtaagggtatgaatcagagaatcaaatgtgatggttttatgtccacagagtgagtgagcaatcacttgagaatcatacatttacttatcctcacacctgccactgccttagcctctcaaatatcctccactcaatccttaatcctttcactcccactaaaacatcccccaccctctccctcttttcctcccactattcccttaccatttgatctctttactatactgtttttcctctccatttattacagaaatggctgctgcagtgagtgctgcagtctctcttccatcatcaaagtccacctctcttgctagcagaacctctatcatctcccctgaaaaaatctgcttcaacaaggtgcctttgtactatagaaatgtgtcatctggtgggaaactggtgcccattagagctcaggtaactactgaggctcctgccaaggttgagaagatctccaagaaacaggatgagggtatagtaaccaacaagttcaagccaaaagagccttacatagggagatgccttcttaacaccaagatcactggagatgatgcccctggtgaaacttggcacatggtcttcagcactgagggggaagtcccttacagagaaggacaatctattggggttattgctgatggagttgacgccaatgggaagcctcacaagttgaggttgtactcaattgccagcagcgcccttggcgactttggagactccaagactgtttctctgtgtgtcaaaaggcttgtctacaccaatgacaagggtgaaatcgttaaaggagtttgctcgaactttttatgtgacttgaaaccgggagctgaagtgaagattactggacctgttgggaaggagatgctcatgcccaaggatcccaacgccacggttataatgcttgccactggaactggaatagcccctttccgctcattcttgtggaagatgttcttcgagaagcacgaagactacaagttcaacggcttggcgtggcttttcttgggtgttcccacaggcagctctttgctctacaaggaggaattcgagaagatgaaggagaaggctcccgagaacttcaggctggactttgcggtgagcagagagcaaacgaacgagaaaggcgagaaaatgtacatccaaaccagaatggcgcaatacgccgaagagctgtgggagttgctgaagaaagacaacacatttgtgtacatgtgtggactgaagggcatggagaagggaattgatgacattatgacctcacttgctgctagagatgggattgactgggcagaatacaagagaacactgaagaaggcagagcaatggaacgtggaagtctactaaattttttgctgtaatgtacaaaattccggccattgtcttaatgtcttatgtgctttttcttttcctctactacatccatgtagatagatcacataacaacaactctcctttgtaattttgtattcctataaaattttcctcttctccatctacatctccatca

SEQ ID NO: 1024 - DNA, 1429 bp, Carpinus betulus
tggggggcggtgagaagtgggtgtagagtcattacattacacatagacttatcctcacatctaccactgcattagccttacaatctcctccactcaatctcataatccagtgccacccaaaaagatcctacccctctctttgtcgggcttattcaccaacacttcactaccccaaaataccatttcttgctttctcctgctgtagctccatctgcatcacaaccatggctactgcagtgactgctacggtctcctttccatcctccaagtctgcttctctgtcctccagaacctctattatctcaccagaaagagtatccttcaagaaggttccattgcagtacagggatgtttctgttggcggaagagctgtttcaatcagagcccaggtcaccacagaggctcctgctaaggttgagaaggtgtccaagaaaatggaggaaggtgtggtggtgaacaagtacagaccaaaggaaccttacgttggcagatgcctcctcaacactaagattaccggcgatgatgctcctggagaaacctggcacatggtcttcagcactgagggagaggtcccctacagagaagggcaatcaattggggtaattgcagatggtattgacaagaacggaaagcctcacaagctgaggttatactcaattgccagcagtgccattggtgactttggagactccaaaactgtttctctttgtgtgaaacggcttgtgtacaccaatgacaaaggagagattgttaaaggagtctgctcaaatttcttgtgtgacctgaaaccgggagctgaagtaaagattacaggaccagttgggaaagaaatgcttatgccaaaagatcccactgccaccgtcgtcatgcttgcaactggaactggcattgctcctttccgctcatttttgtggaaaatgttctttgagaagcatgaggactacaagttcaatggtttggcgtggctcttcttgggtgttcccacgagtagctcactgctttataaggaggaatttgagaaaatgaaggagaaggcccccgagaattttagacttgactttgccgtgagcagggagcaaacaaatgagaaaggagagaagatgtacattcaaacccgaatggctcagtatgcagaagagctatggcagttgcttaagaaggacaacacctttgtctatatgtgtggactgaaggggatggaaaagggaatcgacgacataatggtgtcattggctgctagagatggcattgattggttggattacaaaaagaagttgaagaaggcagagcaatggaatgtggaagtctactaatgcctgcttacctgtacaaatttctcccatttcactttaaagtggcaaccattcaatgatttccactgcgttctgtacataggcaatcgtctttgtaatttttgtattgatatagc

SEQ ID NO: 1025 - DNA, 1441 bp, Glycine max
tctcaaccaccctatcttaaaatcttctgtgcaaccagaaaaaaacggaccttgccctcagtctcttttttccatcatcacttcattaaacattattcactctctttctctgtctctagtttttacaacatggctactgcggtaactgctgcagtgtcctttccagccaccaagtccacttctctttcaagcagaacctctatcactgccccagatagaattgtcttcaagaaggtttcgttgcaatacagagatgtttcaaccagtggaagggtagtttcaatcagagcacaagtgaccacagaggcacctgctaaggttgaaaaggaatcaaagaaacaggaggaaggtgtgatcgtgaacaagttcaaacccaagaacccatatattggtaggtgtcttctcaacacaaagatcactggggatgatgcacctggagaaacttggcacatggtcttcagcactgagggagaagttccttacagagaaggacaatcaatcggggtaattcctgatggggttgacaagaatggcaagcctcacaagctgagattgtattcaattgctagcagtgcccttggtgattttggagattccaaaactgtttctttatgcgtgaaacgtcttgtgtacacaaatgaaaacggagaacttgtcaaaggagtttgctcaaatttcttgtgcgacttgaagccaggagccgaagtaaagattactggacctgttggtaaagaaatgcttatgccaaaagatcctaatgcaaccgtcatcatgttggcaactggaacaggaattgccccattccgctcatttttatggaaaatgttctttgagaagcatgatgattacaagttcaatggtttggcatggctcttcttgggtgtccccacaagcagctcactactttataaggaggaatttgaaaagatgaaggagaaagcacctgacaacttcaggcttgactttgctgtgagcagagagcaaacaaacgaaaaaggagagaaaatgtacatccaaacacgaatggctcaatatgcagaagagttatgggaattactgaagaaagataacacttttgtctatatgtgtggactgaagggaatggaaaagggtatagatgacataatggtttcattggctgcaaaagatggtattgattggattgagtacaagaggcaattgaagaaggcagagcaatggaatgtcgaagtctactaattaatatcacttgcacttgctcagatatcatgccctactttgtgcagcagcaaatctattttgctgtcatgcgctgtgtagatagattacggccctgtaatttttctatgatgggattttttaccttccttatgaacgtacaagcttcattgcaacagccttgcatgaaataattttgaggatctatcaatatagatgaagtcaacttctgtttacaaatttc

SEQ ID NO: 1026 - DNA, 1455 bp, Vitis vinifera
acccctttctttttcttcttcaccaacacccccctctttagtcacccccctcttttctccccaaaacttctttcttctcctcatcccattccttattcagcctcacaacaatggctactgcagtcactgctgcagtctctcttccctcctctaagactacctctctttcagccagaacctccatcatctcaccagaaagaatcagccttaagaaggttcctttgttttacagagatatctctgccggtgggagagtggtttctatcagagcccaggtcaccactgaggctcctgccaaggtcgagaagatttccaagaaaaatgaggaaggagtgattgttaacaagtttaagcctaagaatccttacattggcagatgtcttctcaacactaagatcaccggggatgatgctcctggagaaacatggcacatggtcttcagcaccgagggagaagttccctacagagaagggcaatccattggggtaattgcagatggtgttgacaagaatgggaagcctcacaagctgagattgtactcaattgcaagcagtgcccttggtgactttggagactccaaaactgtttctctttgtgtgaaacggcttgtctacaccaatgagaatggggaactagttaagggagtctgctcaaatttcttgtgtgacttgaagcctggggccgaagtgaagattacagggcctgtggggaaagaaatgcttatgccaaaggatccaaatgccacaatcataatgcttgcaactggaactggaattgctcctttccgctcattcttgtggaaaatgttctttgagaagcatgaagactacaagttcaatggtttggcctggctcttcttgggtgttcccacaagcagctcactactctataaggaggaattcgagaaaatgaaggagaagaagcctgagaacttcaggttggactttgcagtgagcagagagcaatcaaatgccaaaggagagaagatgtacattcagacccgaatggctgagtatgcagaagaactctgggaattactgaagaaagacaacacctatgtctatatgtgtgggctcaagggcatggagaagggaattgatgacataatggtgtcactggctgctagagatggcatcgattggatcgagtacaagaggcagttgaaaagggcagagcaatggaatgttgaagtctattaatgctagtttacttgtacaaatatcttcatcttccttttgttttttttcttttgttttccctttgaagcagccatccctcagctgcactctgtagatagacaacctgctttggaattcctattcttataaaaagcagctgtacctctaaggcatctacaaagaaaaaagttctatttttgaggcatggatcatggatcatggatcatgatcatgcatcattgatcataaagtaagtatatggaagcaaatttcgccc

SEQ ID NO: 1027 - DNA, 1485 bp, Lippia dulcis
ttcattctttcacttattatcatcattattcccatctctctttctctctcttagtttcttatctgatcacaaaaatggctgctgctgtgagtgctgcagtctctcttcccacctccaagtccacttctctccaagctagaacctccctcatttctccagaaagaatcaatttcagcaaggtaccattataccacaggaatgtgtattccgccggagcgaaaatcgggccaatcagagctcaggtgacaacggaggcaccagcgaaggcggagaaaatatcgaagaaacaagaggaaggagttgtggtgaacaagtttaggccaaaagaaccatacattggcagatgccttcttaacaccaagatcactggcgatgatgctcctggtgaaacctggcatatggttttcagcaccgagggagaggtgccgtacagagaagggcaatcaataggtgtgatcgcagacggcatagacaagaatgggaaacctcacaagctcaggttgtactctattgcaagcagtgcaatcggtgacttcggagactccaagactgtatctttgtgtgttaaaaggctcgtttacaccaacgatcaaggcgaaatagttaagggagtttgctcaaacttcttgtgtgacttgaaacctggtgctgaggtgaagataactggaccagtgggtaaagaaatgcttatgccaaaagaccctaacgctaccattgtcatgcttgccaccggaactggtatcgctcccttccgctcgttcttgtggaaaatgttcttcgagaagcacgatgactaccagttcaatggtttagcatggctattcttgggtgttcctacaagcagctcattgctctacaaggaggaatttgagaagatgaaggagaaacgtcccgagaacttcagattggactttgcagtgagtcgagaacagacaaatgccaaaggagagaagatgtacattcaaactcgtatggccgaatatgccgaggagctgtggcaacttctcaagaaagacaacacctttgtctacatgtgtgggctcaagggcatggaaaagggaattgatgacattatggtttccttggctgcaagagatggtattgactggatcgactacaaaaagcagttgaagaaagctgaacaatggaatgttgaagtctactaattttgtcttgcttcatattattgctgtacaaatatcagcactgcatcatgatttttctctgtgctgatgtagataggtaacttcatcttttctgaatttgttctttaagcaatctattttcgcatctatacagctctgcttgttcatatttgagtgcatgctcatgaaaaataattaatagtgaaacaagttatcaatctgatgtggtgtcaaaactcgcgtttgattgtgagatggaatggaaaacaattcaccttgtcattttatcctcaaatttaatatacatgcactaaagtatcacaactaaacttaaattgac

SEQ ID NO: 1028 - DNA, 1210 bp, Valeriana officinalis
cacaacattcccccttaaaatctcctccacccaacttataatccatttgtcactgcactctgcaaaatctcacacattctctctacattatcacgaatcatcaacaatggcgactgcagtaagtgctgcagtatctcttccatcttcaaaatctacctccatttccgccagatcaaactctctcatctcccaaaatgatcggattaacttcgtcaaggttccattgtactacaaaaatgtctgtggtggcgggaaaatgttatcgatcagagctcaggttacaacagaggcgccggttaaggttgagaaaatttcaaagaaagatgaagaaggtgtagttgttaacaaattcaaaccaaagaatccttacactggtatgtgccttctacaacaccaagattaccggcgatgatgcacctggagaaacctggcacatggttttcagcactgagggagaggtgccctacagagaaggacaatcaattggtgtaattccagacggaattgacaaaaatgggaagcctcataagttgagattatactccattgccagcagtgccctcggtgattttggggactccaaaactgtttctttgtgtgtgaaaagactaatctacactaatgaccaaggggaagaagttaaaggagtttgttcgaatttcttgtgtgatttgaaaccgggagccgaagtgaagataactggacctgtaggaaaagaaatgcttatgccaaaggatcctaatgcaaccattataatgcttggaactggaactggaattgctcctttcagatcgtttttgtggaaaatgttctttgaaaagcacgacgattataagttcaatggtttggcatggctcttcttgggtgttcctacaagcagctcactactctacaaagaggaatttgagaaaatgaaggagaagaacccgaaaaatttcagattagattttgcagtgagcagagagcaaacgaatgaaaaaggcgaaaaaatgtacatacaaacgcgaatggctgaatatgcagaagagcttttgggaattacttaaaaaagacaacacatttgtttatatgtgcggacttaaaggaatggagaagggtattgatgacatcatggtttctttggctgctaaagacggaattgattggattgaatacaagaggcagttgaagaaagcagagcaatggaatgtggaagtgtactaataaattt

SEQ ID NO: 1029 - DNA, 1664 bp, Humulus lupulus
ccatctatacacaactacacaacaacaccaccacacccactcttagtttacgttttttggtttttgcgttttttttgctaaaatatccttaccatctcataaaaaattcacctttttctcttgtatatcatcttcttctttggtttattttcttcaatattccaaccatggcagctgcagtaactgctgctgtttcgtttccatcttccaagtccacctcacttcccaccaggacttccattataacacctgacagaatcactttgaaaaaggctcctttctacagagacgcatcagctgttggtgccagagttgtttcagtcagagcccaggtgaccactgaggctcctgctaaggttgagaaagtatcaaagaaagatgaggaaggtgttgttgtaaacaagttcaaacccaaaaatccttacactggtagatgtcttctcaacaccaagatcaccggtgatgatgcccctggagagacatggcatatggttttcagcactgagggtgaggtcccttacagagaaggacaatcaattggagtaatagcagatggtgaagacaagaatggaaaaccccacaagctgaggttatactcaattgccagcagtgctcttggtgactttggagactcaaaaacagtttctctctgtgtgaaaaggctcgtgtatacaaatgataagggagaacttgttaagggagtttgttccaactttttatgtgacttgaagcctggtgctgaagtaaagatcactggacctgttgggaaagaaatgcttatgcctaaagatcctaatgccaccatcgtcatgcttgcaaccgggactggtattgcgccattccgatcattcttgtggaagatgttctttgagaagcatgaagactatgagttcaatggtttggcatggcttttcttgggtgtccccacaagcagctcacttctatacaaggaggaatttgagaaaatgaaagagaaggctccagagaatttcaggctcgatttcgcggtcagcagagagcagacaaatgagaagggagagaagatgtacattcaaaccagaatggctcaatatgcagaagagttgtggcaattactacagaaagacaacacttatgtctacatgtgtggactcaagggaatggagaagggtattgatgacataatggtctcattggctgctagagatggcattgattggattgactacaagaagaagctgaagaaggcagagcaatggaatgtggaagtctactaattcctgatacctttgtacaaatatctccctttcttcttattttcttcaaagggtttcagtttccactgcattggtgtagataggtaatgcccttgtaattggtctgttttcttttttgtctttttttcttcttcttcttcttaatttacaatgatgcagctgtattgttatggcctcaatctgaattttctttctgaggaaccatgggagagtacactatataaaaagccaatttctacatcttcaatcactgtctggaattgctttgtcttaaaatcacaacatgatttttacttcttttttttatacatttttggactctatgttttatcttattacttgtttgtaccctgtatttaacaaattaatttttagatcctatgttttgtaaaatagttaaaatagttc

SEQ ID NO: 1030 - DNA, 1462 bp, Vigna unguiculata
aaatctcgtccactcaaatcttatacttttctcttttttctaaattcattcatactcaaatccctcactgctacacaaaattcatcacttcattcaacatttcttcaccaatggctgctgctgttagtgctgcagtctcttttccatccaccaagtccacctctctccaaagtagaacctccatcgttgccccagagagagtcattttcaacaaggttccttttcaatacagagatgtttccagcaacggaagggtggtttccatcagagctcaagtcaccactgaggcaccagccaaggttgaaaaagagtctaagaaacaggatgaaggtgtgattgtgaacaagttcaagcccaaagccccatacattggtagatgccttctcaacacaaagatcacaggggatgatgctccaggagaaacttggcacatggttttcagcaccgagggagaggttccttacagagaaggacaatcaattggggtaattccggacggtattgacaagaatggcaaacctcataaactgagattgtattctattgccagcagtgccattggtgactttggtgattccaagactgtttctctatgcgtgaaacgactagtgtacacaaatgatagtggagaaattgtcaagggagtgtgctcaaatttcttgtgtgacctgaagccaggatctgaagtaacaataactggacctgttgggaaagaaatgcttatgccaaaagatcctaatgccaccgttgtcatgttggcaactggaactgggattgccccatttcgctcattcttatggaaaatgttcttcgagaagcacgaagattacaagttcaatggtttggcatggctgttcttgggtgtacctacaagcagctcattgctttataaggaggaatttgaaaagatgcaggagaaatatccagagaacttcaggcttgactttgctgtgagcagagaacaaacaaatgagcaaggagagaagatgtacatccaaactcgaatggctcaatatgcagaagagctttgggaactactgaagaaggataatacttttgtgtatatgtgtggattaaaaggaatggaaaagggaattgatgacattatggtatcattggctgcaagagatggcatcgattggattgattacaagaagcaattgaagaaagcagagcaatggaatgtggaagtgtattaatttacagatatcaactcctacttcatgctgcaacaagtctcaaagtgtatcactcctccttcgttgtgtagatatatgacgaccctgtaattttttctttgacgatttttatattgttcatcaataatttcattgtcagttttacaagtactatttttgagggatgatccaacatacatgaatccaaccttattattgtctcactatcccgcgcattgtttctaccaacttgaatcaggattctaaacttctcacgttaagcc

SEQ ID NO: 1031 - DNA, 1403 bp, Olea europaea
ggccgaaatttgagtcatatgtacgtactaaatttcttatcctcacaattgccactgcattggccttgtaatctcgtccaaccaattcataatccactcaacaattatctcccctaaaacagtttccacccatcaattcttctcctcccactccttgctttctcacttaatatcatttgatcgcctttttctttagtgtttcaatcatggctgctgcagtgagtgctggagtttctcttccatcctccaagtctatttctcttccaaccagaaccgccattttttccccagaaagaatcaacttcaacaaggtgcccttgtactacagaaatgtgtctggtggtgggaaggtgatccgagctcaggtcacaacggaggctcctgccaaggccgagaagatttccaagaaacaggaagaaggggtagttgtcaacaagtacaggcccaaggaaccatacattggcaggtgccttctcaacacgaagatcactggcgacgatgcccctggagaaacctggcacatggtcttcaccactgagggagagatcccttacagagaaggccaatccattgggataattgccgatggtcttgacaagaatgggaagcctcataagctgaggttgtattcaattgcaagcagtgccctaggagactttggagactctaagactgtctctttgtgtgttaaaaggctcgtttacaccaacgaccaaggagaaattgttaaaggagtttgctcaaacttcttgtgtgacttgaaacctggatcagaagcgaagataactggacctgttgggaaagaaatgcttatgccaaaagatcctaatgcaaccgtaattatgcttgccactggaactggaattgcccctttccgtggattcttgtggaaaatgttctttgagaaacatgacgactacaagttcaatggtttggcatggcttttcttgggtgttcccacaagcagctcattgctctacaaagaggaatttgagaaaatgaaggaaaagtatccggataactttaggttggactttgctgttagccgagagcaaaccaatgagaaaggtgagaaaatgtacatccagactcggatggctcaatatgccgaagaactatgggaattgctcaagaaagacaacacctttgtctacatgtgtggactgaagggcatggaaaagggaattgacgacataatggtttcattggctgctaaagatggtattgactggatagaatataaaaagcagttgaaaaaggcagagcaatggaatgtggaagtctactaatgaatttttcctttcttgtattgtacaaatatcagccagccaatgtcagtttatctgtgctggtgtagataggctactttctttttgtaacttattttctttttcctatattct

SEQ ID NO: 1032 - DNA, 1572 bp, Cajanus cajan
cacttatcctaatataatatccgccactgcatttgcttctgaatctcatccactcaaatcttatagtcctttgtctgtgaaaccaaaacaacactattcattcacactcatattacataatctcatattcatcacttcattgaacatttctccctctagctaattttacaaatggctgctgcggtaagtgctgcagtctcctttccatccaccaagtctacctctctcccaagcaggacccccatcattgccccagagagacttgtattcaagaaggttccattgcaatacagagatgtttctactagtggaagggtagtttccatcagggcccaagtcaccactgaagcaccaaccaaggttgaaaaaatatccaagaagcaggaggaaggtgtgattgtgaacaagttcaaacccaagaacccttacattggtagatgcctgctcaacacaaagatcactggtgatgatgctccaggagaaacatggcacatggtcttcagcaccgagggagaggttccttacagagaaggacaatcaattggggtgattccagaaggtattgacaagaatggcaaacctcataagctgagattgtactccattgccagcagtgcccttggtgattttggtgattccaagactgtttctctatgcgtgaaacggttagtgtacacaaatgaaaatggagaacttgtcaagggagtctgctcaaatttcttgtgtgacctaaagcccggagctgaagtgacaataactggacctgttgggaaagaaatgcttatgccaaaagatcctaatgcaactgtcatcatgttgggaactggaaccggtattgccccattccgctcatttttatggaaaatgttcttcgagaagcacgaagattacaagttcaatggattagcatggctcttcttgggtgtccctacaagcagctcattgctgtataaggaggaatttgagaagatgaaggagaaatttcctgagaacttcaggcttgacttcgctgtgagcagagagcaaacaaatgagaaaggagagaagatgtacatccaaaccagaatggctcaatatgcagaagagttgtgggaattactgaagaaggataacacttttgtgtatatgtgtggactaaaaggaatggaaaagggaattgatgacattatggtgtcattggctgccaaagatggcatcgattggattgaatacaagaggcaattgaagaaagcagagcaatggaatgtcgaagtttattaatttctgttcaattgcacagatcacaactactttgtgctgcaacgtgtctatcacccctcctgcgttctgtagatatatgacgaccctgtaattttgttttgacgatttttatactgtttctgaacaatttcattgccggtcttacaagtactatttttaagggatgatgcaatatatataaatccaacttcactgtatcatttccaaattttatctttttgatgaaaagtatttaggtgtcccgtgcattatatatcccaaacactacatgaggcttctctctaacccgaatcaggattaataaacttttat

SEQ ID NO: 1033 - DNA, 1600 bp, Amsonia hubrichtii
cacaagctttactttctttcaatttcatcgccccattacttctctcttaaatcttttctttctttctctgcattacatcaaccagaaatggctgctgcagtcagtgctgcagtgtctcttccttcctccaagtctactgcttctcttcccactaccagaacatctatcatttccacagaaagagtcaactttaacaaggttcctttgtactataggaatgtttctgtaggtgggaaagtggtgtccatcagagcccaggtgaccacagaggctcctcaaaaggttgagaaaatttctaagaaaaatgaagaaggtgtgactgtgaacaagttcaggccaaagaacccatacactggtagatgtctccttaacacaaagatcactggtgatgatgcacccggagaaacttggcacatggtcttcagtactgagggagaaatcccatacagagaaggtcagtcaattggggttattgctgatggaattgacaagaacggaaagcctcacaagctgaggttgtactcgattgctagcagtgccattggtgactttggagattccaaaactgtttctctgtgcgttaaaaggcttgtctataccaatgagcagggagaactcgttaaaggagtttgctcaaacttcttgtgtgatttgaaacctggatctgaggtaaaaattactggacctgttgggaaagaaatgctcatgcccaaggatcccaatgccaccataatcatgcttgccactggaactggaattgctcctttccgtgggtttttgtggaaaatgttctttgagaagcatgaagactacaagttcaacggtttggcatggcttttcttgggagttccaacaagcagttccctgctttacaaggaggaatttgagaaaatgaaggaaaaatatccagaaaatttcagactagactttgctgttagcagagagcaaaccaacgagaaaggtgagaaaatgtacattcaaaccaggatggctcaatatgcagacgaactatgggaattactcaagaaagacaacacttttgtctacatgtgtggactgaaaggcatggagaagggaattgatgacattatgttaccactggctgctaaagaaggtatagactggctggaatacaaaagacagttgaagaaggcagagcaatggaatgtggaagtctactaattcttgcttccctgtacaaatataagtcgttattacgttattttctctgcattcatatagataggtatcattccttctgcaaattgcttttggtttaacttttatatctttttttctttttcattttctgtttcttctataactgctccttgtactactctttcgcctctctgagaaaaattttgtgggcatggatgatgacatatagtgaaagaaccttgacccttgtacaactctatcttcactttgtcatatagtttatgcttggatatcaatgtagagtatgacaaaaagcctaaaactgaagcacctaatgacctgatacatactttatgttctggttgaagatcagtagctgcaagaaacatagcatataaaaggttatctttcttggttcccattgtttgtttgcagacat

SEQ ID NO: 1034 - DNA, 1318 bp, Juglans hindsii x Juglans regia
atggctactgcagtaacttctacggtctcatttccatcctccaagtctgcatctcttccctcaagaaccagtattatctcaccagaaagaatctccttcaagaaggttcctctgcactatagggatgtttctgttggaggaagagtggtttctgtcagagcccaggtcaccatagaggctcctgctaaaaaggttgagaaggagtccaagaaaatggaggaaggtgtggttgtgaacaagtataagcctaaggacccttacgttgggagatgcctccttaacactaagattactgcggatgatgctcctggagaaacttggcacatggtcttcagcactgatggggaggttccctacagagaagggcaatcaattggggtaattgcagatggtattgacaagaatggaaagcctcacaagttgagactatactccattgccagcagtgcccttggcgactttggagactccaaaactgtttctctgtgtgtcaaacggcttgtatacacaaatgataaaggagaagttgttaaaggagtctgctcaaatttcttgtgtgacttaaaacctggatatgaagtaaagattacaggaccagttgggaaagaaatgcttatgccaaaagaccccactgcaaccatcattatgcttgcaactggaactggaattgctcctttccgctcatttttgtggaaaatgttctttgagaagcatgatgactacaagttcaacggtttggcatggctcttcttgggtgtccccacaagcagctcactgctttacaaggaggaatttgagaaaatgaaggagaaggccccagaaaactttaggctagactttgctgtgagcagagagcaaacaaatgagaaaggagagaagatgtacattcaaacacgaatggctcagtatgcagaagagctatgggaattactgaagaaggataacacctatgtctatatgtgtggactcaaggggatggaaaagggaattgacgagattatgctgtcattggccgctagagatggcattgattggttggactacaaaaagaagttgaagaaggcagaacaatggaatgttgaagtctactaatccctgactacaaagtgtctcccattgcaatgctttcctccacattctgtagataggtaacgcctttttgtacttttttttccttcctttgttaatgaatttgtattggtatagcctctacaagttttatttatgaggtatcatatgtcataatcatacaatagagttgaaacgaacttcaactatatttttcaacttcattagtaattaattcctccatgttttg

SEQ ID NO: 1035 - DNA, 1614 bp, Aristolochia fimbriata
gcgtaggcttcgctcttcccctcactcccctcctcccttctcgtcgaaccctactcccccccctcttccgggcacgtcccttcagctcctacaaccatggctgctgccgtcacggctgcagtgtctgtccccacgacaaaatcatcccctctacccgccagaacatgtttcatttcttcagaaagaatcagcttccaaaagacatgtctatacaccaggaatgtggctactgttgggaaggtcggacccatcagagcacaggttacaacggaggctccggccaaggtggaaaagatctctaagaaggatgatgaaggtgtggtggtgaacaagtacaggcccaaggagccgtacgttggcagatgcctgcttaacactaagataaccggtgatgatgctcctggagagacatggcacatggtgtttagcaccgaaggggaagtcccatacagagaagggcagtcaattggtgttattgctgatggggttgataagaatgggaagccccacaagctgagactatattcaattgcaagcagtgcccttggagactttggagactccaaaactgtttctttgtgtgtgaagcggcttgtatacaccaatgaccagggagaaattgtaaaaggagtttgctcaaatttcttgtgtgacctgaagcctggagctgaagtaaagatcacaggacctgttgggaaagaaatgctcatgcctaaagatcccaatgccacagtcgtaatgcttgcaactggaacaggaattgcgcccttccgttcattcttgtggaaaatgttcttcgagaaacatgatgactacaagttcaatggattggcttggctattcttgggtgttcctacaagtagctctttgctttacaaagaggaatttgagaagatgaaggagaaggcaccagaaaatttcagactcgactttgctgtgagcagagaacaaaccaatgaaaagggagagaagatgtacatccagacaaggatggcccagtatgctgaagaactgtgggaactgcttaagaaagacaacacatatgtctacatgtgtggattgaggggtatggagaagggaatcgatgatatcatgacatccttggcagagagagatgggctcgtctgggctgattacaagaagcagttgaagaaggcagagcaatggaacgttgaagtgtactgaggagaccatatattgcatttcttgaagagcctattatttagtgctttcatcgtctgtagataggtagcctattcctctgtcatttttaaagttgatttctcatcaaatgcagcagtctgttagttccctcattacttttactggaggcggaatgtatagcactgtcattataacctactatatgtgcttgtaatcattctcaacttccatttgttaatagtaatcccaattttccacaatgtgttatgcaaatcctttgattaggatttgcatccaagtgctgcagtgtatggaatctctttgttttgcttagcggtatgccaagattaccacagttggccatgagaaatcacagcaattgtattccaaattatggtaggaacatgtcacagctccaaacaattaaatgtacagttgggagagatgctt

SEQ ID NO: 1036 - DNA, 1334 bp, Phaseolus vulgaris
atcactctctctttctctgtctctagtttttacaacatggctactgcggtaactgctgcagtctcctttcccgcctctaagtccacctctcttccaagcagaacctctgtcacttccccagatagaatactcttcaagaagctttcgttacaatacagagatgtttcagtcagtggaagggtagtttcggtcagagcccaagtgaccacagaggcacctgcaaaggttgaaaaggaatccaagaaacaagatgaaggtctgatcgtgaacaagttcaaacccaaggacccctatattggtaggtgtcttctcaacacaaagatcaccggggatgatgcacctggggaaacttggcacatggtcttcagcactgagggagaagttccttacagagaaggacaatcaatcgggataattgctgatggggttgacaagaatggcaagcctcacaaactgagattgtattctattgccagcagtgcccttggtgattttggagattccaaaactgtttctttatgcgtgaaacgtcttgtgtacacaaatgaaaatggagaacttgtcaagggagtttgctcaaatttcttatgcgacttaaagccaggagccgaggtaaagattactggacctattggtaaagaaatgcttatgccaaaagatcctaatgccacagtggtcatgttggccactggaactggaattgccccatttcgctcatttttatggaaaatgttcttcgagaagcatgatgattacaggttcaatggtttggcatggctcttcctgggtgttcccacaagcagctcactactttataaggaggaatttgaaaagatgaaggagaaagcacccgagaacttcagacttgactttgctgtgagcagagagcaaacaaacgagaagggagaaaagatgtacatccaaacaagaatggctcaatatgcagaagagttatgggaattactgaagaaagataacacttttgtgtacatgtgtggattgaaaggaatggagaagggaatcgatgacataatggtgtcattggcagcaaaagatggtatcgattggattgactacaagaggcaattgaagaaggcagaacaatggaatgtggaagtatactgaatcatctgtgttcacttgcacttgcatagatatgatgtgatgtccctctttgagcagcagcaaatttattttgctgttctgtgttctgtagataattttgaggatcatgttgttgttaccatgtttatgaacaagcttcattgcatgaaataattttgaggatcatgcaatacatatgaaatcgacttcgcttttacaaagttccgaaa

SEQ ID NO: 1037 - DNA, 1554 bp, Citrus sinensis
caaaaacaacgtgtgagaatcatagattttactcataaacttatcctttcatacgccactgcattggctttccaatctcctccacccaattcaatatccataaacacaacccactaaatcaaatacacaaaaatctcaaccttttcttttttctcatctcacttcttcacttaaaaacgtcaacacccctttaaattttcttctctcttcatctaaattcttctttatcatcacttatcaatcatggctgcagtgagtgctgcagtttctcttccgacttccaagtccacttcgcttccaaccagaacctctatcatctctcctgacagaatcaccttcagaaaggttccattttactacaaagatgtttcaactggagggagagtggtttctgtcagagctcaggttaccactgaggctcctgctaaggtcgagaaagagtccaagaaaatggaggaaggtgttattgttaacaagttcaaacctaagacaccttacattggcagatgccttttaaacactaagatcactggtgatgatgctcctggagagacctggcacatggtcttcagcactgaaggagaggttccctacaaagaagggcaatcaattggggtgattgcagatggtgttgacaagaatgcgaagcctcacaaactgagattatactccattgctagcagtgcccttggtgactttggagactccaaaactgtttctttatgtgtgaaaaggcttgtgtacaccaacgaaaatggagaaattgttaagggagtctgctcaaatttcttgtgtgacttgaagcctggggctgaagtgaaaattacaggacctgttgggaaagaaatgctcatgccaagggatcccaatgctacagtcatcatgcttgcaactggaactggaatcgctccattccgtggatttttgtggaaaatgttctttgagaagcacgaagactacaagttcaatggtttggcatggctcttcttgggtgtcccgactagcagttccctactctacaaggaggagtttgagaagatgaaggagaaggccccggaaaacttcaggcttgactttgcagtgagcagagaacaaaagaatgagaagggtgagaagatgtacattcaaacccgaatggctgaatatgcaaatgagctgtgggaattactcaagaaagataacacttatgtgtacatgtgtgggttgagaggcatggagaagggaatcgatgacattatggtgtcattggctgctaacgatggcattgattggctggactacaaaaagcaattgaagaaatctgagcaatggaatgttgaagtctactaatgctttacatgtacaaaacatccctcacattttcattttttttcctttttgtcccatcgtatgatatttccctctgcactgtgtagataggtagactattttcaaattttctttgtatttttgtcttttttaacggagcaatttacggctattgtctctacagatttttattcttgagggatcatgtatcttgcaaatatatttggaggcaattcaacttgctca

SEQ ID NO: 1038 - DNA, 1491 bp, Cajanus cajan
atctcatccactcaatcataaaatcttctgtataaccagaaaaacgatccttccctcactctcttttatataatcaattcatttaacattactctttctctttctagtttttacaacatggctgctgtagtaactgctgcagtttcctttccatcctccaagtccacctctcttccaagcagaacctcaatcgctgccccagatagaatagtcttcaagaaggtttcgttgcaatacagagatgtttcaatcagtggaaggatagtttctatcagagcacaagtgaccacagaagcacctgctaaggttgaaaaggaatccaagaaacaggaggaaggtgtgattgtgaacaagttcaaacccaagaacccttatactgctaggtgtcttctcaacactaagatcactggggatgatgcacctggagaaacttggcacatggtcttcagcactgagggagaagttccttacagagaaggacaatcaattggggtaattcctgatggggttgacaaggatggcaagcctcacaagctgagattgtattctattgctagcagtgcccttggtgattttggagactccaaaactgtttctttatgcgtgaaacgtcttgtgtacacaaatgaaaacggagaacttgtcaagggagtttgctcgaatttcttgtgcgacttgaagccaggggctgaagtaaagattactggacctgttggtaaagaaatgcttatgccaaaagatcctaatgccaccatgatcatgttggcaactggaactggaattgccccattccgctcatttttatggaaaatgttcttcgagaagcatgatgattacaagttcaatggtttggcatggctcttcttgggtgtacccacaagcagctcactactttataaggaggaatttgaaaagatgaaggagaaagcacctgagaactttaggctagactttgctgtgagcagagagcaaacaaacgaaaaaggagagaagatgtacatccaaacacgaatggctcaatatgccgaagaactttgggagttgctgaagaaagataacacctatgtctacatgtgtggactcaaagggatggaaaagggaattgatgacataatggtgtcattggctgcaaaagatggtatcgattggattgagtacaagaggcgattgaagaaggcagaacaatggaatgtggaagtctactaataatactttcactgatatcatcgagtctcactttgtgctgcaggaaatctattttgctgtcatgctttttgtagatagattacgtatgaatgtatgacccagtaatttttctactatgggaattttcaccttgcttgtgaataagcttcgttgcaacttgcaacaaccttgcatgaaataattgtgaggatcatgcttcatgcaataaagatgaaatcaacttcattttacaaatttcctaaatttttccatataaagatttagttgaaggtagtgttgaatgaa

SEQ ID NO: 1039 - DNA, 1366 bp, Solanum phureja
tgctgcattaagtgcttcactctctctaccatcctctaattcaacttgtctttccatcaaaaccatcttcatctcccctgaaaatattaccttcaacaaggttcctttatgcaacagaaatgtatcagctggtggaaaagtgtttcccattagagctcaactcacaacagaagtacctgcaaaggttgcgaaggtatcgaagaaacaggatgaaggtgtagttgtaaacaagttcaggccaaaggatccttatattggcagatgccttctcaacactaagatcactggagatgatgcccctggagaaacttggcacatggtcttttctactgagggagagatcccatacacagaaggccaatctatcggagtgattcctgatggtgttgacagtaatgggaagccccacaagctcagattgtactccattgctagcagtgcccttggtgacttcggagactccaaaaccgtatctctgtgtgtcaaaaggcttgtctacacaaatgacaaaggggaaatagttaaaggagtctgctcgaacttcttatgtgacttgaaacctggagctgaagttaagattactggacctgttggaaaagaaatgctcatgccaaaggatcccaacgcgacagttataatgcttgccactggaactggaattgctcctttccgtggattcttgtggaaaatgttctttgagaagcatgaggattacaagttcaatggtttagcttggcttttcttgggcgtaccgacaagcagctcacttatttacaaggaggaattcgagaaaatgaaggagaaggccccggaaaacttcagactagactttgctgtgagtagggagcagactaacgagaaaggcgaaaagatgtacatccagaccagaatggctgaatatgctgaagaactatggacattactcaagaaagacaacacatttgtgtacatgtgtggactcaaaggcatggagcagggaatcgatgacattatgacttcacttgctgaaagagatggtattaactgggcagattacaaaaagcagttgaagaaggcagagcaatggaatgtggaagtctactaaaacttttggtttcttcgtacaaatatgagtaaagtgttagtttctctgctctgcattcatgtagatatgtaggtttgtaattatttttttttaacgaaaaaattcgtatttatttcttgttgtgacagtgttctactgttctgggaattaatgtccctttggaagttggattttaaaggggtatggatgataaacatacttctggatgaacctccatatatatgaaatacttgtccatctgaacatacttctgtaaagttggatggaaatgtattccctata

SEQ ID NO: 1040 - DNA, 1494 bp, Castanea mollissima
cttatcctcacatctgccactgcattggccttctaatctcctccactcaaatttcataatccactgcaaacgaaaaagatcatacctctcgttttcatacttcttcaccaactcctcgcaaccccataaaaccatcacactttctttctcttgctctgctttatcaactagcattgcagtcatggctactgcagtaactgccacggtctcttttccatcatccaagtcatcttctctgtcctccagaacctctataatcttaccagagagaatccctttcaagaaggttcctttgcagtacagagatgtttctgttggtggaagagtggtttcgatcagagcccaggtcaccacagaggctcctgcaaaggttgcgaaggaatccaagaaaatggaggaaggagtggtagtgaacaagtacaaaccgaaaaatccatacactggaagatgcctacttaacactaagattactggtgatgatgctcctggagaaacttggcacatggtcttcagcactgagggggagatcccatacagagaagggcaatcagttggggtaattccagatggtattgacaaaaatggcaagcctcacaagctgaggttatactcaattgccagcagtgccattggtgactttggggattccaaaactgtttctctgtgtgtgaaacggttagtgtacaccaatgatgcgggagaaattgttaaaggagtatgctcaaatttcttgtgtgacttgaaacctggagctgaagtgaagatgacaggacctgttggaaaagaaatgctaatgccaaaagatcccaacgctaccatcatcatgcttgcaactggaactgggattgctcctttccgctcatttttgtggaaaatgttctttgagaagcatgatgactacaagttcaatggtttggcgtggctcttcttgggtgtccccacgagtagctcactgctttataaggaggaatttgagaaaatgaaggagaaggcccccgaaaattttagacttgactttgctgtgagtagagagcaaaaaatgagaaaggtgagaagatgtacatccaaacccgaatggctcagtatgcagaagagctatggcaattgcttaagaaggataacacctttgtctatatgtgtgggctgaaggggatggaaaagggaattgatgacataatgatttcattggctgctagagatggcattgattggttggactacaaaaagcagttgaagagggcagagcaatggaatgtggaagtatactaatgcctaaagtactcgtacaaatttctcccacttcacttttaagcggcaactgataatgatttccactgcattctgtagataggtaatgcctttgtaatttttcattttgtatttttgtccttttttgtttaatgcagcagttgtatggtatagcctccacaggagttttatttatgaggggtcatggatatatagtcataaatatagttgaagccaacttcaact

SEQ ID NO: 1041 - DNA, 1637 bp, Gossypium hirsutum
ggatattggctttcaaaatctcctccacccaccttataatcaataaacattgaaaacaatatcccatccttcattttgtttccttcaccacttttacttcttctgcagcaaccacccccatcagatataacattttctcctcctccttatttcttcgttataaaaaaagaaaagaaaagacatggctgctgttactgctgcagtctcttttccttctaccaagtccacctctctccctgctagaacctctattgcctctcctgataggatcaccttcaagaaggtgcctgtttactacagagatgtttgcagtggggggagagtggtttctgtcagggcccaggttacaactgaagctcctgccaaagttgtaaaggaatccaagaaaaatgatgaaggtgttgtggttaacaagttcaggcctatcaacccttacattggtagatgccttctaaacactaagatcactggcgatgatgctcctggagagacttggcacatggtcttcagcaccgaaggagaggtcccctacagagaagggcaatccattggggtgattccagatggcgttgacaagaacggaaaaccacacaagctgagattgtactctattgctagcagtgctcttggtgattttggggactccaaaacggtatccctatgtgtgaaacgactggtatacaccaacgagaaaggagagcttgtcaaaggagtctgctccaatttcttgtgtgacttgaaacctggggcggaagttaaaataactggacctgttggaaaagaaatgcttatgccaaaggatcccaatgccacaatcatcatgctcgctactggaactggaatcgctccctttcgatcatttctgtggaaaatgttcttcgagaagcatgacgactacaagttcaacggtttggcatggctcttccttggtgttcccacgagtagttcattgctatacaaggaggaattcgagaaaatgaaggagaagaacccagaaaacttcaggctggactttgcagtgagcagggaacaaacaaacgagaaaggagaaaagatgtacattcagacacgaatggctgaatacgcgaaagagctatgggagttgctgaagaaagacaacaccttcgtctacatgtgtgggttgaggggaatggagaagggaattgatgacataatggtctcactcgctgcagctgatggtatcgactgggccgagtacaaaaagcaattgaagaaagctgagcagtggaatgtggaagtctactaaatatatacatatggatcgcttgtacaaattaatcatctcccttttcattttccttttttagcacccgccccgacctatgagaatttccaatgcattgtgtagagagggggactgcctttgttttttctgagcccatataatgagaactatcggtattttatagccaaccttatttcttcaacaaataaatttgtccctagtacctttttagcattgatataagcggtaagtcttacttaagggtaaggtttaagttagaaaatattaaattataaaacgagtttaaataaaaaaataacaataacatattatagtagatgtaccattttggttttgttacttattagtatataaatagtggtatgttttg

SEQ ID NO: 1042 - DNA, 1455 bp, Gossypium raimondii
attggctttcaaaatctcctccacccacttcataatccataaacattgaaaacaatatcacatccttcattttgtttccttcaccacttttacttcttctgcagcaaccacccccatcagatataacattttctcctcctccttatttcttcattataaaaaaagaaaagaaaagacatggctgctgttactgctgcagtctcttttccttctaccaagtccacctctctccctgctagaacctctattgtctctcctgataggatcaccttcaagaaggtgcctgtttactacagagatgtttgcagtggggggagagtggtttctgtcagggcccaggttacaactgaagctcctgccaaagttgtaaaggaatccaagaaaaatgatgaaggtgttgtggttaacaagttcaggcctatcaacccttacattggtagatgccttctaaacactaagatcactggcgatgatgctcctggagagacttggcacatggtcttcagcaccgaaggagaggtcccctacagagaagggcaatccattggggtgattccagatggcgttgacaagaacggaaaaccacacaagctgagattgtactctattgctagcagtgctcttggtgattttggggactccaaaactgtatccctatgtgtgaaacgactggtatacaccaacgagaaaggagagcttgtcaaaggagtctgctccaatttcttgtgtgacttgaaacctggggcggaagttaaaataactggacctgttggaaaagaaatgcttatgccaaaggatcccaatgccacaatcatcatgctcgctactggaactggaatcgctccctttcgatcatttctgtggaaaatgttcttcgagaagcatgacgactacaagttcaacggtttggcatggctcttccttggtgttcccacgagtagttcattgctatacaaggaggaattcgagaaaatgaaggagaagaacccagaaaacttcaggctggactttgcagtgagcagggaacaaacaaacgagaaaggagaaaagatgtacattcagacacgaatggctgaatacgcgaaagagctatgggagttgctgaagaaagacaacaccttcgtctacatgtgtgggttgaggggaatggagaagggaattgatgacataatggtctcactcgctgcagctgatggcatcgactgggccgagtacaaaaagcaattgaagaaagctgagcagtggaatgtggaagtctactaaatatatatatatggatcacttgtacaaattaatcatctcccttttcattttccttttttagcacccgccccgacctatgagaatttccaatgcattgtgtagagagggggactgccttttttttttctgagcccatataatgagaactatcggtattttatagccaaccttatttcttcaacaaataaattt

SEQ ID NO: 1043 - DNA, 1307 bp, Arachis hypogaea
agcttgttagttttctgtcacagcaaacatggctactgcagtaactgctgcagtctcatttccatccactaaatccacctctattccaaccacaacaacctctattgcttccccacatagactcctcttcaaaaaggttacattgcagtatagagatgtttgtatcagtggaagagtggttcccatcagagctcaggtcacaactgaggcacctgctaaggttgaaaagatttccaagaagcaggaagaaggtgttgttgtgaacaagttcaaacccaaggagccatacattggaagatgcttgctcaacactaagatcactggggatgatgcacctggtgaaacttggcacatggtcttcagcacagagggagaggttccttacagagaaggacaatcaattggggtgattccagatggcattgacaagaatggaaagcctcacaagctcagattgtattctattgctagcagtgctcttggtgattttggagactcaaaaactgtttctctatgtgtgaaacgtcttgtgtatacaaatgaaaatggagaacttgtcaagggagtctgctcaaatttcctatgtgacttgaaaccaggagctgaagtaaagattactggacctgtggggaaagaaatgcttatgccaaaagatcccaatgctactatcatcatgttggcaactggaactggaattgccccattccgttcgtttttatggaaaatgttcttcgagaagcacgatgattataagttcaatggtttggcatggctcttcttgggtgtccctacaagcagctcactgctatacaaggaggaatttgagaagatgaaggagaaaaaccctgagaaattcaggcttgacttcgcagtgagcagagagcaaacgaacgagaagggagagaagatgtacatccaaaccagaatggctcaatatgcagaagagctttgggagttacttaagaaagacaacacttttgtatacatgtgtggactcaaaggcatggaaaaaggaattgatgacatcatggtttcacttgctgccagagatggcattgattggactgaatacaagaggcaattgaagaaggcagagcaatggaatgtggaagtctactaatttatatgatcactttctgtagatataaagccatgttagtttttctattatcatcatgattttctcctccttcatgaaaccacttcatcattttgagggtcatacaaataatatagatgaaggcaacattgttttatttaccagtttcctaccatatcttttgtgaggatttctttaataccatata

SEQ ID NO: 1044 - DNA, 1563 bp, Solanum lycopersicum
gaaggatcctaattccctacctttcacctaattttcttcttaacaacctcactcccccaaaaaaagttcttttgttcaccactctcaatttattctactatttctcagcatcataaccaatatggctgctgcattaagtgcttcactctctctacaatcctctaattcaacttctctttccatcaaaaccatcttcatttcccctgaaaatatcactttcaacaaggttcttttatgcaacagaaatgtatcagttagtagaaaagtgtttcacattagaggccaactcacaacggaagtacctgcaaatgttgcgaaggtatcgaagaaacaggatgaaggtgtagttgtaaacaagttcaggccaaaggatccttatattggcagatgccttctcaacactaagatcactggagatgatgcccctggagaaacttggcacatggtcttttccactgagggagagatcccatacagagaaggccaatctatcggagtaattccagatggtgttgacagtaatgggaagccacacaagctcagattgtactccattgctagcagtgcccttggtgacttcggagactccaaaaccgtatctctgtgtgtcaaaaggcttgtctacacgaatgacaaaggggaaatagttaaaggagtctgctcgaacttcttatgtgacttgaaacctggagctgaagttaagattactggacctgttggaaaagaaatgctcatgccaaaggatcccaacgcgacagttataatgctggccactggaacaggaattgctccttttcgtggattcttgtggaaaatgttctttgagaagcatgaggattacaagttcaatggtttagcatggcttttcttgggcgtaccgacaagcagctcacttctttacaaagaggaattcgagaaaatgaaggagaaggccccgcaaaacttcagactagactttgctgtgagtagggagcagattaacgagaaaggtgaaaagatgtacatccaaaccagaatggctgaatatgctgaagaactatggacattactcaaaaaagacaacacctttgtgtacatgtgtggactcaaaggcatggagcagggaatcgatgacattatgacttcacttgctgaaagagatggtattaactgggcagattacaaaaagcagttgaagaaggcagagcaatggaatgtggaagtctactaaagcttttagtttctttgtacaaatatgagcaaagagttagtttctctgctctgcattcatgtaggtttgtaattcttattttttttttttaaagaaaaaattcgtattttactttttgttgtgacagtgttgtgggaattaatgtccctttgaaagttggattttaaaggggtatggatgataaacatacttctggatgaacctgcatatatatgaaacgtttgtccatttgatcatacttgtgtaaagttggatggaaatgtatttcctataatggcttgtgctttagtgtataaacatgtatatcaggaatcaggtgtaatactaattgagacagcttgtttggatggttg

SEQ ID NO: 1045 - DNA, 1459 bp, Olea europaea
catggctgctgcagtaagtgctgcagtctctcttccatcctccaagtctacttctcttccaaccagaaccgccattttttccccggaaataatcaacttcaacaaggtgccattgtactacagaaatgtgtcgggtggtgggaagtgatcagagcccaggtcaccacagaagctcctgcaaaggttgggaagatttccaagaaacaggaagaaggtgtagtggtcaacaagtacaggcccaaggaaccatacattggcaggtgccttctcaacacaaagatcactggcgatgatgccccaggggaaacctggcacatggttttcaccactgagggagagatcccttacagagaaggccaatccattggggtgattccagacggcatcgacaagaatggtaagcctcacaagctgaggttgtactcgatcgcaagcagtgccatcggagattttggagattccaagactgtctctttgtgtgttaaaaggcttgtttacaccaatgaccaaggagaaattgttaaaggagtttgctcaaacttcttgtgtgacctgaaacctggagctgaagtgcagataactggtcctgttggaaaagaaatgcttatgccaatagatcctaatgcaaccatagttatgcttggcactggaactggaattgcccctttccgctcattcttgtggaaaatgttcttcgagaagcatgaagactacaagttcaatggtttggcgtggcttttcttgggtgttcccacgagcagctcactgctgtacaaagaggaatttgagaaaatgaaggaaaagtttccggataactttaggttggacttcgccgttagcagagaacaaacaaatgagaaaggtgagaaaatgtacatccagactcggatggctcaatatgctgaagaactatgggaattgctcaagaaagacaacacatatgtgtacatgtgtggactcaagggcatggaaaagggaattgatgatataatgtgttcattggctgctaaagaaggtattgactggatagattacaaaaagcagttgaaaaaaggagagaaatggaatgtggaagtctactaatggatactacctttcttgtattgtacaaatatcagccagccactgtgattttatctgtgctgatgtagataggctactttcttttcccattattcttctttcatgatcaaacagttgcactgctgaccctacggaatttttcagattatggatcatgaaaagatataatagtgaaacaaactttaatctcatcaacttgtaaattgttatgataagcatctttatatccaaattcatcagcaactccagactaactgtaaattttgaaatctgtgaatttggcaatcaaataacatgatctgtggataattcttctcaagctcaagtgtgaattttcttacctggaagggatgacatgcaagtgtttataatgaag

SEQ ID NO: 1046 - DNA, 1454 bp, Tripterygium wilfordii
tcatcacaaccatggccgctgcagtaactgctgcagtctccttcccatcatctaagtccacttctcttcccacaagaatctccgtcatctcacccgagagaatcaccttcaagaagttcaataccgttcactacagatacagagatggctctgctggtgggagagtgggttcgattgttagagcccaggtcactactgaggctcctgctaaggttgagaaggagtccaagaagatggaggaaggtgtgatagttaacaagttcaagcccaagaatccttacattggtagatgccttttgaataccaagatcacaggtgatgatgctcctggagaaacttggcacatggtcttcagcactgaaggggaggttccttacagagaagggcaatctattggagtcattccagatggtattgacaagaatggcaagcctcacaagctgagattgtactctattgccagcagtgccattggtgatttcggcgactccaaaactgtttccctctgcgtgaaacgccttgtatacaccaatgacaaaggagaagttgtcaaaggagtctgctcaaatttcttatgtgacttgaaacctggtgctgatgtgacgattacaggaccagttggcaaggaaatgcttatgccaaaagatcccaatgccactgtcgtcatgcttgctactggaactggtatcgctcctttccgctcattcttgtggaaaatgttcttcgagaagcacgaagattacaagttcaatggtttggcctggctcttcttgggagttcccacaagtagttcattgctctacaaggaggagtttgagaaaatgaaggagaaggctcctgacaacttcaggcttgattttgccgtaagcagagagcaaacaaacgaaaagggagagaagatgtacattcaaacccgaatggctcaatatgctgaagagctatgggagttactcaagaaagataacacctttgtctatatgtgtgggctcaaaggaatggagcaaggaattgatgagataatggaatcattggccgaaagggatggcgtcacttgggtggattacaaaaggcaattgaagaaggctgggcaatggaacgtggaagtctactaatgctttgattacattgtacaaaaatatcaccctcttccactcccattgtgtagataggtaatggtggtgtaattttcttttaaattttgttcttggtattagagaatcaactgtattgaatattaattatggcctcttgaaaggtttttttgtaatcttgaggaataatgggtcatatttatatatgaagatcaatttcaatcccacatatttcccttgatttctgtttcatttgcaccacacaagcaatcactgatatgacactatgtatttcttacctacacttgtctgtctttaaaaactctacgcagtagcgcatttcacaggtgtatatataacccc

SEQ ID NO: 1047 - DNA, 1376 bp, Antirrhinum majus
ccttttttttcgattcttactctttcttaattttcattaaaaaaaataataatttgcaaacatggccgctgcagtaagtgctgcagtctcagttccttcttcaaagtctgcttctcttacagctagaaattctattgtttcaacagacagagtcagtttattcaacaaggtaccatcatactacaggaatgtgtcatctggtggtgtgaggattctgccgatcagagctcaggtgacgactgaagctcctgctgcaaagccggagaaagtgcataagaaacaagaggacggtgtagttgtcaacaagtacaggccgaaggagccgtatgttggcaggtgccttctcaacaccaagatcactggcgatgatgcccctggtgaaacatggcacatggtcttcagcactgagggagagattccgtacagagaaggacaatcaatcgggattatagccgacggtgaggacaagaacgggaagcctcacaagctgaggttgtactctattgctagtagtgcccttggagattttggagacgccaagactgtttccttgtgtgtcaaaaggctggtctacaccaacgaccaaggagagatagttaaaggggtttgctcaaacttcttgtgtgacttgaaacctggatccgaagtgaagataactggacctgtggggaaagagatgctcatgccaaaagaccctaatgctactattattatgctcggaactggaactggtattgctcctttccggtcattcctgtggaaaatgttctttgagaagcatgatgactacaagttcaatgggttggcatggctattcttgggtgttcctacaagcagctcacttctgtacaaagaggaatttgagaaaatgaaggagaaagccccggagaacttcaggttggactttgccgttagcagagaacagacaaacgctaaaggagagaaaatgtacattcaaactcggatggctgaatatgcagaagagctatgggaactcctcaagaaagataacacctatgtctacatgtgcgggctcaagggcatggaaaagggaatcgacgacatcatgctttcattggctgctaaagatggcatagattggttagactacaagaagcagttgaagagagctgaacaatggaatgtggaagtctactgatttactggaagaagttcttgtacaaatatgagccagcttttatgtgatattatcatattatgtggctggtgtagatagattactttcttttgtataatttactttcttttgtttgaatgtttttcagttttgttataccatatggccccctctgaatgtttcaaattttgaggatgttgtttgcaaaagagttattagtgagataaatacaatcttg

SEQ ID NO: 1048 - DNA, 1847 bp, Mimulus guttatus
ccaatctcctccactcaatccaaataatcttctcttttatttttccatccaaataatctttctttccttcatctccttcaccgatttttccattccccccacttcactcattatcataatatcatctctctcttactttctctctctaacatacaatggctgctgctgtaagtgctgcagtctcactgccttccaccaagttcacttcccttcaatctaaaacttccattctatctcctgaaagaatcaattttaacaaggtgccgttgtactacagcagaaatgtaacaaaagtggggcccatcagagctcaggtaacgacagaagcgccggcaaaggcggagaagatatcaaagaaacaggaagaaggtgtaattgtgaacaagtataggcctaaagaaccatacgtcggcagatgccttctcaacaccaaaatcacgggcgacgatgctcccggtgaaacctggcacatggtcttcagcaccgaaggggaggtgccttacagagaaggacaatcgatcggtattatacctgacgggatagacaagaatggaaagcctcacaaacttaggttgtattctattgcaagcagtgccctcggcgactttggagactccaagactgtatctctgtgtgttaaaagactcatctacactaacgaccaaggggaaacagttaaaggagtttgctcaaactttttgtgtgacttgaaacctggtactgaagtgaaaataactgggcctgtgggaaaagagatgctcatgccaaaggaccctaatgctaccattattatgcttggtactggaactggtatcgcccctttccgctcgttcttgtggaaaatgttcttcgagaagcacgacgattacaagttcaatggcttaggatggttgttcttgggtgttccaacaagcagttcattgttgtacaaagaggagtttgaaaaaatgaaggagaaattcccggataacttcagactcgactttgcagttagcagagaacagaacaacgccaaaggggagaagatgtacatccaaactaggatggctgagtacgccgaagagctatgggaactgctcaagaaagacaatacctatgtctacatgtgcggtctcaagggcatggaaaagggtatcgacgaaatcatgctttccttggccgctaaagacggtatcgactggttagactacaagaagcagttgaagagagcagaacaatggaatgttgaagtctactgattcatcttcttatataatattatatatatccatatatatatatatacaaatatatcggcatgcattgtgatttcttcttctctactgatgtagataggcaactttctttttcgaatttgtttcgttcccaatcttcttctacttcttttttcgaatttgtttccatctatggcacctctggatataaaaaatgaagggcattgtcaaaaaatgttgatagtgaaacgaattatatcagttatttttgtcctcaaatcatttgctccgactggatcttcaaatttattagtaggtacagggtttgataacttaatattgtgcctatttatttcatatggttaattaagtaggaaactgggtaagagtctcttaacacaatattttattgggactatacgacaaagaccccttatttaattttgaattcatgataaatttattttattaactgatatttgacataagtcaatttggctcaaattatcggaaatgcccctatcgtactctctctccaagtaacaattcataaatctcacgccattacagtttctttttattctcctttttttccagaaaaaatattgtttttttcaatttcaattttgaaac

SEQ ID NO: 1049 - DNA, 1181 bp, Tripterygium wilfordii
atcatcacagcaatggctgctgcagtaactgctgcagtctcctttccatcctctaagtccacttctcttcccacaagaacatccatcacctcaccagagcgaatcaccttcaagaagttcaatgctgtttactacagagatggctcttctggtgggagaatgggttcaattgtcagagcccaggtcacgaccgaggctcctgctaaggtcgagaaggagtctaaaaagatggaggaaggtttgatagttaacaagttcaagcccaagaatccttacattggtagatgccttttgaataccaaaatcactggtgatgatgctcctggagaaacttggcacatggtcttcagcactgaaggggaggttccttacagagaagggcaatctattggagtcattccagatggtattgacaagaatgggaagcctcacaagctgagattgtactctattgccagcagtgccattggtgattttggtgactccaaaactgtttccctctgcgtgaaacgccttgtatacaccaatgaccaaggagaactagtcaaaggagtctgctcaaatttcttgtgtgacttaaaacctggttccgaagtgaagattacaggaccaattgggaaggaaatgcttatgccgaaagatcccaatgccactgtcgtcatgcttgctactggaaccggtattgctcctttccgctcattcttgtggaaaatgttctttgagaagcacgaagattacaagttcaatggtttggcctggcttttcttgggggttcccacaagtagttcattgctttacaaagaggagtttgagaaaatgaaggagaaggctcctgacaacttcaggcttgattttgccgtgagcagagaacagacgaacgaaaaaggagagaagatgtacattcaaacccgaatggctcaatacgctgaagaactatgggagttgctcaagaaagataacacctttgtctatatgtgcgggctcaaaggaatggagcagggaattgatgaaataatggcgtcattggccgaaagggatggcatcaattgggtggaatacaaaaggcaattgaagaagacagagcaatggaatgtggaagtctactaatgcttgattacattgtacaaaatatcacccccccccccacaccctcctttatttttgttatttcaagcatgttt

SEQ ID NO: 1050 - DNA, 1699 bp, Panax ginseng
ctcaatctctcatattccccaaaatttcccaacaaatccaatcaaaataatcaatcccgaagccaaaaaaaaatccctatacacataaatcccaccacccgcatggccgcatgagaaataaagccagatatccaacataaactaagaggcgaacaattagaacagaaaagtgaatacaaggggaacaagagaagccaaaacagtgggtagaaaaacagatgaatctgaagtagggcttggcaaagcagtggtatcaacgcagagtacatggggacttgcacatttctacagtcccaaatatatcaccaacacaatttttatatctttctccctccttcacccccatttacagccatggctgctgctgtgagtgctgcagtctccctcccatcctccaaatccactgccctttcaaccagaacatttatcatctcacccgaaagagtgaacttcactaaggttcctttgagcttcagaaatgtatctggtggtgggaaagtggtatcaatcagagcccaggtcacaacagaggctccagccaaagttgagaaggtttccaagaaagtggatgaaggtgtgattactaacaaattcaggcctaaggatccatatgttggtaaatgtcttctcaacactaagatcactggtgatgatgctcctggtgaaacttggcacatggtcttcagcactgaaggagaggtaccctacaaagaagggcaatctattgggataattgctgatggtgaagacaagaatgggaagcctcacaagcttaggttgtactcaattgctagcagtgcacttggtgactttggagactccaaaactgtttcattgtgtgtaaagaggcttgtctacaccaatgaccaaggagaaatagtaaaaggagtatgctcaaatttcttgtgtgacttgaagccggggtatgatgtgaagataaccggacctgtaggaaaagaaatgcttatgccaaaggatcctaatgcaactgttgttatgcttgcaaccggaactggaattgctcctttccgctccttcttgtggaaaatgttctttgaggagcacaaagactacaagttcaatggtttggcatggctcttcttgggtgtgcccacaagtagctcgttgctctacaaggaggaatttgagaaaatgaaggagaagaaaccagataactttagactcgactttgcagtgagcagagagcaaactaacgagaaaggggaaaagatgtacatccaaactcgtatggcccaatatgcagaagagctctgggaattactcaagaaagacaacaccttcgtttatatgtgtgggctgaaaggaatggagaagggaattgatgacattatggtgtcattggctgctaaagatggtattgaatgggttgagtacaaaaggtcattgaagaaggcagggcaatggaatgtggaagtctactaatttgtgtttcttgtacaaataaatatatatgcctgtttcttgaagctggccctgctctctctatatttaagtgactttttctctgcattgtgtagataggtaaccgaccttctttgtaattcttcttcttttttcctttattcattttccttatagtaccgttgtattgtgatgtctttttcccccaaaaaatcatttttgatggcttggatcaataaatatagtggaaatgtggaaaataacttattccacctct

SEQ ID NO: 1051 - DNA, 1497 bp, Panax ginseng
gttgcacatttctacagtcccaaatatatcaccaacacaatttttatatctttctccctccttcacccccatttacagccatggctgctgctgtgagtgctgcagtctccctcccatcctccaaatccactgccctttcaaccagaacatttatcatctcacccgaaagagtgaacttcactaaggttcctttgagcttcagaaatgtatctggtggtgggaaagtggtatcaatcagagcccaggtcacaacagaggctccagccaaagttgagaaggtttccaagaaagtggatgaaggtgtgattactaacaaattcaggcctaaggatccatatgttggtaaatgtcttctcaacactaagatcactggtgatgatgctcctggtgaaacttggcacatggtcttcagcactgaaggagaggtaccctacaaagaagggcaatctattgggataattgctgatggtgaagacaagaatgggaagcctcacaagcttaggttgtactcaattgctagcagtgcacttggtgactttggagactccaaaactgtttcattgtgtgtaaagaggcttgtctacaccaatgaccaaggagaaatagtaaaaggagtatgctcaaatttcttgtgtgacttgaagccggggtatgatgtgaagataaccggacctgtaggaaaagaaatgcttatgccaaaggatcctaatgcaactgttgttatgcttgcaaccggaactggaattgctcctttccgctccttcttatggaaaatgttctttgaggagcacaaagactacaagttcaatggtttggcatggctcttcttgggtgtgcccacaagtagctcgttactctacaaggaggaatttgagaaaatgaaggagaagaaaccagataactttagactcgactttgcagtgagcagagagcaaactaacgagaaaggggaaaagatgtacatccaaactcgtatggcccaatatgcagaagagctctgggaattactcaagaaagacaacaccttcgtttatatgtgtgggctgaaaggaatggagaagggaattgatgacattatggtgtcattggctgctaaagatggtattgaatgggtcgagtacaaaaggtcattgaagaaggcagggcaatggaatgtggaagtctactaatttgtgtttcttgtacaaataaatatatattatgcctgtttttcttgaagctggccgtgctatctttacgccactttttctctgcattgtgtagaatagataggtaaccaaccttctttgtaattgttcttgttttttcctttattcattttccttatagtaccgttgtattgtgatgtctttttcccccaaaaaatcatttttgagggcttggatcaagcaagaaatatagtggaaatgtgaggaaaaaaaaaaaaaaaacaaaaaaaaaaaacaaaaaaaaaaaaaaaaaaaaaaaaacaaaaaaaaacaaaaaaaacaaaaaaac

SEQ ID NO: 1052 - DNA, 1219 bp, Manihot esculenta
actagcaaggaccttcctttctgcttcaacatcacagccatggccgctgcagttactgctgcagtctcttttccctcctccaagtccacctctctctcttccagaacctctatcgtagctccagatagaatcgcctttaacaaggtgtctgtttattacaaagatgtttcttctggtgggagagtggtttcgatcagagcccaggtcactactgaggctcctgctaaggttaagaaggaatccaagaaaatggaggaaggcgtggttgttaacaagttcaagcctaaaaacccttatattggtagatgccttttgaatactaagatcactggtgacgatgctcctggagaaacttggcacatggtcttctccactgagggagaggttccctatagagaagggcaatctattggcgttattccagatggtattgacaagaatgggaagcctcacaagcttagattgtattcaattgccagcagtgctcttggcgactttggggactccaaaactgtttctctatgcgtgaagaggcttgtgtacgtgaatgaaaatggagaaactgtaaaaggagtctgctcaaattttttgtgtgacttgaaaccaggatctgaagtgaagattacaggaccagttggaaaagaaatgctcatgccaaaagatcccaatgctacaatcgttatgcttgcaactggaactggtattgcgccattccgatcattcttgtggaaaatgttctttgagaagcatgaggattataagttcactggtttggcatggctcttcttgggggtgcccacaagcagctctttactgtacaaggaggaattcgagaaaatgaaggagaaggcccctgacaacttcaggcttgactttgcggtgagcagagagcaaacaaatgagaaaggagaaaagatgtatattcaaactcgcatggcacaatatgcagaagagctatgggagttactaaagaaagataacacctacgtctatatgtgcggattgaaagggatggaaaagggaattgacgacataatggtgtcactggcagctaaagacggcattgattggttggagtacaagaggtcattgaagaaagcagaacaatggaatgtggaagtctactaattcataggcagccattacttgtacaaaaaaaaaactgctttttttgagtgtttgaagcagaggcatcctgtaatgataagttttctcatgc

SEQ ID NO: 1053 - DNA, 1366 bp, Gossypium hirsutum
ctcctccacccacttacataatccataaacattgaaaacaatatcacatccttctattttgtttccttcaccacttttacttcttctgcaacaacaacccccatcagaaataacatattctcctttcttcttatttcttcattataaaaaaagaaaagaaaagacatggctgctgttactgctgcagtctcttttccttctaccaagtccacctctctccctgctagaacctctcttgtctttcctgataggatcaccttcaagaaggtgcccgtttactacagagatgtttgcagtggggggagagtggtttctgtcagggcccaggttacaactgaagctcctgccaaagttgtaaaggaatccaagaaaaatgatgaaggtgttgtggttaacaagttcaggcctatcaacccttacattggtagatgccttctaaacactaagatcactggcgatgatgctcctggagagacttggcacatggtcttcagcaccgaaggagaggtcccctacagagaagggcaatccattggggtgattccagatggcgttgacaagaatggaaaaccacacaagctgagattgtactctattgctagcagtgctcttggtgattttggggactccaaaactgtatccctatgtgtgaaacgactggtatacaccaacgagaaaggagagcttgtaaaaggagtctgctccaatttcttgtgtgacttgaaacctggggcggaagttaaaataactggacctgttggaaaagaaatgcttatgccaaaggatcccaatgccacaatcatcatgctcgctactggaactggaatcgctccctttcgatcatttctgtggaaaatgttcttcgagaagcatgacgactacaagttcaacggtttggcatggctcttccttggtgtccccacgagtagttcattgctatacaaggaggaattcgagaaaatgaaggagaagaacccagaaaacttcaggctggactttgcagtgagcagggaacaaacaaacgagaaaggagaaaagatgtacattcagacacgaatggctgaatacgcgaaagagctatgggaattgctgaagaaagacaacaccttcgtctacatgtgtgggttgaggggaatggagaagggaattgatgacataatggtctcactcgctgcagctgatggtatcgactgggccgagtacaaaaagcagttgaagaaagctgagcagtggaatgtggaagtctactaaatacatatatatatatatatggatcacgtgtacaaaataatcatctcccttttcattttcttttttttagcacccgccccgacctataagaatttccaatgcattgtgtagagag

SEQ ID NO: 1054 - DNA, 1573 bp, Panax ginseng
aacacaattttcttatcctcacatctgccactgcataggcttcccaatctcctccacccaatccataatccactgatattttcccttaaacaaataatccaaaacaactctctctctattcttcattcacttgcacatttctacagtcccaaatatatcaccaacacaatttttatatctttctccctccttcacccccatttacaaccatggctgctgctttgagtgctgcagtctccctcccatcctccaaatccactgccctttcaaccagaacatttatcatctcacccgaaagagtgaacttcactaaggttcctttgagcttcagaaatgtatctggtggtgggaaagtggtatcaatcagagcccaggtcacaacagaggctccagccaaagttgagaaggtttccaagaaagtggatgaaggtgtgattactaacaaatttaggcctaaggatccatatgttggtaaatgtcttctcaacactaagatcactggtgatgatgctcctggtgaaacttggcacatggtcttcagcactgaaggagaggtaccctacaaagaagggcaatctattgggataattgctgatggtgaagacaagaatgggaagcctcacaagcttaggttgtactcaattgctagcagtgcacttggtgactttggagactccaaaactgtttcattgtgtgtaaagaggcttgtctacaccaatgaccaaggagaaatagtaaaaggagtatgctcaaatttcttgtgtgacttgaagccggggtatgatgtgaagataaccggacctgtaggaaaagaaatgcttatgccaaaggatcctaatgcaactgttgttatgcttgcaaccggaactggaattgctcctttccgctccttcttatggaaaatgttctttgaggagcacaaagactacaagttcaatggtttggcatggctcttcttgggtgtgcccacaagtagctcgttgctctacaaggaggaatttgagaaaatgaaggagaagaaaccagataactttagactcgactttgcagtgagcagagagcaaactaacgagaaaggggaaaagatgtacatccaaactcgtatggcccaatatgcagaagagctctgggaattactcaagaaagacaacaccttcgtttatatgtgtgggctgaaaggaatggagaagggaattgatgacattatggtgtcattggctgctaaagatggtattgaatgggtcgagtacaaaaggtcattgaagaaggcagggcaatggaatgtggaagtctactaatttgtgtttcttgtacaaataaatatattatgcctgttttcttgaagctggccgtgctatctttacgccactttttctctgcattgtgtagaatagataggtaaccaaccttctttgtaattgttcttgttttttccttttattcattttccttatagtaccgttgtattgtgatgtctttttcccccaaaaaatcatttttgagggcttggatcaagcaagaaatatagtggaaatgtggaaaataacttattccacctcaaaaaaaaaaaaaa

SEQ ID NO: 1055 - DNA, 1630 bp, Eucalyptus grandis
aaaacaagtagcagtggccaccaagaggtttcaagtactgtggagggtgagagccatacattcatttcaacgccaccgtagacttatccacacccctgccactgcattggcctcaaaatctcctccacccaatccataatccactctgcccctctttttgatcctattctctcacattcttcacctctcactccttgaccgcactcccccataaattaatctctcattcctgagaggatctttctcccccaccatctgtatctgctgcttgccgttggctcttgatcagctctgcaacaatggctgctgcagtgactgcttcagtgtctctcccttcctcctccaagtctacttctctccctgccagcagaacctccatcatctccactgaaaggatcaacttcaagaaggtccctgtgcattacagagatgtgtgtggtggtgggaggatggtgtctgccattagagcgcaggtcaccacggaggctccagctaaggttgtcaaggagtccaagaaaatggacgagggtgtggttgtgaacaagttcaagcccaagaacccttacattggaaggtgcctcctcaacacgaagatcactggcgatgatgctcctggagagacctggcacatggtcttcagcacagagggtgaggtgccatacagagaagggcaatcgattggggtcattcctgaaggtattgacaagaatgggaagccacacaagctgagactatactcaatcgccagcagtgcccttggtgattttggagactccaagactgtttctctgtgtgtgaagcggctcgtttacaccaacgaaaacggagaactcgtgaaaggagtctgctcaaatttcttgtgtgacttgaaacctggggcagaagtgacgatcacaggaccagttggaaaagaaatgcttctgcctaaggatcctaatgccaccgtcattatgcttgccaccggtactggaatcgctccatttaggtctttcttgtggaaaatgttctttgagaagcacgaagactacaagttcaacggcttggcttggctattcttgggtgtgcccacaagcagctctctgctctacaaggaggagtttgagaagatgaaggagaagaagccggataacttcaggctcgattttgctgtgagccgagagcaaacgaatgagaagggtgagaagatgtacatccagacccggatggcgcaatatgctgaagaactgtgggagttgctcaagaaggacaacacttacgtctacatgtgcggtcttaagggaatggagaaggggatcgacgacatcatggtctcgttggctgctaaagacggcatcgactggctggagtacaagaggcagttgaagaagtctgagcaatggaacgtggaagtctattagatccttctggttcatatcgtatcatatcgtatctctccttttttttctcacttcagaaatccttgtgtagataggcaaagtttactgtaatattctatctttttttgcatatttctacttcaatacaagcagaatatgtttgccttggcctctacaaaggattgtacttttgagatcctatgtaccataacttcatttatatggatgccaacttcgacaaccttgcatggcca

SEQ ID NO: 1056 - DNA, 1242 bp, Daucus carota
tttgctaccaagttttttacttgacaattttttttctctcttttacaacaatggctactgcactcactgctgcactctctctccattcctctaaaacaccttccatttccaccacaccatctatcttgtctactgacagacttaactttaccaaggttcctttgacatttagaaatgtgtctagtggggggaaaatggtatctattagagctcaggtgaccactgaggctccggctaaagttgagaaggtttcgaagaaagtggaggaaggtgtggttactaataaattcaggcctaaggaaccttatgttggtaaatgcctcctcaacactaagatcactggtgatgatgctcctggggagacttggcatatggtcttcagcactgaaggagaggtgccatacaaggaagggcaatccattggaattattgcagatggtgaagacaagaatgggaagcctcacaagctcaggttgtactcaattgctagcagtgccctcggagactttggcgactccaagactgtttcactgtgtgtcaaaaggcttgtctataccaatgaccaaggcgaagtagttaagggagtatgctcaaatttcttgtgtgacttaaagcccggtgctgatgttaagataactggacctgttggaaaagaaatgcttatgccaaaggatcctaatgcaactgttgttatgcttgctactggaactggaattgcacctttccgatccttcttgtggaaaatgttcttcgagaagcatgaggactaccagttcaatggtttggcatggcttttcttgggtgtgcccacaagtagctcgttgctatacaaggaggaatttgagaaaatgaaggagaagaaaccagacaactttaggcttgactttgcagtgagcagagaacaaacaaacgcgaaaggagaaaaaatgtacatccagacccgcatggctgaatacgcagaagagctctgggaattacttaagaaagacaacaccttcatctatatgtgcggtttgaaaggaatggaaaagggaatcgatgacattatggtttcattggctgctaaagatggtattgattggatcgaatacaagaggtcactcaagaaggcaggacaatggaacgtagaagtctactaatttcgggtttcttgtacaaattgtatgcctattcttgaaactccccacgctcctctgaattctgtagatagacgatcaaatttctttgtactgcaactttttt

SEQ ID NO: 1057 - DNA, 1238 bp, Daucus carota
catcactagtactagtaccactaccatccatctatcatttctctcatttctaaactatggctactgcagtcagtgctgcagtctctctaccatcttccagctcaacttcgctttccaccagaacgtctttcatttctactgacagacttagcttcgccaaggttcctttgacatttagaaatgtatctagtggggggaaactggtatctattagagctcaggtgacaacagaggctccggctaaagttgagaaggtttcgaagaaagtggatgaaggcatagttaccaataaatacaggcctaaagagccatatgtcggtaaatgccttctcaacactaagatcaccggggatgatgctcctggagagacttggcatatggtgttcagcactgaaggtgagatcccctacaaggaagggcagtccattggaattattgcggatggcgaagacaagaatgggaaacctcacaagcttaggttgtactctattgctagcagtgccattggagacttcggggactccaaaactgtctcattgtgtgtaaaaaggcttgtttataccaatgatcaaggcgaagaagttaaaggagtatgttcaaattacttgtgtgacttaaagccaggggctgatgttagtataactggacctgtaggaaaagaaatgcttatgcccaaggatcccaatgcaaccgttattatgcttggtactggaactggaattgcacctttccgatccttcttgtggaaaatgttcttcgagaagcatgaggactaccagttcaatggtttggcatggcttttcttgggtgtgcccacaagtagctcgttgctatacaaggaggaatttgagaaaatgaaagagaagaaaccagacaactttaggcttgactttgcagtgagcagagaacaaacaaacgcgaaaggagaaaaaatgtacatccagacccgcatggctgaatacgcagaagagctctgggaattacttaagaaagacaacaccttcatctatatgtgcggtttgaaaggaatggaaaagggaatcgatgacattatggtgtcattggctgctaaagatggtattgattggatcgaatacaagaggtcactcaagaaggcaggacaatggaacgtagaagtctactaatttcgggtttcttgtacaaattgtatgcctattcttgaaactccccacgctcctctgaattctgtagatagacgatcaaatttctttgtactg

SEQ ID NO: 1058 - DNA, 1484 bp, Phaseolus vulgaris
ttctctgcaatcaaaacaacaaaaatcattcatactcacatccctcactactactactacacaatattcatcatttcattcaacatttcactagctgctttcacaaatggctgctgctgttagtgctgcagtctcttttccatccaccaagtctacctctcttccatgtaggacctccatcattgccccagagagagtcattttcaagaaggttccatttcaatacagagatgtttctagcagtggaagggtagtttccatcagagctcaagtcaccactgaagcaccagccaaggttgaaaaagagtctaagaaacaggatgaaggtgtgattgtgaacaagttcaaacccaagaccccatacattggtagatgccttctcaacacaaagatcactggggatgatgctccaggagaaacttggcacatggtcttcagcaccgagggagaggttccttacagagaaggacaatcaattggagtaattcctgagggtgttgacaagaatggcaaacctcataaactgagattgtactctattgccagcagtgccattggtgactttggtgattccaagactgtttctctgtgcgtgaaacgactagtgtacacaaatgacagtggagaaattgtcaagggagtctgctcaaatttcttgtgtgacctgaaaccaggatctgaagtaacgataactggacctgttgggaaagaaatgcttatgccaaaagatcctaatgccactgttgtcatgttggcaactggaactgggatcgccccatttcgctcatttttatggaaaatgttcttcgagaagcacgaagattacacgttcaatggtttggcatggctcttcttgggtgtccctacaagcagctcattgctttataaggaggaatttgaaaagatgcaggagaaataccctgagaacttcaggcttgactttgctgtgagcagagaacaaacaaatgagcaaggagagaagatgtacatccaaactcgaatggctcaatatgcagaagagctctgggaactactgaagaaggagaatacttttgtgtatatgtgtggactaaaaggaatggaaaagggaattgatgacattatgggatcattggctgccagagatggcattgattggattgaacacaagaagaaattgaagaaagcagagcaatggaatgtggaagtctattaatttgtgttcacttgcacagacagatatgaactcctgcttcatgctgcaacaagtctcaagtctatcacccctcctgcgttgtgtagatatgtgaccaccctgtaattttttctttgaccatttttatactgttcatcaacaatttcattgccagttttacaagtactctttttgagggatgatccaatatagatgaatccaactttattatgtcatttgcaagtaattcctaggtctctcactatcaaacacataccaaaaacactacattaggcacaactttaatcag

SEQ ID NO: 1059 - DNA, 1354 bp, Fagus grandifolia
cattgtagtcatggctactgcagtgactgctacggtctcctttccatcctccaagtcagcttctctgtcttccagaacctctattatctcaccagaaagaatctccttcaagaaggttcctctgcagtatagggatgtttctgttggtggaagagcggtttcgatcagagcccaggtcaccacagaggctcctgctaaggttgagaagaaggaatccaagaaaatggaggaaggtgttgtagtgaataagtacaaaccgaaaaacccttacattggtagatgcctccttaacactaagattaccggtgatgatgctcctggagaaacttggcacatggtcttcagtactgatggagagatcccttacagagaagggcaatcagttggggtaattccagatggtattgacaaaaatggcaagcctcacaagctgaggttatactcaattgccagcagtgccattggtgactttggagactccaaaactgtttctctgtgtgtgaaacggcttgtgtacactaatgataaaggagaaattgttaaaggagtatgctcaaatttcttgtgtgacttgaaagctggagctgaagtgactttgacaggaccagttggaaaagaaatgcttatgccaaaagatcccaatgccaccgtcatcatgcttgcaactggaactgggattgctcctttccgctcatatttgtggaaaatgttctttgagaagcatgatgactacaagttcaatggtttggcttggctcttcttgggtgtccccacaagtagctcactgctttataaggaggaatttgagaaaatgaaggagaagtaccccagcaattttaggcttgacttcgctgtgagtagagagcaaaaaaatgagaaaggtgagaagatgtacatccaaacccgaatggctcagtatgcagaagagctatgggaattgcttaagaaggataacacctatgtctatatgtgtgggctgaaggggatggaaaagggaattgatgacataatgctgtcattggccgctaaagatggcattgattggttggactacaaaaagcagttgaagaaggcagagcaatggaatgtggaagtatactaatgcctgattacttgtacaaatttcaatcactttacttttaagcggcaaccgatcaatgatttccactgcattctgtagataggtaatgccattgtaatttttcttttattttttcttcctttcttaatgaagaagttgtattggtatagcctctacaggagttttatttatgaggggttatagattatagtcataaatatagttgaagccaacttcaacttctttttacgaattttcaacttcatttttcac

SEQ ID NO: 1060 - DNA, 1215 bp, Bupleurum chinense
tttctttcatttacaatccaatggctactgcagttagtgctgcagtctctcttccatcatccaagtcaaattccatttcatccagaacatctatcatatctcctgatagacttaactttattaaggtacctttgacattacgaaatgtatccagtggtgggaaaatggtgtttatcagagctcaggtggcaacagacgctccagctaaagttgagaaggtttcgaagaaagttgaagaaggtgtgatcactaataaattcaaacccaaggaaccttatgttggtaaatgtcttcttaacaccaagatcaccggtgatgatgctcctggcgagacctggcatatggtcttcagcaccgaaggagaggtaccctacaaggaagggcaatccattgggattattgctgatggtgaagacaagagtgggaagcctcataagctcaggttgtactcaattgctagcagtgccattggagactttggggactccaaaactgtttcgttgtgtgtaaaaaggcttgtctataccaatgaccaaggtgaagaagttaaaggtgtatgctcaaattacttgtgtgacttaaagccagggtctgatgtgaagataactggaccagtaggaaaagaaatgcttatgccaaaggatcccaatgcaactgtcattatgcttggtactggaactggaattgcacctttccgctccttcttgtggaaaatgttcttcgagaagcatgaagactatgagtttaatggtttggcatggctcttcttgggtgtgcccacaagtagctcattgctctacaaggaggaatttgagaagatgaaagagaaaaaaccagaaaactttagacttgactttgcagtaagcagggaacaaacaaatgccaaaggagaaaagatgtacatccagacccgcatggctgaatacgcggaagagctctgggaattactcaagaaagacaacacattcatctatatgtgtggtttaaaaggaatggaaaagggcattgatgacattatggtgtcattagctgccaaagaaggtattgattggaatgaatacaaaagatcactgaagaagtcaggacaatggaatgtcgaagtatactaatttcggggtttcttgtacaaatgtatgcctattcttaaaagtaactccatgatcattgctccatcttatacctcagtttactgtgcatcctgtacataggtaagca

SEQ ID NO: 1061 - DNA, 1250 bp, Coffea canephora
ttcgtcaaaacataatctttactttgctgtcttctttatactaccacttcacttctcgcttattttcttctccatcttttttttcctttgatactctaatcatcatggctactgcagtcactgctgcagtgtcacttccatcctccaaaacttctgcttctctttcatccaaaacatcaattatctcaccagaaagaatcaatttcgttaaggttcctctgtactataaaaatgtgtctataggcaggaaattggtttcaatcaaagctcaggtcaccactgaggcccctgcaaaagtacaaaaggtttccaaaaaacaggaaaaaggtgttgggacaaacaagtacaaaccaaaggatccatatatgggcaaatgcctccttaacactaaaatcactggggatgatgcgccgggaaaaacttggcacatggtcttcaccacggagggggaactcccttacagggaaggtcagtcaattggggttatagcaaatggagttaacaaaaatggaaagcctcacaagctgaggttgtattcaattggtagcagtgctcttggtgacttcggggattccaaaactgtatctctctgtgtcaagcggctcgtctatacaaatgaccaaggggaaattgttaaaggagtttgctcaaacttcttgtgtgatctgaaacctggagctgaagtaaaaatcactggacctgtcgggaaagaaatgctaatgccaaaagatccaaatgctaccgttgttatgcttgccactggaacaggaattgctcctttccgtggattcttatggaaaatgttctttgagaagcacgacgattacaagttcaacggattggcatggcttttcttgggtgttcccaccagcagctcattgctatacaaagaggaattcgagaagatgaaggaaaagcatccagacaactttcgactagactttgcagtgagcagagagcaaaccaatgagagaggtgagaagatgtatatccaaaccaggatggctcagtatgcagaggagttgtgggaattgctcaagaaagacaacacctttgtgtacatgtgcgggctcaaaggcatggagaagggaatcgatgacattatggcgtcattggctgccaaagatgggatcgattgggctgagtataaaaagcagttgaagaagggcgagcaatggaatgtggaagtctactaatttttgctttcttgtacaaaaaattgaaataaatacatgcccattattatgtga

SEQ ID NO: 1062 - DNA, 1328 bp, Tropaeolum majus
ccaattcctggttcacatttccctctcatcttcaacatcacagtgatcatggccactgcagttagtgctgcagtctctcttccttcttccaactccacctcattaatccctaccagaacctcaatcacctctgctgaaagagtttccttcaaaaaggccactctccatggatgtggtggaaggagagttgtatccattagagctcaggtaactactgaagctccagcaaaagtcgagaagatttctaagaagcaggaggaaggtattacggttaacaaattcaaacccaagaatccttacactggtagatgccttttgaacactaaaatcactgctgatgatgctcctggtgagacttggcatatggtcttcagtactgaaggagaggttccttatagagaaggacaatctattggggtgattgctgatggtgttgacaagaatggaaaacctcacaaactgaggttatactcaattgcaagtagtgctcttggtgattttggagactccaaaactgtttctttatgtgtgaaacgactcgtgtacaccaatgatcaaggagaagttgttaaaggagtctgctcaaatttcttgtgtgatttgaaacctggggctgaagtaaaaatcacaggacctgtcgggaaagaaatgcttatgccaaaagatcccaatgctaccgttatcatgcttgcaacaggaaccggaattgctcctttccgatcatttttgtggaaaatgttctttgaaaaatatgatgactacaagttcaatggattggcatggctgttcttgggtgttccaacaagtagctcattgctctacaaggaggaattcgagacgatgcagagcaaacatccagacaacttcaggctcgacttcgctgtgagccgagagcaaacaaacgagaagggtgagaaaatgtacatccaaacccgaatggctcaatacgcaagggagttatgggaattactcaaaaaaagacaacacctatgtctacatgtgtgggttaaaagggatggagaaaggaattgacgacattatggtttcgttggcagctgaagacggtattgattggttagattacaagaagcagttgaagaaagctgagcaatggaatgttgaagtttactgaaattttttctcatacgataccgttcttttctttcttttgtaatcgatagtatattgaagttttcattgtatcgtgtagatataaaaaatgtctgcaatctactttatgttgttcggtggcatctataaaaattgaagtgattttgggcgactgaataattttgtttacatgctcgagaattagcaggaaaacatag

SEQ ID NO: 1063 - DNA, 1310 bp, Vinca minor
gcattcccctctaaaatctcatccacccaatcctgcataatctcactattacctttctcttcattctccatcacttctttcttttctgtgtaatcatcagaaatggctactgctgcagtcagtgctgcagtttctctcccttctataaaatcttcttcttctatttcaactaccagaacgtctataatctcaactgaaagagttaactttaacaaggttcctttgtattaccggagtgtttcttctggtgggaaagttgttgcttccatcagagcccaggtgactacagaggctcctgctaaggttgagaaagtttccaagaaaaatgaagaaggggtgatagtgaacaagtacaagccaaaggaaccatacattgggaggtgtctacttaacactaagatcactggtgatgatgcaccaggagaaacttggcatatggttttcaccactgagggagaagtcccgtatagagaaggccagtcaattgggattattcctgatggaattgatcccaagaatggaaagcctcacaagctgaggttgtactctattgctagcagtgccattggtgactttggagattccaaaactgtttctctgtgtgttaaaaggcttgtctataccaatgataatggagaactagttaaaggagtttgttcaaacttcttgtgtgatttgaaacctggagcagacgtgaaaattactggacctattgggaaagaaatgctcatgcctaaggatcccaatgccaccgtaatcatgcttggcactggaactggaattgctcctttccgtagtttcttgtggaaaatgttctttgagaagcacgatgactaccagttcaatggtttggcatggcttttcttgggtgttccaacaagcagttcccttctttacaaggaggaatttgagaaaatgaaggaaaaatatccagagaatttcagactcgactttgctgtcagcagagagcaaaccaacgagcaaggtgagaagatgtacatccaaaccaggatggctcaatatgcggaggagctatggcaactactcaagaaagacaacacttatgtgtacatgtgtggactgaagggaatggagaagggtattgatgacattatggtatcattggctgctagagatggtattgattggttggaatacagaagacagttgaagaaggctgagcaatggaatgtggaagtctactaattctacttccttgtacaaatgtaagtcattattacataattttctctgcttcgataatgtagataggtattattccttctgctatttgttgtttttctttaaat

SEQ ID NO: 1064 - DNA, 1540 bp, Prunus persica
ctcacatctgccactgcattggccttcaaatctctaccaccaatctataatccagaaccaaccaaaaaatatcccattttcacaaattttctcaatcttcaccagaaccccataaaacatcgcactttgcttctttttatctcttcttccctattattcttcttcttctgcagcattaacacaacaaccatggctgcagctgtaactgctgctgtctcattcccatcctccaagtcctcctctcttcccagcaggacctctataatctcacctgatagaatcaccctcaagaaggttcctctgtactacagagatgcctctgctagtgggagagtggtttccatcagagcccaggtcaccactgaggctgctcctcctgccaaggttgtgaaggaatccaagaagcaagatgaaggtgtggttgttaacaaatacaagcccaaaaatccctacactgccagagtccttctcaacactaagatcactggtgatgatgctcctggagaaacctggcacatggtcttcagcactgagggagagattccctacagagaagggcagtccattggagtaattccagatggtattgacaagaatgggaagcctcacaagctgaggttgtactcaattgccagtagtgcccttggtgactttggtgactccaaaactgtttctctgtgtgtgaaacggcttgtgtacaccaatgaccaaggagaaattgttaaaggagtgtgttcaaactttttgtgtgacttgaagccagggagtgaagtcacggtcacaggaccagttggaaaagaaatgcttatgccaaaagatcctaatgcaaccatcgtcatgcttgcaaccggaactggaattgctcctttcagatcattcttgtggaaaatgttttttgagaagcatgaagactacaagttcaatggtttggcatggctcttcttgggtgttcccacaagtagctcactgctttacaaggaggaatttgagaaaatgaaagagaaggtccccgaaaacttcaggcttgacttcgctgtcagcagagagcaaaccaatgagaagggcgagaagatgtacattcaaaccagaatggctcagtatgcagaagagctatgggagttgctcaagaaagacaacacctatatctacatgtgtggtctcaagggaatggagaagggaattgatgacatcatggtgtcattggctgctaaagatggcattgactggatagactacaagaagaagttgaagaaagcagagcaatggaatgtggaagtctactaatttctggtcactttgtacaaatatctctctctctctctctccttctttacttaaaagttgaaacagaaattcttgaatgatttccactgcagtgtgtagataggtaaagtccttgcaaattttctgtaatttttttgttgttgccatattaatgaagctgttgtattatactataattatggcccccaagaattttatttctgagggtcgaattttacactcaagtggaagcctgtttcaacttttatactctaaa

SEQ ID NO: 1065 - DNA, 1271 bp, Triphysaria pusilla
tttcttagctcatcataaacatggctgctgctgttagtgctgcagtctctctgccttcctccaaatccacttctctttcagctagaaccgcctttatttctccggaaagaaccaatttcaaaaagggccccttgtactataggaatgtggtgtcgtcaggtcgtgccaatgttttgtcgatcaaagcccaagtaaccacagatgcacctgtcaaggcagagaaagtccacaaaaaacaggaagaaggggtagttgtcaacaagttccggcccaaggaaccatatattggcagggtccttcttaacacaaagatcaccggtgatgacgcccctggtgagacctggcacatggtcttcagcactgagggtgaggtgccctatagagaagggcagtcaattggagtgatcccagatggtatagataagaatgggaagcctcacaagctgaggctttactcgattgccagcagtgccattggtgactttggagactccaagactgtatctttgtgtgtgaaaaggcttgtttacaccaatgaccaaggggaaacagttaaaggagtttgctcaaactttttgtgtgatttgaaacctgctgctgaagtgaaaataactggacctgtgggtaaagagatgctcatgccaaaagaccctaatgctaccataattatgcttggcactggaactggaattgctccttttcgctcattcttgtggaaaatgttctttgagaagcatgaagactataagttcaatggtttagcgtggctattcttgggtgttcctaccagcagttcattgctgtacaaagaggaattcgagaaaatgaaggagaaaaacccggaaaacttccgtctggactttgccgttagcagagaacagacaaatgacaaaggggagaagatgtacatccaaactcgaatggctgaatatgcagaagagctatgggaaatgcttaagaaagaaaacacctttgtctacatgtgtgggttgaagggcatggagaagggaatcgatgacataatgctttccttggctgctaaagatgggattgattggttagactacaaaaagcagttgaagagagcagaacaatggaatgtggaagtctactagttcttgctcaatgttattgtacaaatatcaagcagcgtcatgattttctttgtgctgatgtagatgggtaaccttctttttgtgtcatattcttattgccctccggatgtaaaaaattgaggggatagtactaaaaagataatagtgaaacaagtt

SEQ ID NO: 1066 - DNA, 1238 bp, Daucus carota
gctaccaagttttttacttgacaatattttttctctgttttacaacaatggctactgcactcactgctgcactctctctccattcctctaaaacaccttccatttccaccacaccatctatcttgtctactgacagacttaactttaccaaggttcctttgacatttagaaatgtatctagtggggggaaaatggtggctattagagctcaggtgaccactgaggctccagctaaagttgagaaggtttcgaagaaagttgaggaaggtgtggttactaataaattcaggcctaaggaaccttatgttggtaaatgcctcctcaacactaagatcactggtgatgatgctcctggggagacttggcatatggtcttcagcactgaaggagaggtgccatataaggaagggcaatctattggaattattgcagatggtgaagacaagaatgggaagcctcacaagctcaggttgtactcaattgctagcagtgccctcggagactttggcgactccaagactgtttcattgtgtgtcaaaaggcttgtctataccaatgaccaaggcgaagtagttaagggagtatgctcaaatttcttgtgtgacttaaagcctggtgctgatgttaagataactggaccggttggaaaagaaatgctcatgccaaaggatcctaatgcaactgttgttatgcttgctactgggactggaattgcacctttccgatccttcttgtggaaaatgttcttcgagaagcatgaggactaccagttcaatggtttggcatggcttttcttgggtgtgcccacaagtagctcgttgctatacaaggaggaatttgagaaaatgaaggagaagaaaccagacaactttaggcttgactttgcagtgagcagagaacaaacaaacgcgaaaggagaaaaaatgtacatccagacccgcatggctgaatacgcagaagagctctgggaattacttaaaaaagacaacaccttcatctatatgtgcggtttgaaaggaatggaaaagggaatcgatgacattatggtttcattagctgctaaagatggtattgattggatcgaatacaagaggtcactcaagaaggcaggacaatggaacgtagaagtctactaatttcgggtttcttgtacaaatgtatgcctattcttgaaactccccatgctcctctgcattctgtagatagacgatcaaatttctttgcactgcaactttttt

SEQ ID NO: 1067 - DNA, 1224 bp, Daucus carota
aagttttttacttgacaattttttctctcttttacaacaatggctactgcactcactgctgcactctctctccattcctctaaaacaccttccatttccaccacaccatctatcttgtctactgacagacttaactttaccaaggttcctttgacatttagaaatgtatctagtggggggaaaatggtggctattagagctcaggtgaccactgaggctccagctaaagttgagaaggtttcgaagaaagttgaggaaggtgtggttactaataaattcaggcctaaggaaccttatgttggtaaatgcctcctcaacactaagatcactggtgatgatgctcctggggagacttggcatatggtcttcagcactgaaggagaggtgccatataaggaaggacaatccataggaattattgcagatggtgaagacaagaatgggaagcctcacaagctcaggttgtactcaattgctagcagtgccctcggagactttggcgactccaagactgtttcattatgtgtcaaaaggcttgtctataccaatgaccaaggcgaagtagttaagggagtatgctcaaatttcttgtgtgacttaaagcccggtgctgatgttaagataactggacctgttggaaaagaaatgcttatgccaaaggatcccaatgcaactgttgttatgcttgctactggaactggaattgcacctttccgatccttcttgtggaaaatgttctttgagaagcatgaagactatgagttcaatggtttggcatggctctttttgggggtgcctacaagtagctcgttgctgtacaaggaggaattcgagttaatgaaagagaagaaaccagaaaattttagactcgactttgcagtgagtagagaacaaacaaatgcaaaaggagaaaagatgtacatccagactcgcatggcagaatacgcagaagagctctgggaattacttaagaaagacaacaccttcatctatatgtgcggtttgaaaggaatggaaaagggaatcgatgacattatggtgtcattagctgctaaagatggtattgattggatcgaatacaagaggtcactcaagaaggcaggacaatggaacgtagaagtctactaatttcgggtttcttgtacaaatgtatgcctattcttgaaactccccatgctcctctgcattctgtagatagacgatcaaatttctttgtactgcaac

SEQ ID NO: 1068 - DNA, 1549 bp, Daucus carota
cacaaacacagctcaaatttctttttcttatcctcacacccgccactgcattgtcttaaaattctcctccacccgatatataatccacttatattcgacccatcaaaaaatctaatactcttgtttactaaacatacatcactagtactattaccactaccatccatctatcatttctctcatttctaaactatggctactgcagtcagtgctgcagtctctctaccatcttccagctcaacttcgctttccaccagaacgtctttcatttctactgacagacttagcttcgccaaggttcctttgacatttagaaatgtatccagtggggggaaactggtatctattagagctcaggtgacaacagaggctccggctaaagttgagaaggtttcgaagaaagtggatgaaggcatagttaccaataaatacaggcctaaagagccatatgtcggtaaatgccttctcaacactaagatcaccggggatgatgctcctggagagacttggcatatggtgttcagcactgaaggtgagatcccctacaaggaagggcagtccattggaattattgcggatggcgaagacaagaatgggaaacctcacaagcttaggttgtactctattgctagcagtgccattggagactttggggactccaaaactgtctcattgtgtgtaaaaaggcttgtttataccaatgatcaaggcgaagaagttaaaggagtatgttcaaattacttgtgtgacttaaagccaggggctgatgttagtataactggacctgtaggaaaagaaatgcttatgcccaaggatcccaatgcaaccgttattatgcttggtactggaactggaattgcacctttccgatccttcttgtggaaaatgttctttgagaagcatgaagactatgagttcaatggtttggcatggctctttttgggggtgcctacaagtagctcgttgctgtacaaggaggaattcgagttaatgaaagagaagaaaccagaaaattttagactcgactttgcagtgagtagagaacaaacaaatgcaaaaggagaaaagatgtacatccagactcgcatggcagaatacgcagaagagctctgggaattacttaagaaagacaacaccttcatctatatgtgtggtttgaaaggaatggaaaagggaattgatgacatcatggtgtcattagctgctaaagaaggtatcgagtggattgaatacaaaaggtcactgaagaaggcaggacaatggaacgttgaagtgtactaatttcgggttttttgtacaaatgtatgcctattcttgaaacttcacgctcaatccatatttcacttttctctgcattctgtagatagttaatcaacttccttgtgacccttgtttcttgtattacatttcagttcttcattactgttgtattgtaaattgttcaatgtccttttccaaaagaaattgtacttttgagggtctggatcatgatatatagttaaaatgtagaatataacttcttcgatctctatctccacacacacactat

SEQ ID NO: 1069 - DNA, 1498 bp, Manihot esculenta
gagagtcatacactaaattactcgagtactgagtactgacttatcctcacatcaaccactgcattggcctcaaaatctcatccacgcaactgtaatccatttccaacccaaaaatcctacactggcctcactactattcatcccctgaaggagcttcctttcctcctcttcttctctttcttttcatcatcacaaccatggccgctgcagtaactgctgcagtctcttttccttcctccaagtccacctctctctcctcaagaacctccatcgtagctccagagagaatcacctttaagcaggttcctttttattacaaagatgtttctgctggtgggagagtggtttccatcagcgcccaggttaccactgaggctcctgctaaggttaagaaggaatccaagaaaatggaggaagatgttgtcgttaacaagttcaagcctaaaaacccttatattggcagatgccttttgaatactaagatcactggtgatgatgctcctggagaaacttggcacatggtcttcagcactgagggagaggttccctacagagaagggcaatctattggggtaattccagatggtatcgacaagaatgggaagcctcataagctgagattgtattcaattgccagcagtgctcttggtgattttggagactccaaaactgtttctctttgtgtgaagcggcttgtgtatgtcaatgaaaaaggagaaactgtaaaaggagtctgctcaaatttcttgtgtgacttgaaacctggatcagaagtgaagattacaggaccggttggaaaagaaatgctcatgccaaaagatcccaatgccacaatcatcatgcttgcaactggcactggcattgcgcctttccgatcattcttgtggaaaatgttctttgagaaacatgatgattacaagttcaatggcttggcatggctcttcttgggtgttcccacaagtagttcattgctctacaaggaggaatttgagaaaatgaaggagaaggttccgaacaacttcaggcttgactttgcagtaagcagagagcagacaaatgagaaaggagaaaagatgtatatccaaactcgcatggctcaatatgcagaagagctgtgggagttgctaaagaaagataacacctatgtctatatgtgtggattgaaagggatggaaaagggaattgacgacataatgctatcacttgcagctagagatggcattgattggttggagtacaaaagatcattgaagaaagcagagcaatggaacgttgaggtctactaatgagagagagagagagagagggagagattacttgtacaagaatcttctctgtgcattgtgtagataagcaatatgactgcaatttttcactaaatttttttgccctttttttataaatcaaagcattgtaacgttatggctcttacagaaagttctcatttctaagggaatcaaagatcaagaataattaatggaagccgacttctttttcc

SEQ ID NO: 1070 - DNA, 1239 bp, Scabiosa columbaria
taaattatcaccataatttgtctgcacaagaaaagaaaaatcatcatcaatggctactgcggtaactgctgcagtctctcttccatcttccaagtctacatccctttcaaccagaacatcatcatcatccctttctctcttctcccccgaacgaattaaggttccattgtactacaagaatgtcagtggtggtgggaaaatggtatcaattagagcccaggttacaacagaggcacctgctaaggttgagaaaatatcaaagaaaaatgaagaaggggtagttgtgaacaaattcaagcctaaaaatccctacaccggtatgtgccttctcaacaccaagatcactggtgatgacgcaccgggggagacttggcacatggtcttcagcactgagggagaggtgccatacagagaagggcaatccatcggtataattccagatggtattgacaaaaatgggaagcctcacaagttgagattgtactccattgctagcagcgccattggtgactttggggactccaaaactgtttctttgtgtgtgaaaaggcttgtgtacacaaatgaccaaggagaagtagttaaaggagtctgctctaatttcttgtgtgatttgaaacccggatcccaagtgaaaataactggacctataggaaaagaaatgcttatgccaaaggatcctaatgcgaccattataatgcttgcaactggaactggaattgctcctttcagatcgtttttgtggaaaatgttctttgagaagcacgaggactacaagttcaacgggttggcatggctcttcttgggtgtccccacaagcagctcgctactttacaaggaggaatttgagaaaatgaaagagaagaacccagacaatttcagacttgattttgctgttagcagagagcaaactaatgagaaaggcgagaaaatgtacatacaaacacgaatggctgagtatgcggaagagctatggcaattacttaagaaagacaacactttcgtttatatgtgtgggcttaaaggaatggaaaaaggcattgatgatatcatggtttcattggctgctagagagggaatcgactggatcgagtacaaaaggcaactgaagaaggcggagcaatggaatgtggaagtgtactaataaattgagcttctctttgtacaaatatacatcctatcattaattcttgaagctattaagtgctactcttcatgtgatatttccatgctatggtg

SEQ ID NO: 1071 - DNA, 1413 bp, Primula obconica
ccaaaatcaatcccgttattttccttttcagtctttcttcatcactcccaaaccaaattctctctctctctctctctctctctccatggctggagcagtgagtgtcgcagtctctctcccaacctccaaatcctcagccctccaaaccagaacatcatttgtctcaacctcagaaagaatcaccttcaacaaggttgcctttccctatagaaatgtctcagcaggagggaaattgggtttggtcattagagcacaggtcacaacaactgagacccctaagaaagtggagaaaatttcaaagaaaatggaggaaggtgtgattgtgaacaagtttaggccaaaggagccttatgttgggaggtgccttttgaacactaagatcactggtgatgatgctcctggtgaaacttggcacatggttttcagcactgagggagaggtaccctacaaggaagggcaatctattggtgttattccggaaggtattgacaagaatggaaagcctcacaagctaaggttgtactcaatcgctagtagcgccctcggtgactttggagattccaaaactgtatctctttgcgtgaaaaggcttgtctacaccaatgaccaaggggaaacagttaaaggagtctgctcaaacttcttgtgtgacttaaagcccggaactgaagtgaagatcacaggaccagttggaaaagaaatgctcatgcctaaagatcctaatgcaactattgttatgcttggaactggaactggaattgctcctttccgttcattcttgtggaaaatgtttttcgagaagcatgatgattataagttcaatggtttggcatggctcttcttgggtgtcccaactagcagttcacttctttacagagaggaatttgagaagatgaaggagaaggcccctgaaaacttcaggcttgactttgcagtgagcagagagcaaacaaacgataaaggcgaaaagatgtatattcaaacccgtatggctcaatatgcggaggagctatgggagttgctacaaaaaagataacacctttgtgtatatgtgtgggctcaaaggcatggaaaaaggaattgatgacattatgatttctttagccgccaaagatggcattgattggttggactacaggaagcaattgaagaaggcagatcaatggaatgtggaagtatactaaggcttcacattgttggccattacattatcatcgtgtatatgtaacttcataagtattattctgttactctctttttcttctgctttttttggctagtattttttattttcgatataaaggagttgcattatcgatgacttgtacccgaaatagtgaaaagattatgggagatgcaaattcgacgacatatttcgcccttcacaattttgatttcaatgccatttttttt

SEQ ID NO: 1072 - DNA, 1358 bp, Vaccinium corymbosum
tttagcatcacaaccatggctgctgcagtaagtgctgcagtgtccctcccatcctccaagtctacttcccgttcagccagaaccaacgtcttctcacccgacggaatcaatttcaaggtctctttgccctacagaaatgtatctgcaggtggaaaggtttttactgttagagcccaggtcacaactgaggctgttgaggctcctgcaaaagttgagaaggtttccaagaaaatggacgaaggtgtggttgtgaacaagtacaggccaaaggatccatacattggcagatgtcttcttaacaccaagatcaccggtgatgatgctcctggcgaaacttggcacatggtcttcaccactgagggagaggtaccctatagagaagggcaatccattggtgtaattccagatggaatagacaagaatgggaagcctcacaagcttaggttatactccatcgctagcagtgctcttggtgactttggagactccaaaactgtgtctctatgtgtgaaaagacttgtgtacaccaacgatcaaggagaaatagttaaaggagtttgctcaaacttcttgtgtgacttgaagccgggttctgatgtgaagattacaggacctgttggaaaagaaatgcttatgccaaaagatccgactgccacagttataatgcttgcaactggaactggaattgctccattccgctcgttcttgtggaaaatgttctttgagaagtacgatgactataagttcaatggtttggcatggctcttcttgggtgtccctacaagcagctcactgctttataaggaggaattcgagaagatgaaggaaaaggccccggataacttcaggcttgacttcgctgtgagcagagaacagaccaatgaaaaaggtgaaaagatgtacattcaaaccagaatggctcaatatgcagaagagctatgggagttactcaaaaaggacaacacctatgtgtatatgtgtgggctcaaaggcatggaaaaggggattgatgacataatggtttcattggctgccaaagatggcattgattggatggcttacaagaagcagttgaagaaggcagagcaatggaatgtggaagtctactagtgcttgctttcttttaaagccaactcagatgatttcctccataatctgtagatatgtaacctcttttgtaattctttcttcattttcttcctccatttttatcttctattttgacagtataaagaaaaagtattctattctcgaggaaatgtatctagaaggctagaatataatggaaaccaacttcaacctctttgtatggatcctaattttgccatttattttttgtcacatgtgagaacatgtgg

SEQ ID NO: 1073 - DNA, 1645 bp, Prunus mume
gcactgttattgtgtcaaaaataaaactaagatagtgtcctcctaaggggtagagtgagagtcatacattacacaaaagacttatcctcacatctgccactgcattggccttcaaatctctaccaccaatctataatccagaaccaaccaaaaaatatcccattttcacaaattttctcaatcttcactacgaccccataaaacatcacactttacttctctttatctcttcttccctattattcttcttcttctgcagcattaacacgacaaccatggctgcagctgtaactgctgctgtctcattcccatcctccaagtcctcctctcttcccagcaggacctctataatctcacctgatagaatcaccctcaagaaggttcctttgtactacagagatgcctctgctagtgggagagtggtttccatcagagcccaggtcaccaccactgaggctgctcctcctgctaaggttgtgaaggaatccaagaagcaagatgaaggtgtggttgttaacaaatacaagcccaaaaatccctacactgccagagtccttctcaacactaagatcactggtgatgatgctcctggagaaacctggcacatggtctttagcactgagggagagattccctacagagaagggcagtccattggagtaattccagatggtattgacaagaatgggaagcctcacaagctgaggttgtattcaattgccagtagtgcacttggtgactttggagactccaaaactgtttctctgtgtgtgaaacggcttgtgtacaccaatgaccaaggagaaattgttaaaggagtgtgttcaaactttttgtgtgacttgaagccagggagtgaagtcacggtcacaggaccagttgggaaagaaatgcttatgccaaaagatccaaatgcaaccatcgtcatgcttgcaaccggaactggaattgctcctttcagatcattcttgtggaaaatgttttttgagaagcatgaagactacaagttcaatggtttggcatggctcttcttgggtgttcccacaagtagctcactgctttacaaggaggaatttgagaaaatggaagagaaggcccccgaaaacttcaggcttgacttcgctgtcagcagagagcaaaccaacgagaagggcgagaagatgtacattcaaaccagaatggctcagtatgcagaagagctatgggagttgctcaagaaagacaacacctacatctacatgtgtggtctcaagggaatggagaagggaattgatgacatcatggtgtcattggctgctaaagatggcattgactggacagactacaagaagaagttgaagaaagcagagcaatggaatgtggaagtctactaatttctggtcactttgtacaaatctctctctctctctctctctcccctcttctttacttaaaagtttaaacagaaattcttgaatgatttccactgcagtgtgtagataggtaaagtccttgcaaattttctgtaatttttttttttggccatattaatgaagctgttgtattatactataattatggtccccaagaattttatttctgagggtcgaattttacactctagtggaagcctgtttcaacttctacactctaaattgcgttactg

SEQ ID NO: 1074 - DNA, 1238 bp, Daucus carota
gctaccaagttttttacttgacaatattttttctctgttttacaacaatggctactgcactcactgctgcactctctctccattcctctaaaacaccttccatttccaccacaccatctatcttgtctactgacagacttaactttaccaaggttcctttgacatttagaaatgtatctagtggggggaaaatggtggctattagagctcaggtgaccactgaggctccagctaaagttgagaaggtttcgaagaaagtggaggaaggtgtggttactaataaattcaggcctaaggaaccttatgttggtaaatgcctcctcaacactaagatcactggtgatgatgctcctggggagacttggcatatggtcttcagcactgaaggagaggtgccatataaggaaggacaatccataggaattattgcagatggtgaagacaagaatgggaagcctcacaagctcaggttgtactcaattgctagcagtgcccttggagactttggcgactccaagactgtttcattatgtgtcaaaaggcttgtctataccaacgaccaaggcgaagtagttaagggagtatgctcaaatttcttgtgtgacttaaagcccggtgctgatgttaagataactggacctgttggaaaagaaatgcttatgccaaaggatcccaatgcaactgttgttatgcttgctactggaactggaattgcacctttccgatccttcttgtggaaaatgttcttcgagaagcatgaggactaccagttcaatggtttggcatggcttttcttgggtgtgcccacaagtagctcgttgctatacaaggaggaatttgagaaaatgaaagagaagaaaccagacaactttagacttgactttgcagtgagcagagaacaaacaaacgcgaaaggagaaaaaatgtacatccagacccgcatggctgaatacgcagaagagctctgggaattacttaagaaagacaacaccttcatctatatgtgcggtttgaaaggaatggaaaagggaattgatgacatcatggtgtcattagctgctaaagaaggtatcgagtggatcgaatacaaaaggtcactcaagaaggcaggacaatggaacgtagaagtctactaattttgggtttcttgtacaattgtatgcctattcttgaaactccccacgctcctctgaattctgtagatagacgatcaaatttctttgtactgcaactttttt

SEQ ID NO: 1075 - DNA, 1262 bp, Daucus carota
gtttactaaacatacatcactagtactattaccactaccatccatctatcatttctctcatttctaaactatggctactgcagtcagtgctgcagtctctctaccatcttccagctcaacttcgctttccaccagaacgtctttcatttctactgacagacttagcttcgccaaggttcctttgacatttagaaatgtatccagtggggggaaactggtatctattagagctcaggtgacaacagaggctccagctaaagttgagaaggtttcgaagaaagtggataaagatatagttactaataaatacaggcctaaggagccttatgtcggtaaatgccttctcaacactaagatcactggggatgatgctcctggtgagacttggcatatggtgttcagcaccgaaggtgagataccctacaaggaagggcagtccattggaataattgcagatggcgaagacaagaatgggaaacctcacaagcttaggttgtactctattgctagcagtgccattggagacttcggggactccaaaactgtctcattgtgtgtaaaaaggcttgtttataccaatgatcaaggcgaagaagttaaaggagtatgttcaaattacttgtgtgacttaaagccaggggctgatgttagtataactggacctgtaggaaaagaaatgcttatgcccaaggatcccaatgcaaccgttattatgcttggtactggaactggaattgcacctttccgatccttcttgtggaaaatgttctttgagaagcatgaagactatgagttcaatggtttggcatggctcttcttgggggtgcctacaagtagctcattgctgtacaaggaggaattcgagttaatgaaagagaagaaaccagaaaattttagactcgactttgcagtgagtagagaacaaacaaatgcaaaaggagaaaagatgtacatccagactcgcatggcagaatacgcagaagagctctgggaattacttaagaaagacaacaccttcatctatatgtgcggtttgaaaggaatggaaaagggaatcgatgacattatggtttcattggctgctaaagatggtattgattggatcgaatacaagaggtcactcaagaaggcaggacaatggaacgtagaagtctactaatttcgggtttcttgtacaaattgtatgcctattcttgaaactccccacgctcctctgaattctgtagatagacgatcaaatttctttgtactgcaactttttt

SEQ ID NO: 1076 - DNA, 1352 bp, Aquilegia formosa
cacatttactcttctctctctccaccatggctactgcacttgctgctgcagtctctctaccatcttcttccaagtcttcctctttatcatctagaacctctatcattttcacagaaagaaccagctttaacaagaattatttgtattccaagaatttatctattggtgggaatgtagtttctataagagcacaagttactacagaggctcctgccaaagtagccaagcattcaaagaaacaagaggaaggtgtggttgttaacaaattcaaacctaagaatccttacattggtagagttcttcttaacactaagatcactggtgatgatgcacctggtgaaacctggcacatggtcttcagcactgaaggagaggttccatacagagaagggcaatctattggaattattccagatggagttgataagaatgataaaccccacaagctaaggttgtactcaattgccagtagtgctcttggagactttggagactcaaagacagtttctctctgcgtgaagaggctcatttacactaatgataaaggagaaacaatcaagggggtctgctcaaatttcctgtgtgatttgaagccaggggcagaagtgaaaataacaggacctattgggaaagaaatgcttctgcctaaggatcctaatgcaacaatcgtaatgcttgccactggaactggaattgctcctttccgctcattcttatggaaaatgttctttgagaagcacgaagactacaagttcaacgggctgggatggctcttcttgggtgttcccacaagtagctcattgctttacaaggaggaatttgagaagatgaaggagaaggcacctgagaacttcaggctcgactttgctgttagcagagaacaaaccaatgagaagggagagaaaatgtacatccaaacccgaatggctcaatatgcagaggagctatgggagttactcaagaaagacaacacctacgtctatatgtgcggactgaagggaatggagaagggaattgatgacataatggtatctttggctgctaaagatggcattgattggattgaatacaaaagacagttgaagaaaggagagcaatggaatgttgaagtatattaagaaggcctgttttcttcatcacagagtctctctttcaaagaagcaatctgtaattttctctgttctatgtagataggtgatatctcctttgtaatttatattaagttttgtataaggcagatgtattactaaagccacatcaaaagcttctttgaaaacggattctccatcgtacagagttgtatacttgtatgaatcaacaccaacctattgtaagcatttcaacttcgtttg

SEQ ID NO: 1077 - DNA, 1329 bp, Eschscholzia californica
gaacttgtattttcctccacccaatttataatcctcttcaacttctctctcttcttcttcttctccatcataacctcacaaaccccataaaagaacttcattccttttatcttcattttcttctccaccccagggaagaaccatggctactacagttactgcttcagtctctcttccttcctcctctaagtcatcttctctatcctcaagaacatctatcatcttctctgatagaatcaacctcaccaagagtaatgtgtactctggtgctatttcaactgggagagttgtttccattagagctcaggtcactacagaagctcctgcaaaagtagtgaagatatcgaagaagaatgacgaaggagttattgttaataggtacaagcctaaggagccatacactggaagatgccttctcaacactaagatcactggcgacgatgccccaggagaaacctggcacatggtcttcagcactgagggggaaatcccatacagagaaggacaatcagttggagtcattgccgacggaatagacaagaatgggaagccacacaagttgaggttatactccatcgctagtagtgctcttggtgactttggagactccaagacagtttctctttgtgtaaagcgtctcgtttacaccaatgacgcaggagaagtagtgaagggagtttgctcgaacttcctctgcgacttgaagcccggtgcggaagttaagcttactgggcctgtcggaaaagaaatgcttatgcccaaagatccaaatgctactatcataatgcttggaactggtactggaattgctcctttccgctctttcttgtggaaaatgttcttcgagaagcatgaagactacaagttcaacggattggcatggctattcttgggtgtacccacaagtagctcattactgtacaaagaggaattcgagaagatgaaagagaaggcacctgaaaatttcaggttagactttgcagttagtagggaacaaacaaatgaagcaggagagaagatgtacatacaaactagaatggctcagtacgcagaagagctatggcagatgctcaagaaagacaacacttacgtttacatgtgtggacttaagggaatggagaagggaatcgatgacattatgggttctttggccgctagagacggtctcgattggttggaatacaaaagacagttgaagaaggcagaacaatggaatgttgaagtttactgagctcgtgttcgttcaatttggtctatccttgtatgatttccttatattatatagttgtaagtttctctcataaggcagctttgttactaatagccatc

SEQ ID NO: 1078 - DNA, 1408 bp, Glycine max
atactcctctcttgtctgtgtaatcaaaacaacaacattcattcatactcacttccttgcctactacacattcttcatcacttcattcaacatttctccccttagcttgtttcaccaatggctgctgcggttagtgctgcagtctcttttccatccaccaagtctacctctcttccaagcaggacctccctcattgccccagagagagttgtgttcaagaaggcttcattgcaaaacagagatgtttctagcagtggacgggtagtttccatcagagctcaagtcaccactgaggcaccagccaaggttgaaaaagagtccaagaaacaggatgaaggtgtggttgtgaacaagtttaaacccaagaccccttacattggtagatgcctgctcaacacaaagatcactggggatgatgctccaggagaaacttggcacatggtcttcagcaccgagggagagattccttacagagaaggacaatcaattggggtaattccagatggtattgacaagaatggcaaacctcataaactgagattgtattctattgctagcagtgccattggtgattttggagattccaaaactgtttctctatgcgtgaaacggctggtgtacacaaatgaaaatggagaaattgtcaagggagtctgctcaaatttcttgtgtgacctgaagccaggagctgaagtaacaataactggacctgttgggaaagaaatgcttatgccaaaagatccaaatgccaccatcatcatgttgggaactggaaccgggattgccccatttcgctcatttttatggaaaatgttctttgagaagcacgaagattacaagttcaatggtttggcatggctcttcttgggtgtccctacaagcagctcattgctttacaaggaggagtttgagaagatgcaagagaaaagtcctgaaaacttcaggcttgacttcgctgtgagtcgagagcaaacaaacgagaaaggggagaagatgtacatccaaacccgaatggctcaatacgcagaagagctttgggaattactgaagaaggataacacttttgtgtacatgtgtggactaaaaggaatggaaaagggaattgatgacattatggtgtcattggctgccaaagatggcattgattggactgagtacaagaggcaattgaagaaagcagagcaatggaatgtcgaagtctattaatttctgttcacttgcacaaatatcatctcctactttatgctgcagcaagtctatcaaccctcctgcgttgtgtagatatatgacgaccctgtaatttttctttgacgatttttatactgttcatgaacaacttcattgccagttttactagtactatttttgagggatgatgcaatatagatgaatccaacttcactgtgtc

SEQ ID NO: 1079 - DNA, 1458 bp, Citrullus lanatus
acatgaaccacttcatttgctctgcaatctcctccacccaatcccctaatcttttccctcttttattccattttcccctcttcccccatttccccatttccccatttcccttgatcttttctctctcaccttcttcctcaatcatcatcatccatggctgccgcagtaactgccgcagtttctttcccttccaaatcctcttctctcccttcaagaactcctctcatttcccccgacagaatcttcctcaagaaggttccggtgttcttccatggcggaagagccgcggtgagtccgattagagctcaagtgaccacggaggctccggccaaggtggagaaagagtcgaagaagcaagaggaaggaattgtggtgaataaattcaaacccaagagtccgtacgtcggacgatgccttctgaacaccaaaatcaccggcgatgatgctcccggtgagacttggcatatggtcttcagtactgaaggagaagtgccctacagagaagggcaatcaattggggtaattgctgatggagaagacaaaaatgggaagcctcacaagttgagattatactctattgccagcagtgcccttggtgactttggtgactccaagactgtttctctatgtgtgaagaggctggtgtacaccaatgaacaaggagagattgtcaaaggagtttgctccaacttcttgtgtgacctaaaacctggagcagaggtgaagataacaggacctgtgggaaaagaaatgcttatgcctaaagatcccaatgctacagttatcatgcttgcaactggaactggaattgctccatttagatcatttttgtggaaaatgttctttgagaagcatgaagactacaagtttaatggtttggcatggctcttcttgggtgtcccaactagtagctcacttctttacaaagaggagttcgagaaaatgaaagagaagtatcccgacaacttcaggttggactttgcagttagtcgagagcaaacgaacgagcagggggagaaaatgtacattcaaactagaatggctcagtatgctgaggagctttgggaattattgaagaaggacaatacctttgtttacatgtgtggacttaagggcatggagaagggaattgatgacattatggtctctttggctgctagagatggtattgattggctggaatacaagagggaattgaagaaatcagagcaatggaatgtggaagtttattaattttataaaaataacttgtacattttgacttgaaagatccctctcaacctaccccagcctgcattattatgtagatataggtaatttccttttttaaattttctgtatttttctcccattttaattttcaattccattgttaattatgcccataaaaaaaaaaaaaaaaaaaaaaaaaatctcatttatgagaaacatccactaaagggaatactttcgctccaa

SEQ ID NO: 1080 - DNA, 1247 bp, Cyclamen graecum
gaagggaaacttgagttctctccaaccaaaatcaatctccgtgtttgtgttccttttcattttcttcatcttctttgaaatctctctctctaatccagtgccatggctgcagcagtgagtgccgcagtttctctctcatcctccaaatcttcctctctacaaacgagaacaccaatcgtcccaaccccagaaagaatcagcttcaacaaggttagcttgccctataggaatgtatctagagttgggaaattgggatctgtcatcagagcacaggtcacaacaactgagaccccaaagaaagtggaaaaaatatcaaagaaaaatgaagagggtgtgatagtgaacaagtataggccaaaggagccctatattgggaggtgccttttgaacactaagatcacaggtgatgatgcccctggtgaaacctggcacatggtcttcagcactgatggagaggtaccctacagggaagggcaatccattggtgttatcccagaaggtgttgacaagaatgggaagcctcacaagctaaggttgtattcaattgctagcagtgccctcggtgactttggagactcgaaaactgtatccctgtgcgtgaaaaggcttgtatacaccaatgacaaaggggaattagttaaaggagtttgctcaaacttcttgtgtgacttaaagccaggaactgaagtgaagatcacaggaccagttggaaaagaaatgctcatgccaaaagatcctaacgcaactattgttatgcttggaactggaactggaattgctcctttccgctcgttcttgtggaaaatgttttttgaggagcacgaagactataagttcaatggtttggcatggctcttcttgggtgtccccactagcagctcgctactttacaaggaggaatttgagaagatgaaggagaagttcccagataccttcagactagattttgcagtgagcagagaacaaacgaacgagaaaggtgaaaagatgtacatccaaactcgtatggctcagtatgccgaggagctgtgggagatgcttaagaaagataacacgtttgtgtatatgtgcggactcaaaggcatggaaaaaggaattgatgacattatggtttctttagccgcgaaagatggcattgattggatggagcataagaagctattgaagaaggcagagcaatggaatgtggaagtctactgaaagctctgttttgtgtagatatgtaacttcatttgtactttgttact

SEQ ID NO: 1081 - DNA, 1165 bp, Ananas comosus
ctctctctctaatccagtgccatggctgcagcagtgagtgccgcagtttctctctcatcctccaaatcttcctctctacaaacgagaacaccaatcgtcccaaccccagaaagaatcagcttcaacaaggttagcttgccctataggaatgtatctagagttgggaaattgggatctgtcatcagagcacaggtcacaacaactgagaccccaaagaaagtggaaaaaatatcaaagaaaaatgaagagggtgtgatagtgaacaagtataggccaaaggagccctatattgggaggtgccttttgaacactaagatcacaggtgatgatgcccctggtgaaacctggcacatggtcttcagcactgatggagaggtaccctacagggaagggcaatccattggtgttatcccagaaggtgttgacaagaatgggaagcctcacaagctaaggttgtattcaattgctagcagtgccctcggtgactttggagactcgaaaactgtatccctgtgcgtgaaaaggcttgtatacaccaatgacaaaggggaattagttaaaggagtttgctcaaacttcttgtgtgacttaaagccaggaactgaagtgaagatcacaggaccagttggaaaagaaatgctcatgccaaaagatcctaacgcaactattgttatgcttggaactggaactggaattgctcctttccgctcgttcttgtggaaaatgttttttgaggagcacgaagactataagttcaatggtttggcatggctcttcttgggtgtccccactagcagctcgctactttacaaggaggaatttgagaagatgaaggagaagttcccagataccttcagactagattttgcagtgagcagagaacaaacgaacgagaaaggtgaaaagatgtacatccaaactcgtatggctcagtatgccgaggagctgtgggagatgcttaagaaagataacacgtttgtgtatatgtgcggactcaaaggcatggaaaaaggaattgatgacattatggtttctttagccgcgaaagatggcattgattggatggagcataagaagctattgaagaaggcagagcaatggaatgtggaagtctactgaaagctctgttttgtgtagatatgtaacttcatttgtactttgttac

SEQ ID NO: 1082 - DNA, 1380 bp, Chelidonium majus
caattctcacaccaacaaagccatggctactgcagttactgctgcagtctctcttccttcatctaaatcagcctctctctccagcagaacatctatcatcttcgcagacagaatcagcttcaccaagagcaatgtgtactctggtggtgtttctattgctgggaaatctgtttccattagagctcaggtcactacagagactacagaagctcctccagctaaggtagagaagcattccaagaagaatgaggaaggtgtcattgtcaacaaatacaagcctaagaacccttacactggtagatgtcttcttaacaccaaaatcactgctgatgatgcacctggagagacctggcatatggttttcagcactgaaggggaaatcccttacagagaagggcaatctgttggggttattcctgacggcatagacaaaaatgggaaaccacataagcttaggttgtattcaattgccagcagtgctcttggtgattttggagactccaagactgtttctctctgtgtaaagcggctcgtttacaccaatgaccaaggggaagtagtcaagggagtttgctcaaatttcctttgtgatttgaagcctggttctgaagtgaagctcacagggcctgttggaaaagaaatgcttatgcccaaggatccaaatgctaccgtcataatgcttggaactggaactggaattgctccgttccgctcatttttgtggaaaatgttctttgagaagcatgaagactacaagtttaacgggctagcatggcttttcttgggtgttcccacaagtggctcattgctgtacaaggaggagtttgagaagatgaaggagaaagcacctgataatttcaggttagactttgcagtgagcagagaacaaacgaatgaacagggggagaagatgtacatacaaacccgaatggctcagtatgcagaggaactatggcagttactcaagaaagacaacactttcgtctacatgtgtgggctaaagggaatggagaagggaatcgatgacattatggcttctttggccgaaagagatggtttgaattgggtggaatacaaaagacagttgaagaaagcagagcaatggaatgttgaagtctactgatcgaggaatggttcttgtacaattggtatttcttgtctgaattgaagaagccatccttggtggcatgacttcattttgctatgttagatagttgtaagtttctcataaggcagctgttgttattatatagccacctcaaaacgtttcatgaagagggatctacagaagttgtgatttactgtgaatcttctgaaccgaggcgatcctcttataagcattctaatcttcatttgtcgataatccaatccccgtttttc

SEQ ID NO: 1083 - DNA, 1404 bp, Plantago ovata
gaatactcaatctcctcgtcgctcacatccttactcttcttcttctttcttgataatcatcccctcttcttctttcttcttcattctactaccatcatcatggctactgcagtaagtgctgcagtcactctttcttccgccacctctaacactctctctgctagaacctccatctcttcaaccgatagactccttttcaacaaggtgccattacattataggagtgtttcatataccggtgtcaaggttttgccaattagagctcagatcaccacaacagaagaagttcctactgcaaaggtagagaaggtccataagaagcaggaggaaggtgtagtcgttaacaagttcaggcccaaggaaccatacattggcagatgtttgctcaacaccaagatcaccggcgatgatgctcctggtgaaacatggcacatggtcttcagcactgagggagaggttccttacagagaaggacaatcaattggggtgatcgcagatggagaggacaagaatgggaagcctcacaagctgagactgtactccattgctagcagtgcccttggagacttcggggactcaaagactgtttcattgtgtgtcaaaaggcttgtctacacaaatgatgcaggggaagttgttaaaggggtttgctcaaacttcttgtgcgacttgaagccaggatccgaggtgaagattaccggacctgtagggaaagaaatgctcatgcctaaggaccctaacgctactgtcataatgcttgcaactggaactggaattgctcctttcagatcattcttatggaaaatgttcttcgagaagcatgaggactacaagttcaatggcttggcatggctattcttgggtgttcccacaagcagctcactgctctacaaagaggaattcgagaaaatgaaggagaaatctccagacaatttcagggtggactttgccgttagtagagaacaggctaacgcccagggtgagaaaatgtacatccaaactcgtatggctgaatatgcggaagagctatggcaactactcaagaaagacaacacctttgtctacatgtgtggtctaaagggcatggaaaagggtatcgatgacatcatggtttcattggctgctagagacgggatcgactggatagaatacaagaggcagttgaagaaagcagaacaatggaatgtggaagtgtactaagccttgcataaagatttcttgtacaaatatgaacaaatttcatatgattttctccagttggtgtagatagataaccttaattgtttccatatgtatctcttttttcatcaccaaaatactattttactgccttctgattgttcaaaattttgggggcattatggtgtgcaaaagagttaatactagtgaaaatgaattaaactt

SEQ ID NO: 1084 - DNA, 1377 bp, Cucumis melo
tctctctctctctctctctcactcattcatggccgccgccgtaaccgccgccgctgtttctttcccttctaaatcctcttctctcccttccagaactcctctaatttcccctgacagaatcttcctcaagaaggttccggtgttttaccatggcgggagagttgcggtgagtccgattagagctcaagtgactacggaggctccagcgaaggtggagaaagagtcgaagaaacaagaggaaggaattgtggttaataagtttaaacccaagactccatacatcggacgttgtcttttgaacacgaagattactggcgatgatgctcccggcgagacgtggcatatggtcttcagtactgaaggggaagtgccctacaaggaaggacaatcgattggggtaatagcagatggagaggacaagaatgggaagcctcacaagttgagattatactccattgcaagcagtgctcttggtgactttggtgactccaaaactgtttctctatgtgtgaagaggttggtgtacaccaatgaacaaggagagattgttaaaggagtttgctctaactttttatgtgacctaaaacctggagcagaggtgaaaataacaggacctgtgggaaaagaaatgcttatgcctaaagatcctaatgctacagttattatgcttgcaactggaactggaattgctccattcagatctttcttatggaaaatgttcttcgagaagcatgaagactacaagtttaatggtttggcatggctgttcttgggtgtcccaacaagtagctcacttctttacaaagaggagtttgagaaaatgaaagagaagtatccggaaaactttaggttggattttgcggttagtagagagcaaacgaacgagaagggtgagaagatgtacattcaaactagaatggctgagtatgctgaggagctttgggagttgttgaagaaggacaatacctttgtttacatgtgtggacttaagggcatggagaagggtattgatgacattatggactctttggctgctagagatggtattgattggcaggaatacaagaggcaattgaagagatcagagcaatggaatgtggaagtttattgattttataaagataactttgtacattttgacttttgaaagaatctctcttcaacccctaccccaacctgcattattgttgttattattatcatcattattattatatgtagatataggtaatttcctttttttttcttctttcaaaatttaaatgtatttttctcccattttcactttcaattccattgttaattatgacctcataagaaaaggaattgtttctcatttatgagaatcatccactaaagtgaatactttcattccaa

SEQ ID NO: 1085 - DNA, 1583 bp, Petroselinum crispum
agaagacagacaatctgtggtgcaaactggaaaaatgatacgctccgaagattcataaagtaaaacacaattttcttatcctcatacccgccactgcattgtcttaaaaatctcctccacccgatatataatccacttaatattctccccatcgaaaaatctaacactctctgacttgttaactaacacactaaacatacatcactagtaccaccattctatcatttctctcttttccaaacaatggccactgcagtcagtgctgcagtctctcttccatcctccaactcaacttccctttcaaccagaacatctttcatatctactgacagacttaacttcactaaggttcctttgacatatagaaatgtatccagtggtggaaaattggtagcaattagagctcaagtcacaacagaggctccagctaaagtcgagaaggtttcaaagaaagtggacaaaggcgtggttactaacacgttcagacccaaggaaccttatgttggtaaatgccttctcaacactaagatcactggtgatgatgctcctggtgagacttggcatatggtcttcagcactgaaggaaagataccctacttggaagggcaatccatcggaataattgcagatggcgaagacaagaatgggaagcctcacaagcttaggttgtactcaattgctagcagtgccatcggagacttcggggactcccaaactgtctcattgtgtgtaaaaaggcttgtatataccaatgaccaaggtgaaatagtcaaaggagtatgctcaaattacttgtgtgacttaaagccaggggctgatgtgaatataactggacctgtaggaaaagaaatgcttatgccaaaggatcccaatgcaaccattattatgcttggtactggaactggaattgcaccattccgctccttcttgtggaaaatgttctttgagaagcatgaagattacgagttcaatggtttggcatggctcttcttgggtgtgcccacaagtagctcgttgctgtacaaggaggaattcgagaaaatgaaagagaagaaaccagaaaattttagacttgactttgccgtgagcagagaacaaacaaatgcgaaaggagaaaagatgtacattcaaacacgcatggctgaatatgcagaagagctctgggaattactcaaaaaagataacaccttcatctatatgtgcggtttgaaaggaatggaaaagggaattgatgacatcatggtgacattagctgctaaagatggtattgattggactgaatacaaaaggtcactgaagaaggcaggacaatggaacgttgaagtgtactaatttcgggtttcttgtaaaaatgtatgccaattcttgaaactctatgctcgatctatatttcacttttttctgtattatgtagataggtaatcaacttccttgtaactttccttgtattcattttcactttcttctctactgttgtatattgtttaatgtccttctccaaaaaatgtatttttgagggccttgatcataataaaaagttgaaatgtagaacataacttcttcaatctgtctccacacacaca

SEQ ID NO: 1086 - DNA, 1491 bp, Glycine max
ctcaaatcttatactcctctcttgtctgtgcaatcaaaacaacaacattcattcatactgatcacttccttgcctattgcacattcttcatcacttcattcaacatttctctctcccttagctagtttttaccaatggctgctgcggttagtgctgcagtctcttttccatccaccaagtctacctctctcccaagcaggacctccatcattaccccagagagagttgtattcaagaaggcttcattgcaatacagagatgtttgtagcagtggaagggtagtttccatcagagctcaagtcaccactgaggctccagccaaggttgaaaaagagtccaagaaacaggatgaaggtgtggttgtgaacaagttcaaacccaagaccccttacgttggtagatgcctgctcaacacaaagatcactggggatgatgctccaggagaaacttggcacatggtcttcagcaccgagggagagattccttacagagaaggacaatcaattggggtaattccagatggtgttgacaagaatggcaaacctcataaactgagattgtattctattgctagcagtgccattggtgattttggagattccaagactgtttctctatgcgtgaaacggctagtgtacacaaatgaaaatggagaaattgtcaagggagtctgctcaaatttcttgtgtgacctgaagccaggagctgaagtaacaataactggacctgttgggaaagaaatgcttatgccaaaagatcctaatgccaccatcatcatgttgggaactggaaccgggattgccccatttcgctcatttttatggaaaatgttctttgagaaacacgaagagtacaagttcaatggtttggcatggctctttttgggtgtccctacaagcagctcattgctatataaggaggaatttgagaagatgcaagagaaatatcctgacaacttcaggcttgacttcgctgtgagccgagagcaaacaaacgagaacggagagaagatgtacatccaaacccgaatggctcaatatgcagaagagctgtgggaattactgaagaaggataacacttttgtgtacatgtgtggactaaaaggaatggaaaagggtattgatgacattatggtgtcattggctgccaaagatggcattgattggactgagtacaagaggcaattgaagaaatcagagcaatggaatgtcgaagtctattaatttctgttcacttgcacaaatatcatctcctactttgtgctgcaacaagtctatcaaccctcctgcgttgtgtagatatatgacgtccctgtaatttttctttgacgatttttatactgttcatgaacaacttcaatgtcagttttacaagtactatttttgagggatgatgcaatatagatgaatccaagttcactatgtcatttccaaattttatgttttgatgagaagtacttaggtatccggtgcattatatatcccaaacaaa

SEQ ID NO: 1087 - DNA, 1168 bp, Ricinus communis
tttcactcttctcttcttctccatttgtcaatacataatagccatggccgctgcagttactgctgcagtttcctttccttccactaagtccacttctctcccttcaagaacctccatcatagcaccagagaggaccaccttaaagaaggtgcctgtttactatagggatgttgtgtctgctggtaaaagagttgtttccatcagagcccaggttacaacagaggcagaagctcctgtcaaggttaagaaagaatcaaagaaaaatgaggaaggtattgttgttaacaagttcaagcctaagaatccttacactggcaggtgccttttgaacactaagatcactggtgatgatgctcctggtgaaacttggcacatggtctttagcaccgagggagaggtcccctacagagaagggcaatcaattggtgtaattccagatggtattgataagaatgggaagcctcacaagctcagattgtattcaattgccagcagtgctcttggtgactttggagactccaaaactgtttctctttgtgtgaagcggcttgtgtacaccaatgataaaggagaattagttaaaggagtctgctcaaatttcttgtgtgacttgaaacctggagctgaagtacagattactggaccagttggaaaagaaatgcttatgccaaaagatcccaatgccaccatcgttatgcttgggactggaactgggattgctcctttccgatcgttcttgtggaagatgttctttgagaagcatgaagactataaattcaatggtttggcgtggctcttcttgggtgtccccacaagtagctcattgctgtacaaggaggaattcgagaaaatgaaggagatagcccctgataactttaggcttgactttgccgtgagcagagagcaaactaatgaaaagggagaaaagatgtatatccaaactcggatggctcaatatgcagaagaactttgggagttattaaagaaagataacaccttcgtctatatgtgtggactgaaaggaatggagaagggaattgatgacataatggcatcattggcagctaaagaaggcattgattggttggagtacaaaaggcagttgaagaaagcagagcaatggaatgtggaagtgtactaatgcctgcggttattacttgtacaaata

SEQ ID NO: 1088 - DNA, 1288 bp, Cucurbita pepo
agccatggccgctgcagtcactgctgcagttctttcccctccgccaccaaaatcctcttctctcccatccagaaccgcgctaatttcccctgacagaatcgctctcaagaaggtccggcgtgttcatcatggcggaagagtggtggtggctccgattagagctcaggtgaccacggaagcaccggcgaaagtggaaaagagtcgaagaagcaagaagaaggaatcgtggtgaataagttcaagcctaagagtccgtacgttggacgctgccttttgaacacgaagatcactggcgatgatgctcctggtgagacttggcatatggtcttcagtactgaaggggaagtgccgtacagagaaggcagtcaattggggtaattgctgatggagaggacaagaacgggaagcctcataagctccgattatactccattgctagcagtgcccttggtgattttggagattccaagactgtttctctgtgtgtgaagcggcttgtgtacaccaacgaccaaggagagatcgtcaaaggagtttgttctaactttttatgtgacctgaaacctggagcagaggtgaagataactggacctgtaggaaaagaaatgcttatgcctaaagatcccaatgctacagttgtcatgcttgcaactggaactggaattgctccatttagatcatttttgtggaaaatgttctttgagaagcatgatgactacaagttcaatggattggcatggctctttttgggtgtcccgacaagtagctcacttctctacaaagaggagttcgagaaaatgaaagagaagtaccccgagaacttcaggttggactttgcagttagtcgagagcaaacaaacgagcagggcgagaaaatgtacatccaaaccagaatggctcaatatgccgaggagctttgggaattattgaagaaagacaacacctttgtctacatgtgtggacttaagggcatggagaagggaattgatgacattatggtctctttggctgctagagatgggattgattggctggagtacaagaggcagttgaagaaatcagagcaatggaatgtggaagtttattaattttataaatataatattttccacattttgacttcaacatctctctttcaacccctcccccaccattattatgtagatatagttaattccctttttataattttctgtattttctctctttttattttgaattcttgttcattatgctcgtcaaaattaaaaagaaaaacttcgaattatgcccaagaaatacttttcgc

SEQ ID NO: 1089 - DNA, 1406 bp, Cicer arietinum
tcttaatatcctctctccaaccagaaaaaaaaactatactcactcaaaaactgcatatacatatcatcacttaattaatcaacattactctctctttctctctatcttctcaattcttacaacaaaaacaacatggctgctgcagttaccgccgcagtctcctttccttactccaactccacttcccttcccatcaggacatctgttgttgctcctgaaagacttgtcttcaagaaggtttcattgcaatatagagataataatgtttctataagtggaagggttggttcaattagagcacaagttactacagaagcacctgctaaggtagaaaagatatcaaagaaacaggatgaaggtatagttgttaacaaattcaaacctaaggaaccatacattgggaggtgtcttcttaacacaaagatcactggtgatgatgcacctggtgaaacttggcacatggttttcagcactgagggagaggttccttacagagaaggacaatcaattggagtagttccagatggtattgacaagaatggcaagcctcacaagctgagattgtattcaattgctagtagtgccattggtgattttggagactccaaaactgtttcgctatgtgtgaaacgtcttgtgtacacaaatgacagtggagaagttgtcaagggagtctgctcaaatttcttgtgtgacttgaagcctggatctgaagtaaagattactggaccagttggtaaagaaatgcttatgccaaaagatcctaatgccaccatcatcatgttgggaactggaactggaattgctccatttcgctcatttttatggaaaatgttcttcgaaaaacacgaagattaccagttcaatggtttggcatggctcttcttaggtgtccccacaagcagttcattgctttataaggaggaatttgaaaagatgaaggagaaagcacctgagaacttcaggcttgactttgctgtgagtagagagcaagtaaacgaaaaaggagagaaaatgtacatccaaaccagaatggctcaatatgcagaagagttgtgggagttacttaagaaagacaacacttttgtttacatgtgtggactcaaaggaatggaaaagggaattgatgacataatggtgtcactcgctgccaaagacggtatcgattggatcgagtacaagagacaattgaagaaggcggagcaatggaatgttgaagtctattgatttatttttcacttgcacagataacaagtctcactttgtgcagcagcatatctatatcaccctcctcctgcattctgtagatagattacaaaccctgtaattttggtatgctaaaaaaattataccttgcttgtgaacaatctttgttacataatccttgcaagaaataattttgaaga

SEQ ID NO: 1090 - DNA, 1433 bp, Gossypium raimondii
attggccttcaaatctcctccacccaattcatgatccaaacccaatacaaaaccatatccttctgagatttcctcacctcatctcattccttcttcaccaaactatccatcaaattacatttttctcacctcttcattctccaaaacccatggctgccgtaactgctgcagtctcctttccttctaccaactccacctcttttactactcgaacctctatcatctctcctgaaagaatcacattcaagaaggtttctttttactacccagatgtttcaagtggagggagagtggtttcagtgcgagcccaggttacaactgaagctcctgctaaagttgtaaaggaatccaagaaaaatgatgaaggtgttgtggttaacaagttcaagccaaaggaaccttacattggcaggtgccttctaaatactaagatcaccggtgatgatgctcctggagagacatggcacatggtcttcagcactgagggagaggttccttacagagaaggacaatccattggagtgattccggatggcgttgacaagaatgggaaacctcataaactgagattatactctattgctagcagtgctcttggtgactttggggactccaaaactgtatccctatgtgtgaaacgtcttgtatacaccaacgagaaaggagaacttgttaaaggagtctgctcaaatttcttatgtgacatgaaacctggggcagaagttaaaatcacaggacctattggaaaggaaatgcttatgccaaaagatcctgatgccacaatcatcatgcttgctacaggaactggtatcgctccctttcgatcatttttatggaaaatgttctttgaaaggcatgaggattacaagttcaatggtttggcatggctgttcctcggtgttcctacaagtagctcattgttgtacaaggaggaatttgagaaaatgaaggagacgtatccagacaacttcaggctggactttgctgtgagcagagaacaaacaaatgagaaaggagaaaagatgtacattcagacccgaatggctgaatatgcaaaagagctatgggaattactgaagaaagataacacctttgtttacatgtgtgggttgaaaggaatggagaagggaattgatgacataatggtctcacttgctgcagcagatggtattgattggattgaatacaaaaggcagttgaagaaatctgagcaatggaatgtggaagtctactgattgtggattacatgtacaaaccaaaccccaattcttcctctctctttttttatttttctgagcagccagctacagtccaacaatgatttccaatgcattgtgtgtgttggtatttttattttataaccaaacctcacaaatcttaatctcgaggagtaatccatgcttcagctttgatgtgcagaatggattgatgcc

SEQ ID NO: 1091 - DNA, 1289 bp, Scabiosa columbaria
ttcacttaaaatctcctccacccaaatctataatcctctcttctccttcaaatcactattctctccatatttaaaccataaatttctctcttttcacttcatcatcctcatcatcaatggctactgcagtaagtgctgcagtttctcttccatcttccaaatccacatcccttgctaccagatcaacatcactcttcttccccgaacgagttaacttcgttaaggtaccattgtacaacaagaatgtctgtggtggtgcgaaagtggtgtcaatcagagcccaggttacaacagaggcacctgctaaagttgtgaaagaatcaaagaaaaatgaagaaggcatagtcgtgaacaaattcaaacctaagaatccctacaccggtatgtgccttctcaacaccaagatcactggtgatgacgcaccgggggagacgtggcacatggtcttcagcactgagggagaggtgccctacagagaggggcaatccatcggtgtaattccagagggcattgacaaaaatgggaagccacacaagttgagattgtactctatagctagcagcgccattggtgattttggtgactccaaaacagtttctttgtgtgtgaaaaggcttgtgtacacaaatgaccaaggggaagtagttaaaggagtttgctctaatttcttgtgtgatttgaaacctgggtccaatgtgacaataactggacctataggaaaagaaatgcttatgccaaaggatcctaatgcaactattataatgcttgcaactggaactggaattgctcctttcagatcgtttttgtggaaaatgttctttgagaagcacgacgactacaagttcaacgggttggcatggctcttcttgggtgtccccacaagcagctcactactttacaaggaggaatttgagaaaatgaaagagaagaaccctgataatttcagactcgactttgctgtgagcagagagcaaacaaatgagaaaggtgagaaaatgtatatacaaacaagaatggcggaatacgcagaagaactatggcaactacttaagaaagacaacacttttgtttatatgtgtgggctaaagggaatggagaaaggcattgatgatattatggtttcattggctgctagagacggcattgactggattgagtacaagaggcaattgaagaaggcagagcaatggaatgtggaagtctactaataattttgagtattttgtttgtacaaatatatatacacttcccattaattcttgaagctgttgagtgctactcttcatgtg

SEQ ID NO: 1092 - DNA, 2126 bp, Cicer arietinum
gctctctaacctttttcttttgacaagacactgccctctaaccttaaatcttatgtcctcatgatctcataaaaacatctagtgaccaaacaccctttaggctaaaatggtcatcgcaggtgtaagtatcttacatacagatagacttatcttcacatcatatctaccactgcttttccttacaaatttcatccactcaatcttaatatcctctctccaaccagaaaaaaaaaactatactcactcaaaaactgcatatacatatcatcacttaattaatcaacattactctttctttctctctatcttctcaattcttacaacaacaacaacaacatggctgctgcagttacagccgcagtctcctttccttactccaactccacttcccttcccatcaggacatctgttgttgctcctgaaagacttgtcttcaagaagatttcattgcaatatagagataataatgtttctataagtggaagggttggttcaattagagcacaagttactacagaagcacctgctaaggtagaaaagatatcaaagaaacaggatgaaggtatagttgttaacaaattcaaacctaaggaaccatacattgggaggtgtcttctcaacacaaagatcactggtgatgatgcacctggtgaaacttggcacatggttttcagcactgagggagaggttccttacagagaaggacaatcaattggagtagttcctgatggtattgacaagaatggcaagcctcacaagctgagattgtattcaattgctagtagtgccattggtgattttggagactccaaaactgtttccctatgtgtgaaacgtcttgtgtacacaaatgacagtggagaagttgtcaagggagtctgctcaaatttcttgtgtgacttgaagcctggatctgaagtaaagattactggaccagttggtaaagaaatgcttatgccaaaagatcctaatgccaccatcatcatgttgggaactggaactggaattgctccatttcgctcatttttatggaaaatgttcttcgaaaagcacgaagattatcagttcaatggtttggcatggctcttcttaggtgtccccacaagcagttcattgctttataaggaggaatttgaaaagatgaaggagaaagcacctgagaacttcaggcttgactttgctgtgagtagagagcaagtaaacgaaaaaggagagaaaatgtacatccaaaccagaatggctcaatatgcagaagagttgtgggagttacttaagaaagacaacacttttgtttacatgtgtggactcaaaggaatggaaaagggaattgatgacataatggtgtcactcgctgccaaagacggtatcgattggatcgagtacaagagacaattgaagaaggcggagcaatggaatgttgaagtctattgatttatttttcacttgcacagataacaagtctcactttgtgcagcagcatatctatatcaccctcgtcctgcattctgtagatagattacaaaccctgtaattttggtatgctaaaaaaattataccttgcttgtgaacaatctttgttacataatccttgcaagaaataattttgaagatcatgcagtatatagataaaaccaagttttatcaatttcctaaatttgattgtcaatattcagtagtgaggatctcttccagcttaaccagtggttttggaaatacaggaagagttttgtcgtccattttaatcttactcgactcgagggataatattcaattcaaaaaaaaaaaaaatttgatgtggaaattaacttaatgtcaattggggggtaatggagggtgttgaaggggtgagaataacaagattgagtgaattattaccatgttagattgcttggttatagttatatcttgaaaattgaaaatgctacttgcacataactaccaaaattaataattacctaatgaatataatattggtaactagatgaacattttttgacttgtggtatctatgagagcatgaagtcacgcaagttggcaaaataattgaagatgacactttgtttttgttatcctaaacatagaattaaattttggtactacaaggttgtcttgtattttttatttta

SEQ ID NO: 1093 - DNA, 1357 bp, Cicer arietinum
catatcatcacttaattaatcaacattactctttctttctctctatcttctcaattcttacaacaacaacaacaacatggctgctgcagttacagccgcagtctcctttccttactccaactccacttcccttcccatcaggacatctgttgttgctcctgaaagacttgtcttcaagaagatttcattgcaatatagagataataatgtttctataagtggaagggttggttcaattagagcacaagttactacagaagcacctgctaaggtagaaaagatatcaaagaaacaggatgaaggtatagttgttaacaaattcaaacctaaggaaccatacattgggaggtgtcttctcaacacaaagatcactggtgatgatgcacctggtgaaacttggcacatggttttcagcactgagggagaggttccttacagagaaggacaatcaattggagtagttcctgatggtattgacaagaatggcaagcctcacaagctgagattgtattcaattgctagtagtgccattggtgattttggagactccaaaactgtttccctatgtgtgaaacgtcttgtgtacacaaatgacagtggagaagttgtcaagggagtctgctcaaatttcttgtgtgacttgaagcctggatctgaagtaaagattactggaccagttggtaaagaaatgcttatgccaaaagatcctaatgccaccatcatcatgttgggaactggaactggaattgctccatttcgctcatttttatggaaaatgttcttcgaaaagcacgaagattatcagttcaatggtttggcatggctcttcttaggtgtccccacaagcagttcattgctttataaggaggaatttgaaaagatgaaggagaaagcacctgagaacttcaggcttgactttgctgtgagtagagagcaagtaaacgaaaaaggagagaaaatgtacatccaaaccagaatggctcaatatgcagaagagttgtgggagttacttaagaaagacaacacttttgtttacatgtgtggactcaaaggaatggaaaagggaattgatgacataatggtgtcactcgctgccaaagacggtatcgattggatcgagtacaagagacaattgaagaaggcggagcaatggaatgttgaagtctattgatttatttttcacttgcacagataacaagtctcactttgtgcagcagcatatctatatcaccctcgtcctgcattctgtagatagattacaaaccctgtaattttggtatgctaaaaaaattataccttgcttgtgaacaatctttgttacataatccttgcaagaaataattttgaagatcatgca

SEQ ID NO: 1094 - DNA, 1203 bp, Cicer arietinum
aaaaaaactatactcactcaaaaactgcatatacatatcatcacttaattaatcaacattactctttctttctctctatcttctcaattcttacaacaacaacaacaacatggctgctgcagttacagccgcagtctcctttccttactccaactccacttcccttcccatcaggacatctgttgttgctcctgaaagacttgtcttcaagaagatttcattgcaatatagagataataatgtttctataagtggaagggttggttcaattagagcacaagttactacagaagcacctgctaaggtagaaaagatatcaaagaaacaggatgaaggtatagttgttaacaaattcaaacctaaggaaccatacattgggaggtgtcttctcaacacaaagatcactggtgatgatgcacctggtgaaacttggcacatggttttcagcactgagggagaggttccttacagagaaggacaatcaattggagtagttcctgatggtattgacaagaatggcaagcctcacaagctgagattgtattcaattgctagtagtgccattggtgattttggagactccaaaactgtttccctatgtgtgaaacgtcttgtgtacacaaatgacagtggagaagttgtcaagggagtctgctcaaatttcttgtgtgacttgaagcctggatctgaagtaaagattactggaccagttggtaaagaaatgcttatgccaaaagatcctaatgccaccatcatcatgttgggaactggaactggaattgctccatttcgctcatttttatggaaaatgttcttcgaaaagcacgaagattatcagttcaatggtttggcatggctcttcttaggtgtccccacaagcagttcattgctttataaggaggaatttgaaaagatgaaggagaaagcacctgagaacttcaggcttgactttgctgtgagtagagagcaagtaaacgaaaaaggagagaaaatgtacatccaaaccagaatggctcaatatgcagaagagttgtgggagttacttaagaaagacaacacttttgtttacatgtgtggactcaaaggaatggaaaagggaattgatgacataatggtgtcactcgctgccaaagacggtatcgattggatcgagtacaagagacaattgaagaaggcggagcaatggaatgttgaagtctattg

SEQ ID NO: 1095 - DNA, 1864 bp, Lactuca sativa
caacttttcatcctaagatacataaaaaagatgatattttcctatagaatctgttttgttctttatcatttgagaaaaataatcttgtttattaagaattcaaaagggaaatcacgtttgtggccacagaaactcacaagtgtacaaagccaacacaaatttcttatcctcacatctgccagtgccattggctttctaatttcctccatccaattcacaaatatccattcccttcaacatcgcatttcttcttcactcatagtatatcttccctttctcttatccctcttcactcttcattttgttcgatcaccatggcttctgcagtaagtgctatagtctccctcccatcttctaaatccgctgcaatttcaacaagaacatccctcatcactcaagaacgagtctccttcacaaaggtgccatattacaagaatgtgtcatcaaatgttaagtcgctatcaattagagctcaagttacaacagaagctcctgctaaagtagagaaaatttcaaagaaacaagaagaaggtgtagttacaaataaatatcgcccaaaggaaccttacgttggtaggtgtcttctcaacaccaagatcaccggcgacgatgcccctggtgaaacttggcacatggtcttcacaaccgaaggtgagatcccatataaagaaggacaatccattggtgtaattcccgatggaattgacccaaagaatggaaagccacacaaattgagattgtattccattgcgagtagtgctcttggtgacttcggagactccaaaactgtttcattgtgtgtaaaaagactagtctacaccaatgacgcaggagaagaagttaaaggagtttgctctaacttcttatgcgacttgaagcctggagcagaggtgcaaataacaggtccagttggaaaagaaatgcttatgccaaaggatcctaatgcaactgttataatgcttgcaacaggaactggtattgctccatttcgatcatttatgtggaaaatgttcttcgagaaacacgaagactataaatttaacggattggcatggctctttttgggagttcccacaagtagttcattgctatataaagaggaatttgagaaaatgaaggagatgaaaccggataacctaagagttgactttgctgtgagtagagaacaaactaatgagaagggtgaaaagatgtacattcaaacaagaatggctcaatatgatagagagctatgggaattactcaagaaagacaacacgtttgtgtatatgtgtgggcttaagggtatggagaagggtattgatgacattatgggtacattggctgctgaagatgggattgattgggtaacatacaagaagcagttgaaaaaggaaggacaatggaatgtggaggtgtattaagtggttatgttcctttttgtacaaatacagccctctctttgtagatagctttggatgcttatttcgagtgcccaaaacgcaacaagtacagaaggatatggaagtaatcatggcattatgtgagagcatttgacttcaccaacgaaaaaagtgtactaatgataacaaatggttcttcctttgccacaatttatatgttatggtgcatgtgtttttaattccatttgtatccaaagtcattctcttacattatattcaagatagggtcattggttcgagccttctcttccactttgagccttcatgttgttctatagacttttgatggttattatggaggtatcaaggatgatagttgtcacaacttgaaaaaaaaaaatcaaggattaaattaaagttttgaaactggtaaagttgatttttatggtccctagttaataactataaacaatatgtttgga

SEQ ID NO: 1096 - DNA, 1352 bp, Arnica chamissonis
tctattcaatcaccatggctgctgcagtaagcgctgtggtctccctcccatcttccaaatccaccgtaatttcatccagatcatcattaacccctcaagaacgagtttctttcaccaaggtgccatattacaaaaatgtgtcgacaagtggtaataaattattatcgattagagcccaattagtaacagacactgaggcacctgctaaagtagagaaaatttcaaagaaacaagaggagggtgtggttacaaataaatacagaccaaaggaaccatatgttggtaggtgtcttctcaacaccaagatcacaggtgatgatgctcctggtgaaacgtggcatatggttttcaccactgagggtgagatcccatatagagaaggacaatccatcggtgtaattccagacgggattgatcccaaaaatggaaagccacacaaactgagattgtattccattgctagcagtgctataggtgactttggagactccaaaactgtctctttatgtgtgaagagacttgtctacacgaatgacgcaggcgaagaagttaaaggagtctgctctaacttcttgtgtgacttgaagccaggatctgaggtgcaaataaccggtccagtaggaaaagaaatgcttatgccaaaagatcctaatgctacagttataatgcttgcaacaggaactgggattgctccttttcgctcatttttgtggaaaatgttctttgagaagcacgaagactataaattcaatgggttggcatggctctttttgggtgttcccacaagtagttccttgttatataaagaggaatttgagaaaatgaaggagatgaagccagataatctaagagttgactttgcagtgagtagagagcaaactaatgagaagggtgaaaagatgtacattcaaaccagaatggctcagtatgacagagagctatgggagttactgaagaaagacaacacttttgtgtatatgtgtgggcttaagggcatggagaagggtattgatgacatcatggttacattggctgccgaagatggcattgattggatacaatacaagaagcagttgaagaaacaagggcaatggaatgtggaggtttactaagtggcttttttcttcttgtacaaatgcagccctctctttgtagataggtaaccttctattttttgtaatattacttttttttctttaatttcaccatgaaccaactctattgttattgggcatccccaaatttagttctcttttttttttacttgggtacaagttcatactgtcgaagttggccgcgagtctggatttacacctatgcgataaactcaaaccaatgaaacaccgaaaacc

SEQ ID NO: 1097 - DNA, 1322 bp, Linum usitatissimum
ccacgcgtccgaatttccaccaccaccacttccatatcctctcttaacattcctcccaactcccatcactacagtacatccatggctgctgcagtgacttccgctgcagtctctttcccttcttccaagtcatccttccctctctcttcccgaacctccatcatccccactcccgaaaggatcgccttcaaaaaggcatcttacgtgcaagctggagccaggggagtcgtttcagtcagagcccaggtcaccaccgaagctcctgttgttaaggtgaaaaaggagtccaagaaagatgaagaaggcgtgattgtcaacaagtacaagcccaaggagccttacactggaagatgccttttgaacactaagatcaccagcgatgatgcccctggagagacctggcacatggttttcagcactgaaggagaggtgccttacagagaaggacaatccattggggttatcccagaaggtattgacaagaatgggaagccacataagctgagattgtattcaattgccagcagtgctcttggtgatttcggtgactctaaaactgtgtccctatgtgttaagaggcttatttacaccaacgatgctggagagattgtcaagggagtctgctccaacttcttgtgcgatttgaagcctggatctgaagtgaagatcactggaccagtaggcaaggaaatgcttatgccaaaagatcctaatgccaccattatcatgcttggaactgggactggaattgcaccatttagatctttcttgtggaaaatgttcttcgagaagcatgaggactacaagttcaatggtttggcatggctcttcctgggagttcccaccagcagctcactcttgtacaaggaggaatttgagaagatgaaggaaaaggcacccgagaacttcaggctagactttgcagtgagcagagagcaaacaaacgagatgggcgagaagatgtacatccaaacgagaatggctcagtacgcagaggagttgtgggagttgctgaagaaagacaacacgtacgtatacatgtgtgggttgaagggaatggagaagggtattgatgaaatcatggtcggtttggctgccaaagaaggaattgactggcttgattacaagaagcagttgaagaaggctgagcagtggaatgtggaagtttactgataaggtttttttgggtttgtacaaaaaggaagaatacctgctcctttgttttttcttagtggggattgtaatttgcaagccgaaatattattcttattaatgaactcccgtccactctcgtatagatacggaggtaatcaatatataat

SEQ ID NO: 1098 - DNA, 1300 bp, Cyclamen graecum
catctctttcagccatggctaccgcaataagtgctgcagtttcgtttcaatcatcgagttctacttctctctctaccaaatcctctatcatctcccccaaaagaatcacctttaaggttcctttgcccaacagaaatgtgtccacgggttgtagggttctctcaatcagagcccagatcacaactgatgctcctgctaagaaggtcgaaaaacattcaaagaaaatggaggaaggtgtgatagtgaacaagtacaggccaaaggacccatacattgggacatgccttcttaacactaagatcactgctgatgatgcacctggagaaacttggcacatggtcttctccacagagggagaggtaccctatagagaagggcaatctattggtgtgattccagatggtgttgacaagaatgggaagccacacaaactcagattgtactcaattgctagcagcgctcttggtgatttgggagactcaaaaactgtatccctgtgtgtaaaaaggcttgtgtacacaaatgatcaaggagaagtagtcaaaggagtctgctcaaactttttgtgtgatctgaagcctggagctgacgtgaagatcactggtccagttggaaaagaaatgctcatgcctgtagatcccactgcaaccgttataatgcttgcaactggaactggaattgctcctttccgttcatttttgtggaagatgttctttgagaagcatgaagattataagttcaatggtttggcatggctcttcttgggtgtccccactagcagctccctactatacaaggatgaattcacgaaaatgaaagagaaagccccagaaaacttcaaggtcgactatgccgtgagcagagaagaaacaaatgaaaagggcgagaagatgtacatccaaaccaaaatggctcaatatgcagaacagctgtgggagcttctcaaaaaggacaacacttatgtctatatgtgtggtctcaaaggcatggaaaagggtatcgatgacattatggtttctttggctgcgaaagatggtatcgattggctggactataggaagcagttgaagaaggcagagcaatggaatgtggaggtctattaataaagttgccttcaaaatgtaaatcggtagtaaagagggcatatctctgtgctatctcatagataataaaatgatcctcaatgaatgattacttcgtgtcgaatgcttgtctgtaggttaaaaggtctttaagacattcaagtcccattatacatggatccaaaaagtttattcatacatcgatcatctcatatcct

SEQ ID NO: 1099 - DNA, 1503 bp, Cirsium arvense
atcctcacatctgccgttgccattggctttcaaatttcctccatccaattcacaaatatccattccctttttcttcttcactcgtagtatatcttccatttctctttgcactcttcactcttcattttcttcaatcacgatggctgctgcagtgagtgccgttgtctccctttcatcttccaaatccactgcaatttcaactagaacatccctcgtttcccaagaacgagtctccttcgccaaggtgccatattacaaaaatgtgtcatcaagtggtaaattgttttcaattagagctcaagtcacaacagaggctcctgctaaagtagagaaagtttcaaagaaacaagaagaaggtgtagttacaaataaataccggccaaaggaaccatatgtcggtcggtgccttcttaacaccaagatcactggcgatgatgcccccggtgaaacatggcacatggtcttcagcaccgagggtgagatcccatacagagaagggcaatccattggtgtaattccagatggaatcgatcccaagaacggaaagccacacaaactgagattgtattccatcgctagcagtgctatcggtgattttggagactccaaaaccgtctctttatgtgtgaaaagacttgtctacaccaacgaccaaggcgtagaagttaaaggagtttgctctaacttcttgtgtgacttaaagcctggatctgaggtgcaaataaccggtccagttggaaaagaaatgcttatgccaaaggatcctaatgcaaccgttataatgcttgcaacaggaactgggattgctccatttcgctcatttatgtggaaaatgttcttcgagaagcatgaagactatcagttcaatggtttggcatggctctttttgggagttcccacaagtagttccctgttatataaagaggaatttgagaagatgaaggagatgaaaccagagaacctaagagttgactttgctgtgagcagagagcaaactaacgataagggggaaaagatgtacattcaaaccagaatggcgcaatacgacaaagaactatgggaattgctcaagaaagacaacacctttgtgtatatgtgtgggcttaagggcatggagaagggtattgatgacattatggtttcattggctgctgaagatggcattgattggctacaatacaagaagcaattgaagaaagaagggcaatggaatgtggaggtgtactaagtggctttgtttcttcttgtacaaatgcagccctctctttgtagatagctttggatgcttatttcgagtgcccagaaagcaacaagttcataaggatatggaaagggtacgacattatgtgagagagcttcaccaacaaaaaaagcgtaataatgttaacgaattgttatgtggttgacattgtttacaagttatggtatacatatttgtgattccatacatgtatatgaggtcattctttacattatattaaagaaagagctcacagagttgaa

SEQ ID NO: 1100 - DNA, 1457 bp, Lotus japonicus
ctccaccccattggtttccaatttcatccactcaatcttataatcctcagtgcatcaagaatcttcatacttcattccctaccacgtttcatcatcgcttcatatatcattgccttctctctctgtctctccttctaatctttttccaatggctgccgcagtaactgctgcagtttcctttccatccaccaaatccacctctctcacaagcagaacctccatcgttgccccagagagagttgtgttcaagaaggttccattgcaatacactagtggaagggttgtttccatcagggctcaagtcaccactgacactgatacacaggctccaccagctaaggttgagaaggtgcacaagaaacaggaggaaggtgtggttgtgaacaagttcaaaccaaagaatccatatattggaagagtccttctcaactcaaagatcactggagatgatgctcctggagaaacatggcatatggtcttcagcactgaaggggaggttccttacagagagggacaatcaattggggtgattccagaaggtattgacaagaatggcaaaccacacaaactgagattgtattccattgccagcagtgcccttggtgactttggagactctaagactgtttctctttgcgtgaaacggctagtgtacacaaacgatagcggagaaattgtcaagggagtctgctcaaacttcttgtgtgacttgaagccaggatctgaagtaacaatcactggacctgttgggaaagaaatgcttatgccaaaagatcctaatgccaccgtcatcatgttggcaactggaactgggattgccccatttcgctcatttttatggaaaatgttcttcgagaagcatgatgactacaagttcaatggtttggcatggctcttcttgggtgtcccaacaagcagctctctgctttataaggaggaatttgaaaagatgaaggagaaatcacctgaaaacttcaggttggactttgctgtgagcagagagcaaacaaatgataaaggagagaagatgtacatccaaacccgtatggctcaatatgcagaagagctgtggcaactacttaagaaagacaacacttttgtgtacatgtgtggactgaaagggatggaaaagggaattgatgacattatggtgtcattggctgccagagatggcattgattggattgagtacaagaggcaattgaagaaagcagagcaatggaatgttgaagtctattaatttcagttccacttgcacagatatcaagtcctactttatgcagtaacaaatctatcacccctcttgcattctgtaggtatatgcagccctgtaatttttctatgatgatatattttttttacactgttgatgaacaactgttgtgaaagcccgacaagaagtaatatttttgagggatgaatgatgttatatagacgaatccaacttcactgtacca

SEQ ID NO: 1101 - DNA, 1309 bp, Utricularia gibba
caaaatggctgctgctgtaagcgctgcggtctctctgccttcctccaaatccacttctcttactactagaaactccagtgccgtctcagagaggatcacctacaataaggggtccttatcctacagaaatggatcgtgtggtggttctaagtttctgtccataagagctcaagtgacagcagatacagaggtgcaagccccgcccaaggccgtgaagcactcaaagaagcaagaagaaggagtggtggtgaacaagttcaagcccaaggatccatataccggtagatgcctactgaataccaagataaccggagacgatgcccctggtgaaacatggcatatggtgttcagtactgagggtgaggtgccatatcgagaagggcagtcgatcggtgtcattccggatggtattgacaagaatgggaagcctcataagcttaggttgtattctattgcaagcagtgcacttggtgactttggagactccaagactgtgtctttgtgtgttaaacgtcttgtttacaccaacgatcaaggggaaattgtcaagggagtctgttccaactttctgtgtgacctgaaacctggtgccgaggtgaagataactgggcctgtaggaaaagaaatgcttatgccaaaggatcccaatgctaccgtcataatgctcgccactggaactggaatagctccattccgttcatttttgtggaaaatgttctttgaaaagcatgatgattaccagttcaatggcttagcatggctgttcctcggagttcccaccagcagctcactgttatacaaggaggaatttgagaagatgaaggagaaaagcccagaaaacttcagagtggacttcgctgtcagcagggagcaaaccaatgctaatggggagaagatgtacatccaaacccgaatggctgaatacgcacaagagctgtgggaactgctcaagaaagacaacacttatgtctacatgtgtggtctcaagggcatggagaaaggcattgatgacataatggtgtccttggctgctaaagatggcatcgactggatagattacaagaagcagttgaagaggggagaacagtggaatgtggaggtgtactaaatacactcactcctctcacacatggagaaacattctgcttatccgctatatgctgctgtaaagattttcttctatttctgcatcttccaatcttgtgtttgtaatccatgtggttggatatagcaaaacagagaagatcctctacaaaatcgtttgtcctttacctaacctactccgttattgtcaactagtcaccctcct

SEQ ID NO: 1102 - DNA, 1193 bp, Arnica chamissonis
attcaatcaccatggctgctgctgcagtaagcgttgttgtctctcttccatcttccaaatctactgtaatttcaactacaacgtcactcgtttctcacccacgtgtctctttcaccaaggtgccatattacaaaaatgtgtcaacaaatggtagattggtatcaattagagcccaagttgcaacagatactgaagcacctgctaaagtagagaaagtttcaaagaaacaagaggaaggtgtggttacaaataaataccgcccaaaggaaccatatgttggtaggtgtcttctcaacaccaagatcacaggtgatgatgcccctggtgaaacttggcacatggttttcagcacagagggtgagatcccatatagagaagggcaatcaattggtgttattccagatgggattgaccccaagaatggaaaaccacacaaactgagattgtattccattgctagcagtgctattggtgattttggagactccaaaactgtatcattatgtgtgaaaagactcgtctacacgaatgacaaaggcgaagaagttaaaggagtttgttctaacttcttgtgtgacttaaagcctggagctgaggtgcaaataactggtccagtaggaaaagaaatgctcatgccaaaggatcctaatgctactgttataatgcttgcaacaggaactgggattgctccattccgatcgtttatgtggaaaatgttctttgagaagcatgaagactataagttcaatgggttggcatggctctttttgggtgttcccacaagtagttccttgttatataaagaggaatttgagaaaatgaaggagatgaaaccagataacctgcgagttgactttgcggtgagccgagaacaaaccaatgagaagggtgaaaagatgtacattcaaaccagaatggctcaatatgacagagaattatgggaattactcaagaaagacaacacatttgtgtatatgtgtgggcttaagggtatggagaagggtattgatgacattatggtcacattggctgctgaagatggcattgattgggtacaatacaagaagcaattgaagaaagaagggcaatggaatgtggaggtttactaaatggctttgaggttcttgtacaaatgcaacactctctttgtagataggtaacctttataaaccaactctattgttatgagattt

SEQ ID NO: 1103 - DNA, 1237 bp, Heritiera littoralis
aacagcccatcaaataacatttcctcctcttctctcttctttcttctttcttcattatcaaaaaccatggctgctgtaactgctgcagtctcttttccttctaccaagtcaacatctcttcctgctagaacctctatcattatttctccagaaagaatcaccttcaggaaggttcctgtttacttcagagatgtttccaatggagggagaatggtttctgtcagagcccaggttactactgaggcagaggctcctgctaaagttgtaaaggagtccaagaaaaatgaggaaggtgttgtcgttaacaagttcaagccaaagaaccctcacatcggcagatgccttttaaacactaagatcaccggtgatgatgctcctggagagacttggcacatggtcttcagcactgaaggagagcttccctacagagaagggcaatccattggggtgattccagatggcattgacaagaatgggaaacctcacaagttgagattatattctattgctagcagtgctcttggtgattttggagactccaaaactgtatccctatgtgtgaaacggttggtctacaccaatgagaatggagaacttgttaaaggagtctgctcaaatttcttgtgtgacttgaaacctgcggcagaagttaaaatcacaggacctgttggaaaggaaatgcttatgccaaaagatcccaatgccacaatcatcatgcttgctactggaactggaattgctcccttccgatcatttttgtggaaaatgttctttgagaagcacgatgattacaagttcaatggtttggcatggctcttccttggtgtccccacaagtagctcattgttgtacaaggaggaattcgagaagatgaaggagaagtaccctgacaagttcaggctggactttgcagtaagcagagagcaaacgaatgagaaaggagaaaagatgtacattcagacccgaatggctcaatacgcaaaggagctatgggagttactcaagaaagacaacaccttcgtctacatgtgtgggttgaagggaatggagaagggaatcgatgatataatggtgtcactggctgcagaagatggtgttgattggactgagtacaaaaggcagttgaagaaagctgagcaatggaatgttgaagtctactaactgtggattacttgtacaaatctccccttctcttccattttctctctcttctctgagcagccatggatatagggta

SEQ ID NO: 1104 - DNA, 1288 bp, Cicer arietinum
tggctgctgcagttacagccgcagtctcctttccttactccaactccacttcccttcccatcaggacatctgttgttgctcctgaaagacttgtcttcaagaagatttcattgcaatatagagataataatgtttctataagtggaagggttggttcaattagagcacaagttactacagaagcacctgctaaggtagaaaagatatcaaagaaacaggatgaaggtatagttgttaacaaattcaaacctaaggaaccatacattgggaggtgtcttctcaacacaaagatcactggtgatgatgcacctggtgaaacttggcacatggttttcagcactgagggagaggttccttacagagaaggacaatcaattggagtagttcctgatggtattgacaagaatggcaagcctcacaagctgagattgtattcaattgctagtagtgccattggtgattttggagactccaaaactgtttccctatgtgtgaaacgtcttgtgtacacaaatgacagtggagaagttgtcaagggagtctgctcaaatttcttgtgtgacttgaagcctggatctgaagtaaagattactggaccagttggtaaagaaatgcttatgccaaaagatcctaatgccaccatcatcatgttgggaactggaactggaattgctccatttcgctcatttttatggaaaatgttcttcgaaaagcacgaagattatcagttcaatggtttggcatggctcttcttaggtgtccccacaagcagttcattgctttataaggaggaatttgaaaagatgaaggagaaagcacctgagaacttcaggcttgactttgctgtgagtagagagcaagtaaacgaaaaaggagagaaaatgtacatccaaaccagaatggctcaatatgcagaagagttgtgggagttacttaagaaagacaacacttttgtttacatgtgtggactcaaaggaatggaaaaggattgatgacataatggtgtcactcgctgccaaagacggtatcgattggatcgagtacaagagacaattgaagaaggcggagcaatggaatgttgaagtctattgatttattttcacttgcacagataacaagtctcactttgtgcagcagcatatctatatcaccctcgtcctgcattctgtagatagattacaaaccctgtaattttggtatgctaaaaaaattataccttgcttgtgaacaatctttgttacataatccttgcaagaaaataattttgaagatcatgcactagacgcgt

SEQ ID NO: 1105 - DNA, 1283 bp, Ananas comosus
atctctttcagccatggctaccgcaataagtgctgcagtttcgtttcaatcatcgagttctacttctctctctaccaaatcctctatcatctcccccaaaagaatcacctttaaggttcctttgcccaacagaaatgtgtccacgggttgtagggttctctcaatcagagcccagatcacaactgatgctcctgctaagaaggtcgaaaaacattcaaagaaaatggaggaaggtgtgatagtgaacaagtacaggccaaaggacccatacattgggacatgccttcttaacactaagatcactgctgatgatgcacctggagaaacttggcacatggtcttctccacagagggagagataccctatagagaagggcaatctattggtgtgattccagatggtgttgacaagaatgggaagccacacaaactcagattgtactcaattgctagcagcgctcttggtgatttgggagactcaaaaactgtatccctgtgtgtaaaaaggcttgtgtacacaaatgatcaaggagaagtagtcaaaggagtctgctcaaactttttgtgtgatctgaagcctggagctgacgtgaagatcactggtccagttggaaaagaaatgctcatgcctgtagatcccactgcaaccgttataatgcttgcaactggaactggaattgctcctttccgttcatttttgtggaagatgttctttgagaagcatgaagattataagttcaatggtttggcatggctcttcttgggtgtccccactagcagctccctactatacaaggatgaattcacgaaaatgaaagagaaagccccagaaaacttcaaggtcgactatgctgtgagcagagaagaaacaaatgaaaagggcgagaagatgtacatccaaaccaaaatggctcaatatgcagaacagctgtgggagcttctcaaaaaggacaacacttatgtctatatgtgtggtctcaaaggcatggaaaagggtatcgatgacattatggtttctttggctgcgaaagatggtatcgattggctggactataggaagcagttgaagaaggcagagcaatggaatgtggaggtctattaataaagttgccttcaaaatgtaaatcggtagtaaagagggcatatctctgtgctatttcatagataataaaatgattctcaatgaatgattacttcgtgtcgaatgcttgtttgtaggttaaaaggtctttaagacatttaagttcgattatacattgatcgaaaaagttttatttatacat

SEQ ID NO: 1106 - DNA, 1388 bp, Theobroma cacao
acctcacttcttcactaacaaaaaaccatcaatcagcaatttctactgtactttcttcttcttccttcattgtcaaaaacatggctgctgtaaatgctgcagtctcttttccttctaccaagtccacctctcttcctgctagaatctcgatcatctctccagaaagactcaccttcaagaaggttcctgtttactacagagatgtttccagtggagggagagtggtttctgtcagagcccaggttacgaccgaggctcctgccaaaaaagttgtaaaggaatccaagaaaaatgaggagggtgttgtcgtgaacaagttcaagccaaagaacccgtacactggcagatgccttctaaacactaagatcactggtgatgatgctcctggagagacttggcacatggtcttcagcactgagggagaggttccctacagagaagggcaatccattggggttattccagatggcattgacaagaatgggaaacctcacaagctgagattatactctatcgctagcagtgcccttggtgattttggagactccaaaactgtgtccctatgtgtgaaacggctggtctacaccaatgagaatggagaacttgttaaaggagtctgctcaaatttcttgtgtgacatgaaacctgggtcagaggttaaaatcacagggcctgttggaaaggaaatgcttatgccaaaagatccaaatgccacaatcatcatgcttgcaactggaactggaattgctcccttccgatcatttttgtggaaaatgttctttgagaagcatgatgactacaagttcaatggtttggcatggctcttcctgggtgtacccacaggtagctcattgctgtacaaggaggaatttgagaagatgaaggagaagtaccctgacaactttaggctggactttgctgtgagcagagagcaaacgaatgagaaaggtgaaaagatgtacatccagacccgaatggatcaatattcaaaggagctatgggagttactcaagaaagataacacctacgtctacatgtgtgggttgaagggaatggagaagggaattgatgacataatggtctcacttgctgcagaagatggtattgattggactgagtacaaaaggcagttgaagaaatctgagcaatggaatgtggaagtctactaactggttgattacttgtacaaatccccctctctcgggtttttctcctctcttttttgagcagccatcctgtaaggagtcccactgcactgtgtaaatagggagtgtctcttttttggagcctatattaatgaaacaacagtattttatagccaacctcataaatttttattcttgaggggtaatcaatcaaacttccaactccaacctgctttatattaa

SEQ ID NO: 1107 - DNA, 1839 bp, Populus trichocarpa
cgaacacttatcctcacttcaaccactgcatttgcttccaaatctcatccattcatcccataatccattaccagcctagaaaacaagaagatcatactacttacactcttctgtcactaataaaacttcgccctcttttctcttcttctttttacctcttctttctttagcctcatcatcatcacaaccatggcagctgcagtaactgctgcagtctcctttccttcctctaccaagtctacctctctttcttcaagaaccactctcattgcaccagaaagaatcaccttgaaaaaggcgccagtttactacagagatgcgtctgctagtggaagagtgatttccatcagagcccaagtcaccacagaggctccagttaaggttgagaaggtatcaaagaaggatgttgagggagtggttgttaacaagttcaagcctaagaacccttacactggaagatgtcttttgaacactaagatcactggtgatgatgctcctggtgaaacttggcacatggtcttcagcactgaaggagaggtaccctatagagaagggcaatcaattggagtaattccagatggtattgataagaacgggaagcctcataaactaagattatattcaattgccagcagtgctattggtgactttggagactccaaaactgtttctttgtgtgtgaagaggcttgtctacaccaatgaacaaggagaaattgtaaaaggagtttgctcaaatttcttgtgtgacttgaaacctggagctgaagtacagattacagggcctgttgggaaagaaatgcttatgccaaaagatccaaatgccactatcattatgcttggaactggaactggtattgctcctttccgatcattcttgtggaaaatgttctttgagaagcacgatgactacaagttcaatggtctggcatggctcttcctgggtgtcccgacaagtagctcattgctctacaaggaggaatttgagaaaatgaaggagaaagcccccgacaacttcaggctggacttcgcagtcagtagagagcaaacaaacgacaaaggggaaaagatgtacatccaaacccggatggcagaatacgcagaagagctgtgggaattactaaagaaagacaacacttatgtctatatgtgtgggttgaagggaatggagaagggaattgatgaaataatggtgtcattggctgctaaagatggcattgattggcttgagtacaaaagaagtttgaagaaagcagagcaatggaatgtggaagtctattgatgctatgattacttgtacagatatttcccctcttttctggttattacaagcaatcatcttcctgtaatgatttccactgcattgttgtagataggtaatatgcatggttgtagtttttggctagaaaatccttttcgttttttctttttcaatgaatgaagcgaatgtattttatggcatttggatacaagagttattatttcttgagcaatcacagtatgcaaaacatttatatgcatgagtcaacttctatgatctctgctgtatgaatgttctgatttcttcagaatctgtcagtttcaagcacacttttttgttgaattcctctaatttgggatgagttcaggatgcctaagttttgggcacagacaccatcagccaaaactcttagcctagccatgcacgtcatgatatttaatatttctttatccctaaaattatttttatttaattattcaataataaaacgcatgagaattgttttgcatggaatattgtttttttttttttaaataactaggacaggcgcgtgatactaagattgcaaaagtagaccta

SEQ ID NO: 1108 - DNA, 1369 bp, Pisum sativum
aatcaacattactctctcttcctccatcttctagattcttccatcatcaacaacaacaacaaacatggctgctgcagtaacagccgcagtctccttgccatactccaactccacttcccttccgatcagaacatctattgttgcaccagagagacttgtcttcaaaaaggtttcattgaacaatgtttctataagtggaagggtaggcaccatcagagctcaggttactactgaggcacctgctaaggtagtaaagcattcaaagaaacaagatgaaaatattgttgtgaacaagttcaaacctaaggaaccatacgttgggaggtgtcttctcaacacaaagatcactggtgatgatgcacctggtgaaacttggcacatggttttcagcactgagggagaggttccttacagagaaggacaatctattgggatagttcctgacggtattgacaagaatggcaagcctcacaagctgagattgtattcaattgctagcagtgccattggtgattttggagactccaaaactgtttccctatgtgtgaaacgtcttgtttacacaaacgatgccggagaagttgttaagggagtttgctcaaatttcttgtgcgatttgaagccgggatcagaagtaaagattactggaccagttggtaaagaaatgcttatgccaaaagatcctaatgctactgtcatcatgttgggaactggaactggaatcgccccatttcgctcatttttatggaaaatgttctttgagaagcatgaagattaccagttcaatggtttggcatggctcttcctaggtgtccctacaagcagctcactgctttataaggaggaatttgaaaagatgaaggagaaagcacccgagaacttcaggcttgactttgctgtaagcagagagcaagtaaacgataaaggagagaaaatgtacatccaaacaagaatggctcaatacgccgaagagttatgggaattactgaagaaagacaacacttttgtttacatgtgtggactgaaaggaatggaaaagggaattgatgacataatggtgtcactcgctgccaaagacggcatcgattggatcgagtacaagagaacgttgaagaaggcggagcaatggaacgttgaagtctattaatttcttttcacttgcattgataacaagttccagtttgtgcagcagcttatctatatcaccctcctgtattctgtagatagattacattacaaccttgtaattttggtatgacaaaaaattataccttgcttgtgaacaatattgtttacggaatcgttgcaagaaataattttgaggatcatgcaatatagtttatcaatttcctgaaatttaattgtgaat

SEQ ID NO: 1109 - DNA, 1442 bp, Amaranthus tuberculatus
aactccatacaaattttctactaaatttaggttcttaaaactaattaacctacgtacagtttttctgttttatttctctctttcctcaaacaatatacattatctcttcttccatttacatagctagtcatggctgctgcagtcactgctgcagtttctttccctacaaccaagtcatcaaatccctcctctagaacttcttctatcatctctaatgacaagatcagctacaaaaaggttcctttgtaccacagaaatgtatgtggtgtgggtaaagtgggggccattagagcccaagtgacctcagatgtggcagctcctcctgcaaaagttgagaagcattctaagaaaatggaggaaggagttgttttaaacaagtataagcctaaagaaccttacgttggaaggtgtctccttaacactaaaattactggggatgatgctcctggggagacttggcacatggttttttcccatgaaggagaggttccttacagagaggggcagtctattggagtcattgccgatggtgttgacaagaatggaaagcctcataagttgagattgtactcaattgccagcagtgcccttggtgatttcggtgattctaaaactgtttcgttgtgtgtaaaacgacttgtctacaccaatgaggctggagaaatagtcaagggagtctgctcgaactacttatgtgacttgaaacccggtgctgaagtgaagataacagggccagttggaaaggagatgctgatgcctaaagaccccaatgcaactattatcatgcttgcaactggaactggaattgctcctttccgttcgttcttgtggaagatgttcttcgaaaagcatgatgattacaagtttaacggcttggcttggctgttttgggtgtaccgacaagcagttctctgctctacaaagaggaatttgaaaagatgaaagagaaggctccagaaaacttcaggctagattttgctgtgagccgtgagcagactaacgagaaaggagagaagatgtacatccaaactcgtatggcacaatacgacaaggagctatgggaattgctcaagaaagataacacttacgtctacatgtgtggactcaagggaatggagaaaggaatcgatgatatcatggttccattggctgctgctgaggggatcgattggattgaatacaagaggcaattgaagaaggcagagcagtggaacgttgaagtctactgataacccatgtatattgtttacttattcaaaataatcccagtttctcactgcaccttgtagttagctcagttttttctcaatactattatcatcatcataccataaaacttgtgttcggaagcccagtgtttgagctaatatagtcaaactcatttgaaaacaattgttgtatgctttacaaatatgaaccaacctaataacgttctgttttat

SEQ ID NO: 1110 - DNA, 1284 bp, Tropaeolum majus
atgatggtactagtaaactagttgtagtggattgatggtgaattcatgcaaataaacacaaaaaacttatcctcacataagccactgccttacttctacaatctcatccacccaatttcatataatccattaacactatcccaattcctcatctctcattcccaacccaaaaaatatcatggcgactgcagtaagtgctgcggtttctctcccttccgccacctccacatcgttgatctccaatagaacctccatcatctcacctgaaagagtctccttctccttcaataagggttttcttcaatacagagatgtatgtgctggaggaagagtcgtacccatcagagctcaggttacaaccgaagctccagctaaagttgagaaagttcataaaaaaatggaggatggaatcactgttaacaaattcaaacctaagaatccctacaccggtagatgtcttctgaacactagaatcactggtgatgatgctcccggtgagacttggcatatggtattcagcactgaaggggaggttccttatagagaaggacaatccattggggtgattgctgatggtgctgacaaaaatgggaaacctcataagcttaggttatactccattgctagtagtgccattggtgactttggggactcgaaaactgtttctttatgtgtgaaaagacttgtctacaccaatgatcaaggggaggttgttaaaggagtttgctcgaatttcttgtgtgacttgaaacctggatcagaagtaaaaatcacaggacctgttgggaaacaaatgcttatgccaaaagatccaaatgccacaatcattatgcttggaacaggaactggaattgctcccttccgatcattcttgtggaaaatgttctttgagagccatgaggactataagttcaacggtttggcatggctattcttgggtgttccaacaagcagttcattgctctacaaggaggagttcgaggaaatgcagaagaagcatccagacaacttcaggctagacttcgcggtgagcagagaacaaaccaatgaaaaaggcgaaaaaatgtacatccaaacccggatggcgcagtacgcgagggagctatgggagttactcaagaaagacaacacctttgtttacatgtgtgggttgaaagggatggagaaaggaattgacgacatcatggtttcattggctgctgaagacggtattgactggttagagtacaagaagcagttgaagaaagctgagcaatggaatgttgaagtgtattaagctgcctt

SEQ ID NO: 1111 - DNA, 1187 bp, Medicago truncatula
gcatatacatatcatcacttaattaaataacattactctctctctctctctctacattttcttgattcttccaataacaacatggctgctgcagtaacagccgccgtctcttttccatactccaactccacttctcttccgatcaggacatctgttatttccccagatagacttgtcttcaaaaaggtttcgttgaataatgtttccataagtggaaggttaactgtcagagccgaagttgctacagaagcacctgctcctgttaaggttgaaaagatatcaaagaaacaggaagaaggtattgttgtgaacaagtttaaaccaaagacaccatacattggaaggtgtcttctcaacacaaagatcactggtgatgatgcacctggtgaaacctggcacatggttttcagcactgagggagaggttccttacagagaaggacaatcaattgggatagttccagatggtattgacaagaatggaaagcctcacaagctgagattgtattcaattgctagcagtgctcttggtgattttggagactccaaaactgtttctctatgtgtgaaacgtcttgtgtacacaaatgatgccggagaagttgttaagggagtttgctcaaacttcttgtgcgacttgaggcctggatctgaagtacagattactggtccagttggtaaagaaatgcttatgccaaaagatccaaatgccaccgtcatcatgttgggaactggtactggaattgccccattccgttcatttttatggaaaatgttcttcgagaagcatgaagattacaagttcaatggtttggcatggctcttcttgggtgtccccacaagcagctcactgctttataaggaggaatttgaaaagatgaaggagaaagcgcctgagaacttcaggctcgactttgctgtgagcagagaacaagtaaacgacaaaggagagaaaatgtacattcaaaccagaatggctcaatatgcagaagagttgtgggaattactgaagaaagacaacacttttgtttacatgtgtggactgaaaggaatggaaaagggaattgatgacataatggtttcactcgctgccaaagacggtattgattggattgagtacaagagatcgctgaagaaggcagagcaatggaatgttgaagtctattgatttattttcacttgcatcga

SEQ ID NO: 1112 - DNA, 1793 bp, Populus trichocarpa
gggaggccttattgctctgctacatcaaaacaaagatagtggcaggcagacttttgtggcaaaaggataattggagtcatacgttgcacatacaacttatcctcacatcagccactgcatttgcttcaagatctcatccattcaaatcccatcatccccccaaaaaagaaagaaaaaaaacaagccataatacttgcattcttctgtttctcgcttcctccactgataaaacctccctctcttcacaaccaccaccatcatctcaaccatggcagctgcagtgactgctgcggtctcttttccttcctcaaccaagtctacttctcttccttcaagaaccattctcattgcaccagaaagaatcaccttgagaaaggtgccagttcacttcagggatgtgtctgctagtggcagagtgatttccattagagctcaagttacaacagaggctccagctaaggttgagaaggtatcaaagaaaaatgaggagggagtggttgttaacaagttcaagcctaagaacccttacactggaagatgtcttttgaacactaagatcactggtgatgatgctcctggtgaaacctggcacatggtcttcagcactgaaggagaggttccgtatagagaagggcaatcaattggagtgattccagatggaattgataagaatgggaagcctcataaactaagattatattcaattgctagcagtgctatcggtgactttggagactccaaaactgtttctttgtgtgtgaagaggcttgtgtacaccaatgaccaaggagaaattgtaaaaggagtttgctcaaatttcttgtgtgacttgaaacctggagctgaagttaatattacaggaccagttgggaaagaaatgctcatgcctaaagatcccaatgccactgtcattatgcttggaactggaactggtattgctcctttccgatcattcttgtggaaaatgttctttgagaagcatgatgactacaagttcaatggtttggcatggctcttcttgggagtcccgacaagcagctcattgctttacaaggaggaattcgagaagatgaaggagaaagcccctgacaacttcaggctagactttgcggtaagtagagagcaaaccaatgccaaaggtgaaaagatgtacatccaaacccggatggcagaatatgcagaagagctatgggaattactaaagaaagacaacacctacgtctacatgtgtggattgaaaggaatggagaaggggattgatgatataatggtgtcattggctgctaaagaggaaattgactggcttgagtacaaaagaagcttgaagaaagcagggcaatggaatgtggaggtctattaatgtgattacttgtacaaatatttcctcttttttggttactacaagcaatcgtcttcctcctgctgcgttgttgtagatagataattaagatgcatgttcgtaatttttggctaaaaatttctttttccttttttatgaatgaaggcaatgtaatgtcatagcatgcatttacaaatgacaggagttgttatttcttaaggaatcatggtatatttgaaatatatttttatttaattatataaaaattaaaataaatataagtaagaaaggaaattattaaaattccggagaaaaatatatttttttagtcaagattgtattctcagctcattcatgtaacatttttttatacaatgacattgtcttttttattatcaacatgatttactgaacaatgacaaataaccattaaaaaaatattcttaaaaattct

SEQ ID NO: 1113 - DNA, 1491 bp, Tragopogon dubius
tgttttgtggccacagaaactcacaagtgtaaaaagacaacacaaatttcttatcctcaatatctgccactgccattggctttctaatttcctccaaccaattcacaaatatccaccatcgcatttcttcttcactcatagtatatcttccctttctcttaactctcttcactcttcattttgttcgatcaccatggcttctgcagtaagtgcggtagtctcccttccgtcttccaaatctgccgcaatttcaaccagaacatctctcatctctcaagaacgagtctctttcaccaaggtgccatcttacaaaaatgtgtcatcaagtgttaaatcgtttacaattagagcccaagtcacaacggaggctccggctaaagtagagaaaatttccaagaaacaagaggagggtgtggttacaaataaataccggccaaaggaaccatatgttggtcggtgccttcttaacaccaagatcaccggcgatgatgcccctggtgaaacgtggcacatggtcttcaccaccgagggtgagatcccatatagagaaggacaatccattggtgtaattccggatggaattgaccccaagaatggaaagccacacaaactgagattgtattccattgctagcagtgctcttggtgactttggagactccaaaactgtctcattatgtgtgaaaagacttgtctacacgaatgacgagggggtagaagttaaaggagtttgttctaacttcttgtgtgacttgaaacctggggcagaggtgcaaataactggtccagtaggaaaagaaatgcttatgccaaaggatcctaatgcaactgtcataatgcttgcaacaggaactgggattgctccatttcgctcatttatgtggaaaatgttcttcgagaagcacgacgactataagttcaacggtttggcatggctctttttgggtgttcccacaagtagttcattgctatataaagaggaatttgagaaaatgaaggagatgaaaccggataacctacgagttgactttgctgtgagcagagagcaaactaatgataagggtgagaagatgtacattcaaactagaatggctcagtatgacagagagctatgggaattacttaagaaagacaatacctttgtgtatatgtgtgggctcaagggcatggagaagggtattgatgacattatgggtacattggctgctgaagatggcattgattgggtaacatacaagaaacagttgaagaaagaagggcaatggaatgtggaggtgtattaagtggctttgtttatttttgtacaaatacagccctcatcttgtagataggtaaccttttatttttgtaatctgcatatttgacatctttttttttaattttcttctttttaatttcattataaaccaagtctattgttatgggccaattttagtttatattttttgagggcatggatttcgaaagtatactacaagtatggtaataagaa

SEQ ID NO: 1114 - DNA, 1749 bp, Echinacea purpurea
cggccgggggatggccacagaaattaacaaatatcaagtgtaaaaagacaacacaaatttcttatcctgaaatctgtcaccagtttcctccatccaattgtacaccattcacgatcatatttcttcttcactcatcgtatatcttccatttctcttcactttcattttattcaatcgccatggctgctgcagtaagcgtcgtcgtctccctcccatcttccaaatcgactgtaatttcaactagaacatcgctcatctctcaggatcgtgtctctttcaccaaggtgccatattacaaaaatgtgtcaacaaatggtaaatcactatcaattagagcccaagtcaccacagaggctgaagcacctcctaaagtagagaaagtttcaaagaaacaagaggaaggtgtggttacaaacaaataccgcccaaaggaaccatacattggtaggtgtcttctcaacaccaagatcacaggtgatgatgcccctggtgaaacctggcacatggttttcagcacagagggtgagatcccatatagagaagggcaatccattggtgtaattccagatgggattgaccccaagaatggaaaaccacacaaactgagattgtattccattgctagcagtgctcttggtgattttggagactccaaaagtgtatctttgtgtgtgaaaagacttgtctacacgaatgacaaaggcgaagaagttaaaggagtttgctctaatttcttgtgtgacttaaaacctggagctgaggtgcaaataactggtccagtaggaaaagaaatgctcatgccaaaggatcctaatgctactattataatgcttgcaacaggaactggaattgctccattccgctcgttcatgtggaaaatgttctttgagaagcatgaagactataagttcaatgggttggcatggctctttttgggtgttcccacaagtagttccttgttatataaagaggaatttgagaaaatgaaggcggcaaaaccagataaccttagagttgactatgcggtgagccgagaacaaaccaatgagaagggtgaaaagatgtacattcaaaccagaatggctcaatatgacagagaattatgggagttactcaagaaagacaacacctttgtgtatatgtgtggacttaagggcatggagaagggtattgatgacatcatggtcacattggctgctgaagatggcattgactggacaacatataagaagcagttaaagaaagaagggcaatggaatgtggaggtttactaaatggttttgtttcttcttgtacaaatgcatccctcaatctttgtagataggtaacctttataaaccaactctattgtcatggattttcccaatatttagtttttatttttgtgagggcatggaacatgaaagtatattgcaattatgaaaacaagattcttcttgtaccattgcatatttgtataagcttatgacctttccatttgttctatcccaaatggcaaaaggataaaaggacatgttttgcacgcccatttaaagagatgtggaatagatatcgagactatgtgagagcgctataccaactagacgaatgtaaaaatggtttgttggtagtttttaagtcatggcttttgctttcatgtatcgagcttttgcgtgggttcttgtaggcattttatgacattagtatgcatccgttttggtggttatgatggatcttgaagaaacaggcgttcaaccgggtgggttgaac

SEQ ID NO: 1115 - DNA, 1305 bp, Flaveria ramosissima
ctctcacctctcttcactcttcattttattcaatcaccatggcctctgcagtaagcgctgtggtctcccttccatcttcaaaatccaccacaatttccaccagaacatcactaatctctcaagaacgagtctccttcaccaaggtgccgtgttacaagaatgtgtctactagtggtagattgttgtcgattagagctcaagttacaacagaggctgaggcgcctgcgaaagtagagaaagtgtcgaagaaacaagaggagggtgtggttacaaataagtataggccgaaggaaccgtatattggtaggtgtcttctcaacaccaagatcacaggtgatgatgctcctggtgaaacttggcatatggttttcagcactgagggtgagatcccatataaagaaggacaatccattggtgtaattccagatggaattgaccccaaaaacggaaagccacacaaactaagattgtattccattgctagtagcgctattggtgactttggagactccaaaactgtctctttatgtgtgaaaagacttgtctacacgaatgaccaaggcgaagaagttaaaggagtttgctcgaacttcttgtgtgacttaaagcctggagctgaggtgcaaataaccggtccagtgggaaaagaaatgcttatgccaaaggatcctaatgctacaattataatgcttgcaacaggaactgggattgctcctttccgctcatttatgtggaaaatgttcttcgagaagcacgaagactataaattcaatgggttggcatggctctttttgggtgttcccacaagtagttccttgttatataaagaggaatttgagaaaatgaaggagatgaagccagataacctaagagttgactttgcagtgagtagagagcaaactaatgataagggtgaaaagatgtacattcaaaccagaatggctcagtatgacagagagctgtgggaattactcaagaaagacaacacttttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaagtggcttttttcttgtacaaatgcagccctctctttgtagataggtgacaaggggatggtcgcgaatcatgaaatgaagaaacttaatggtctcatttctcacgcattcgttgaaatatgattcagttgacacaaaacttgttatgtaatctccctgtcacatgttgtaaag

SEQ ID NO: 1116 - DNA, 1385 bp, Flaveria ramosissima
tgccactgccattggctttctaatttcctccatccaattaccaaatatccacattccattcaccatcatacttcttcttcactcacactatatcatccatttctctcagctctctccactcttcattttattcaatcaccatggcctctgcagtaagcgctgtggtctcccttccatcttcaaaatccaccacaatttccaccagaacatcactaatctctcaagaacgagtctccttcaccaaggtgccgtgttacaagaatgtgtctactagtggtagattgttgtcgattagagctcaagttacaacagaggctgaggcgcctgcgaaagtagagaaagtgtcgaagaaacaagaggagggtgtggttacaaataagtataggccgaaggaaccgtatattggtaggtgtcttctcaacaccaagatcacaggtgatgatgctcctggtgaaacttggcatatggttttcagcactgagggtgagatcccatataaagaaggacaatccattggtgtaattccagatggaattgaccccaaaaacggaaagccacacaaactaagattgtattccattgctagtagcgctattggtgactttggagactccaaaactgtctctttatgtgtgaaaagacttgtctacacgaatgaccaaggcgaagaagttaaaggagtttgctcaaacttcttgtgtgacttaaagcctggagctgaggtccaaataaccggtccagtaggaaaagaaatgcttatgccaaaggatcctaatgctacaattataatgcttgcaacaggaactgggattgctcctttccgctcatttatgtggaaaatgttcttcgagaagcacgaagactataaattcaatgggttggcatggctctttttgggtgttcccacaagtagttccttgttatataaagaggaatttgagaaaatgaaggagatgaagccagataacctaagagttgactttgcagtgagtagagagcaaactaatgataagggtgaaaagatgtacattcaaaccagaatggctcagtatgacagagagctgtgggaattactcaagaaagacaacacttttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaagtggttttttcttgtacaaatgcagccctctctttgtagataggtaaccttctattttttgtaatttgtatttttttttcttttaatttctattataaaccaactctattgttattggtatccccaaattttattcttttccttactttg

SEQ ID NO: 1117 - DNA, 1218 bp, Flaveria ramosissima
ttctctcacctctcttcactcttcattttattcaatcaccatggctgctgcagtaagcgctgtggtctcccttccatcttcaaaatccaccacaatttccaccagaacatcactaatctctcaagaacgagtctccttcaccaaggtgccgtgttacaagaatgtgtctactagtggtagattgttgtcgattagagctcaagttacaacagaggctgaggcgcctgcgaaagtagagaaagtgtcgaagaaacaagaggagggtgtggttacaaataagtataggccgaaggaaccgtatattggtaggtgtcttctcaacaccaagatcacaggtgatgatgctcctggtgaaacttggcatatggttttcagcactgagggtgagatcccatataaagaaggacaatccattggtgtaattccagatggaattgaccccaaaaacggaaagccacacaaactaagattgtattccattgctagtagcgctattggtgactttggagactccaaaactgtctctttatgtgtgaaaagacttgtctacacgaatgaccaaggcgaagaagttaaaggagtttgctcgaacttcttgtgtgacttaaagcctggagctgaggtccaaataactggtccagtaggaaaagaaatgcttatgccaaaggatcctaatgctacaattataatgcttgcaacaggaactgggattgctcctttccgctcatttatgtggaaaatgttcttcgagaagcacgaagactataaattcaatgggttggcatggctctttttgggtgttcccacaagtagttccttgttatataaagaggaatttgagaaaatgaaggagatgaagccagataacctaagagttgactttgcagtgagtagagagcaaactaatgataagggtgaaaagatgtacattcaaaccagaatggctcagtatgacagagagctgtgggaattactcaagaaagacaacacttttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaagtggcttttttcatgtacaaatgcagccctctctttgtagataggtaaccttcttattttttgtaatttgtactttttttttt

SEQ ID NO: 1118 - DNA, 1275 bp, Primula obconica
tggctactgcagtaagtgctgcagtgtctctcccatcctcgaattctacatctctctcttcaagaaactcaatcatctctcccgatagaatcagtctttaagattaccttttcccagtggaaatgtatcgtacggggtgtagggttctctctatcagacgcccagatcacgagtgatgctcctgctaagaaagtacgaaaaacattacaaagaaaatggaagagggtgtaatagtgaacaagtacaggaccaaaacgaccctatataggaaaatgccttcttaactctaaaatcactgctgacgatgcgcctggtgaaacttggcacatgggttttctccactgagggagaggtaccctatcgagaagggcaatctatcggtgtgattgcagatggtattgacaagaatggaaagccccacaaactcagattatactcgatcgctagcagtgctcttggtgatttgggagactcaaaaactgtgtccctgtgtgtaaagaggcttgtgtacacaaatgatcaaggagaaattgtcaaaggagtttgctcaaactttttgtgtgatctgaagcctggagctgatgtgaaaatcactgggcccgtgggaaaagaaatgctcatgccaaaagatccaaatgcaaccattataatgcttgcaactgggactggaattgctcctttccgttcatttttgtggaagatgttctttgagaagcatgaagattatgagttcaaaggtttggcatggctcttcttgggtgtccctacgagcagctccctgttatacaaggatgaattcacgaaaatgaaggagaaggccccagaaaacttcaaggttgactatgctgttagcagagaagaatcaaatgaaaagggtgagaagatgtacatccaaaccagaatggctcaatatgcagaacagctatgggagctgactaaaaaaggataacacatatgtctatatgtgtgggctcaaaggcatggaaaagggtattgatgacattatgatttctttggccgccaaagacggtatcgattggatcgactacaggaagcagttgaagaaggcagagcaatggaatgtggaagtctattgataaatttgccttttgaatgtacatctttggtaaaaaggccatatctttgtgttattggagctatttcatagtcaataaaaaatactcgatgaatgattacttcttgtttagtgcttgtttgcaggttaagaactcttttagacatttgttacttctttttactgataaaaaaacggtt

SEQ ID NO: 1119 - DNA, 1523 bp, Cichorium intybus
ccattggctttccaatttcctccatccaattcacaaatatccattcacttcaccatcgcatttcttcttcactcatagtatatcttccctttctcttagctctcttcactcttcattttgttcgatcaccatggcttctgcagtaagtgccgtagtctcacttccatcttccaaatccgctgtcgtttcaaccagaacatccctcatctctcaagaacgagtctctttcgccaaggtgccatatttcaaaaatgcgtcatcgagtgttaaatcgttatcaattagagcccaagtcactactgaggctgaggctcctcccgctaaagtagagaaaatttcaaagaaacaagaagatggtgttgttacaaataaataccgcccaaaggaaccgtatgttggtaggtgtcttctcaacaccaagatcaccggcgatgatgcccccggtgaaacttggcacatggtcttcaccaccgaaggtgagatcccatatagagaaggacaatccattggtgtgattcctgacggaattgatcccaaaaatggaaagccacacaaactgagattgtactccattgctagcagtgctctcggtgacttcggggactccaaaaccgtttcattgtgtgtgaaaagacttgtgtacaccaatgatgcaggggaagaagttaaaggagtttgctctaacttcttatgtgacttgaagcctggagcagaggtgcaaataaccggtccagtaggaaaagaaatgcttatgccaaaggatcctaatgcaactattataatgcttgcaacaggaactggtattgctccgtttcgctcatttatgtggaaaatgttctttgagaagcatgaagactataagttcaacggtttggcatggctctttttgggagttcccacaagtagttcgttgctatacaaagaggaatttgagaaaatgaaagagatgaaaccagataatctacgagttgactttgctgtgagcagagagcaaactaacgaaaagggtgaaaagatgtacattcaaactagaatggctcagtatgacagagaactatgggaattactcaagaaagacaacacctttgtgtatatgtgtgggcttaagggcatggagaagggtattgatgacattatgggcacattggctgctgaagatgggattgattgggtaacatacaagaagcagttgaagaaggaagggcaatggaatgtggaggtttactaaatggttttcttcctttttgtacaaatacagccctctctttgtagatagctttggatgcttgttctgggtgcccaaaaagcaagaagttcggaaggacatgggactattaacggcattatttgagagcacttcaccaacgagaaacgtgtactgatggtcacaaatggctctttgtatgtcactattcatatgttatgtcgttatggtgtatgtgtttttgacttcatatgtatccaatgattcttttacattatattaaacatacgagtcactggtactggtttgagattttgca

SEQ ID NO: 1120 - DNA, 1507 bp, Elaeis guineensis
aatggcttctgctgcagtaactgctgcagtgtccttcccatcctccaagtcctcatccctttaactcttcttccacttccattgtctctcttcctccccctgaattcagaaaagaaagtagacaatggcttctgctgcagtaactgctgcagtgtccttcccatcctccaagtcctcatcccttgccctgcctacaagtagaacctccatctccactactgagaggctcagtctccacaagacatgcttgcacccaagaagtgtgtccacagctgggaagctggtctcaataagagcccaggtgacaacagagacgcctgccaaggtacagaagatctccaagaagaacgacgagggtgtcgtcgtcaacaagtataagccgaaggagccatacattgggaggtgcctccttaacaccaaaatcaccggcgatgacgcacctggagaaacgtggcacatggtcttcagcaccgagggtgacgttccatacagagagggacagtccattggtgtgatccctgatggaattgataagaatggaaaaccacacaagctcaggttgtactcaatcgccagcagcgctcttggagattttggtgactccaagacagtttctctgtgtgtaaagcggcttgtttatactaatgagcaaggggaaatagtgaaaggagtctgctcaaatttcttatgtgacatgaaacctggtgccgaagttaagattacagggccagtagggaaagaaatgcttatgcctaaggatcccaatgcaactatcataatgcttgccacaggaactgggattgcacctttccgctccttcttgtggaaaatgttctttgagaagcatgatgactacaagttcaacggacttgcatggctcttcttgggagttcctacaagcagctccttgctctataaggaggaattcgagaagatgaaagagaaggcaccaaataatttcagggtcgactttgctgtaagcagagagcaaacaaatgaaaagggagaaaagatgtacatacagactcgtatggcgcagtatgctgaggaactgtgggatctactcaagaaggacgatacctatgtatatatgtgtggactaaaaggaatggagaagggtattgatgacatcatggtatctttggctgctaaggatggtattgactgggtggattacagaaagaacctgaagaagtcagagcagtggaatgtggaagtgtattagcttgcatttttgtgcatgttgtgtaaggagctcatccttctataatatactctttactctagttctatgtggatagctaatgttctcttttgtgttttattttagtttcttgtaaggcaactgtattattctggccttgtaaatttgattcaagagggattttaacattgtaattctagccaatttggataccttgtaatgaacctcagcgataattatagtttttataacaaaaaaaaaataatagaacgtagtcgacgaagcacaggaggagtagggggg

SEQ ID NO: 1121 - DNA, 1429 bp, Helianthus annuus
ttggcttcagtttcctcctccatccattgtatacattcacgatcatatcttccatttctctccatcgccatggctgctgcagtaagcctcgctgtctcccttccatcttccaaatccactctaatttcaactagaccatcactcctctctcaggatcgtgtctccttcaccaaggtgccatattacaaaaatgtgacaacaaacggtaaaccactatcaattagagcccaaatcacaacagaggctgaagctgaagcacctgctaaagtagagaaagtttcaaagaaacaagaagaaggtgtagttacaaacaaatacaaaccaaaggaaccatacatcggtaggtgccttctcaacaccaagatcaccggtgatgacgcccctggtgaaacttggcacatggttttcagcacagagggtgagatcccatatagagaagggcaatctattggcgtaattccagacgggattgaccccaagaacggaaaaccgcacaaactgagattgtattccattgctagcagtgctcttggtgactttggagactctaaaaccgtatctctatgtgtgaaaagacttgtctacacgaatgacaaaggcgaagaagtcaaaggagtttgctctaacttcttgtgtgacttaaagcctggagccgaggtgcaaataactggtccggtaggaaaagaaatgctcatgccaaaggatcctaacgctactgtcataatgcttgcaacaggaactgggattgctccattccgctcatttatgtggaaaatgttctttgagaagcatgaagactatcagttcaatgggttggcatggctctttttaggtgttcccacaagtagttccttgttatataaagaggaatttgagaagatgaaggagatgaaaccagataacttaagagttgactttgcggtgagccgagaacaaaccaacgacaagggtgaaaagatgtacattcaaaccagaatggctcaatacgacagggaattatgggagttactcaagaaagacaacaccttcgtgtatatgtgcgggcttaagggtatggagaagggtattgatgacattatgaccacattggctgctgaagatggcattgagtgggcaacatacaagaagcagttgaagaaagaagggcaatggaatgtggaggtttactaaatggcgtttttcgcttcttgtacaaatgcagccctctctttgtagataggataaaaagacatgtttcgcacacgcatttaaagggatgtggagtagataatgaggaggctatgtgagagcgcttcaccaactagacgaatgtaataatggtatgttggtaatatatgtcattgcttttgctttcatgtatcgagcttttgcttgggttcttgtacgacgcatattgacattggtatgtactcgtttttggtggttatga

SEQ ID NO: 1122 - DNA, 1419 bp, Beta vulgaris
gcttcttcctattttcattcttcttccaatatacacacagtcatggctgctgcagtaactgctgcagtttctttcccttctacaaaatctacttctctttcctcaagaacttcttccatcatctcccctgagaagatcagcttcaagaaggttcctctgtactacagaaatgtatctgcaactggtaaagtgggtcccattagagcccaagtgacctctgatgtggaggcacctgcagctgcacctgctaaagttgagaaacattctaagaaaatggaggaaaatttggttgtgaacaagtataagcctaagaatccttacgttggaagatgtcttcttaacactaaaatcactggggatgatgcacctggagaaacctggcacatggttttctcccatgaaggagagatcccttacagagaagggcagtccgttggggtcattgcagatggtcttgacaagaatggaaagccccataagttgagattgtactcgattgccagcagtgccctcggtgactttggtgattcaaaaactgtttcattgtgtgtaaaacgacttgtctacaccaatgacgctggagaagaagttaagggagtctgctcaaacttcttgtgtgacttgaaacctggttctgaagtgaagctaacagggccagttggaaaggaaatgttgatgcccaaagaccctaatgctacgattgtcatgcttggaactggaacaggaattgctcctttccgttcattcttgtggaagatgttctttgaaaagcatgaggattaccagtttaacggcttggcttggctcttcttgggtgtacccaccagcagttctctgctctacaaagaggaattcgagaagatgaaggagaagtttccagacaactttaggctggattttgccgttagcagagagcaaactaacgagaaaggcgagaagatgtacattcaaactcgtatggcacaatatgctaatgagctatgggaaatgcttaagaaagacaacactttcgtctacatgtgtgggctcaagggaatggaatcaggaattgatgacattatggtttcgttggctgctgcagaaggcattgattggtttgaatacaagaggcagctcaagaaggcagaacaatggaatgtggaagtctactaataactgttgtacaaaaatctcttattcctttttgtgaagcagcatctatatctattgccattttctcactgcaccttgtagataggtcagttttttttttttacttttgggggttatgatgttgttatgacgataagcaaattgcattttagcgccatagcataaagctcttgtgagaaggctagtttttcagctaattatataggggaaattattgttgatactgtacacagaggaatttatgaaaatgaataccttatgcttcaa

SEQ ID NO: 1123 - DNA, 1479 bp, Flaveria ramosissima
atctgccactgccattggctttccaatttcctccatccaattaccaaatatccacattccattcaccatcattcttcttcttcgctcacactatatcacccatttctctcacctctcttcactcttcattttattcaatcaccatggcctctgcagtaagcgctgtggtctccgttccatcttcaaaatccaccacaatttccaccagagcatcactaatctctcaagaacgagtctccttcaccaaggtgccgtgttacaagaatgtgtctactagtggtagattgtcgttgattagagctcaagttacaacagaggctgaggcgcctgcgaaagtagagaaagtgtcgaagaaacaagaggagggtgtggttacaaataagtataggccgaaggaaccgtatattggtaggtgtcttctcaacaccaagatcacaggtgatgatgctcctggtgaaacttggcatatggttttcagcactgagggtgagatcccatataaagaaggacaatccattggtgtaattccagacggaattgaccccaaaaacggaaagccacacaaactaagattgtattccattgctagtagcgctattggtgactttggagactccaaaactgtctctttatgtgtgaaaagacttgtctacacgaatgaccaaggcgaagaagttaaaggagtttgctcgaacttcttgtgtgatttaaagcctggagctgaggtccaaataactggtccagtaggaaaagaaatgcttatgccaaaggatcctaatgctacagttataatgcttgcaacaggaactgggattgctcctttccgttcatttatgtggaaaatgttcttcgagaagcacgaagactataaattcaatgggttggcatggctctttttgggtgttcccacaagtagttccttgttatataaagaggagtttgagaaaatgaaggagatgaagccagataacctaagagttgactttgcagtgagtagagagcaaactaatgataagggtgaaaagatgtacattcaaaccagaatggctcagtatgacagagagctatgggaattactcaagaaagacaacacttttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaagtggtttttttcttgtacaaatgcagccctctgtagataggtaaccttctattttttttttgtaatttgtactgtttttcttttaatttctattataaaccaactctattgttattgggtatcccaaattttagttttcttttccttactttgagggtcattgattatgaaagtatactacaattatggaataagattctccttgtaaagtttttttacattggttatgtgccatagaaac

(The sequence listing continues in the following parts.)

What is claimed is:

1. A method of increasing growth rate, biomass, and/or abiotic stress tolerance of a plant, comprising:
   (a) transforming a plant with a nucleic acid construct comprising a polynucleotide encoding a polypeptide comprising the amino acid sequence set forth by SEQ ID NO: 196 or a homologous polypeptide comprising an amino acid sequence at least 95% identical to SEQ ID NO: 196, wherein any substitutions with respect to SEQ ID NO: 196 are conservative amino acid substitutions, wherein said nucleic acid construct further comprises a constitutive promoter operably linked to said polynucleotide, wherein said amino acid sequence increases biomass, growth rate and/or tolerance of a plant to abiotic stress conditions, wherein said abiotic stress is drought stress and/or nitrogen deficiency, and
   (b) selecting under said abiotic stress conditions plants transformed with said nucleic acid construct for an increased trait as compared to a control plant of the same species which is grown under the same growth conditions, wherein said abiotic stress conditions are such that cause adverse effect on metabolism, growth, reproduction and/or viability of a control plant, wherein said trait is selected from the group consisting of: dry weight, fresh weight, growth rate of root coverage, growth rate of rosette diameter, leaf blade area, leaf area, root coverage, root length, and rosette area,
   thereby increasing the growth rate, biomass, and/or abiotic stress tolerance of the plant.

2. The method of claim 1, further comprising growing the plant expressing said polynucleotide under the abiotic stress conditions for at least 10 days.

3. The method of claim 1, wherein said leaf blade area, said growth rate of rosette diameter and/or said rosette area is increased under drought-stress conditions employed for at least 10 days as compared to a control plant grown under the same conditions and for the same time duration.

4. The method of claim 1, wherein said fresh weight, said dry weight, said leaf area, said root coverage, said root length, and/or said growth rate of root coverage is increased under nitrogen deficiency employed for at least 10 days as compared to a control plant grown under the same conditions and for the same time duration.

5. A method of increasing growth rate, biomass, and/or abiotic stress tolerance of a plant, comprising:
   (a) transforming a plant with a nucleic acid construct comprising a polynucleotide encoding a polypeptide comprising an amino acid sequence at least 99% identical to the amino acid sequence selected from the group consisting of SEQ ID NOs: 196, 270, 4116, 4117, 4118, 4119, 4120, 4121, 4122, 4123, 4124, 4125, 4126, 4127, 4128, 4129, 4130, 4131, 4132, 4133, 4134, 4137, 4137, 4138, 4139, 4140, 4141, 4142, 4143, 4144, 4145, 4146, 4147, 4148, 4149, 4151, 4152, 4153, 4154, 4156, 4157, 4158, 4159, 4160, 4161, 4162, 4163, 4164, 4165, 4166, 4167, 4168, 4169, 4169, 4170, 4171, 4172, 4173, 4174, 4175, 4176, 4177, 4178, 4179, 6533, 6534, and 6535, wherein said nucleic acid construct further comprises a constitutive promoter operably linked to said polynucleotide, wherein said amino acid sequence increases biomass, growth rate and/or tolerance of a plant to abiotic stress, wherein said abiotic stress is drought stress and/or nitrogen deficiency, and
   (b) selecting under said abiotic stress conditions plants transformed with said nucleic acid construct for an increased trait as compared to a control plant of the same species which is grown under the same growth conditions, wherein said abiotic stress conditions are such that cause adverse effect on metabolism, growth, reproduction and/or viability of a control plant, wherein said trait is selected from the group consisting of: dry weight, fresh weight, growth rate of root coverage, growth rate of rosette diameter, leaf blade area, leaf area, root coverage, root length, and rosette area,
   thereby increasing the growth rate, biomass, and/or abiotic stress tolerance of the plant.

6. The method of claim 1, wherein said polypeptide comprises the amino acid sequence set forth in SEQ ID NO: 196.

7. The method of claim 5, wherein said polynucleotide comprises a nucleic acid sequence selected from the group consisting of SEQ ID NOs: 114, 15, 91, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 858, 859, 860, 861, 862, 863, 864, 865, 866, 867, 868, 869, 870, 871, 872, 873, 874, 875, 876, 877, 878, 879, 880, 881, 882, 883, and 884.

8. A method of reducing time to flowering and/or time to inflorescence emergence of a plant, comprising:
   (a) transforming a plant with a nucleic acid construct comprising a polynucleotide encoding a polypeptide comprising the amino acid sequence set forth by SEQ ID NO: 196 or a homologous polypeptide comprising an amino acid sequence at least 95% identical to SEQ ID NO: 196, wherein any substitutions with respect to SEQ ID NO: 196 are conservative amino acid substitutions, wherein said nucleic acid construct further comprises a constitutive promoter operably linked to said polynucleotide, wherein said amino acid sequence reduces time to flowering and/or time to inflorescence emergence, and
   (b) selecting plants transformed with said nucleic acid construct for a reduced time to flowering and/or for a reduced time to inflorescence emergence as compared to a control plant of the same species which is grown under the same growth conditions, thereby reducing time to flowering and/or time to inflorescence emergence of a plant of the plant.

9. The method of claim 8, wherein said polypeptide comprises the amino acid sequence set forth in SEQ ID NO: 196.

10. The method of claim 8, wherein said selecting of said plants in step (b) is for a reduced time to inflorescence emergence as compared to a control plant of the same species which is grown under the same growth conditions.

11. A method of reducing time to flowering and/or time to inflorescence emergence of a plant, comprising:
(a) transforming a plant with a nucleic acid construct comprising a polynucleotide encoding a polypeptide comprising an amino acid sequence selected from the group consisting of SEQ ID NOs: 196, 270, 4116, 4117, 4118, 4119, 4120, 4121, 4122, 4123, 4124, 4125, 4126, 4127, 4128, 4129, 4130, 4131, 4132, 4133, 4134, 4137, 4137, 4138, 4139, 4140, 4141, 4142, 4143, 4144, 4145, 4146, 4147, 4148, 4149, 4151, 4152, 4153, 4154, 4156, 4157, 4158, 4159, 4160, 4161, 4162, 4163, 4164, 4165, 4166, 4167, 4168, 4169, 4169, 4170, 4171, 4172, 4173, 4174, 4175, 4176, 4177, 4178, 4179, 6533, 6534, and 6535, wherein said nucleic acid construct further comprises a constitutive promoter operably linked to said polynucleotide, wherein said amino acid sequence reduces time to flowering and/or time to inflorescence emergence, and
(b) selecting plants transformed with said nucleic acid construct for a reduced time to flowering and/or for a reduced time to inflorescence emergence as compared to a control plant of the same species which is grown under the same growth conditions, thereby reducing time to flowering and/or time to inflorescence emergence of a plant of the plant.

12. The method of claim 11, wherein said polynucleotide comprises a nucleic acid sequence selected from the group consisting of SEQ ID NOs: 114, 15, 91, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 858, 859, 860, 861, 862, 863, 864, 865, 866, 867, 868, 869, 870, 871, 872, 873, 874, 875, 876, 877, 878, 879, 880, 881, 882, 883, and 884.

13. The method of claim 11, wherein said selecting said plants in step (b) is for a reduced time to inflorescence emergence as compared to a control plant of the same species which is grown under the same growth conditions.

* * * * *